(12) United States Patent
Johnson et al.

(10) Patent No.: US 12,371,689 B2
(45) Date of Patent: Jul. 29, 2025

(54) ENGINEERED ENVELOPED VECTORS AND METHODS OF USE THEREOF

(71) Applicant: GigaMune, Inc., San Francisco, CA (US)

(72) Inventors: David Scott Johnson, San Francisco, CA (US); Matthew James Spindler, San Francisco, CA (US); Robert Edgar, Corte Madera, CA (US); Yoong Wearn Lim, Pacifica, CA (US); Taylor Weller, San Mateo, CA (US)

(73) Assignee: GigaMune, Inc., San Francisco, CA (US)

( * ) Notice: Subject to any disclaimer, the term of this patent is extended or adjusted under 35 U.S.C. 154(b) by 0 days.

(21) Appl. No.: 18/462,747

(22) Filed: Sep. 7, 2023

(65) Prior Publication Data

US 2024/0067958 A1 Feb. 29, 2024

Related U.S. Application Data

(63) Continuation of application No. PCT/US2023/073206, filed on Aug. 30, 2023.
(Continued)

(51) Int. Cl.
*C12N 15/10* (2006.01)
*C12N 9/22* (2006.01)
(Continued)

(52) U.S. Cl.
CPC .......... *C12N 15/1082* (2013.01); *C12N 9/22* (2013.01); *C12N 15/1065* (2013.01); *C12N 15/11* (2013.01); *C12N 15/86* (2013.01); *C12N 15/907* (2013.01); C12N 2310/20 (2017.05); C12N 2740/15022 (2013.01); C12N 2740/15042 (2013.01); *C12N 2740/15052* (2013.01); *C12N 2800/80* (2013.01)

(58) Field of Classification Search
CPC .. C12N 15/1082; C12N 9/22; C12N 15/1065; C12N 15/11; C12N 15/86; C12N 15/907; C12N 2310/20; C12N 2740/15022; C12N 2740/15042; C12N 2740/15052; C12N 2800/80
USPC .......................................................... 506/14
See application file for complete search history.

(56) References Cited

FOREIGN PATENT DOCUMENTS

| WO | WO 2018/050738 A1 | 3/2018 |
| WO | WO 2020/139892 A1 | 7/2020 |

(Continued)

OTHER PUBLICATIONS

P07766 CD3E_Human. Entry Version 216, 2021. Uniprot [online]. 2021. [Retrieved on Feb. 10, 2024]. Retrieved from the Internet: <URL:https://rest.uniprot.org/unisave/P07766?format=txt&versions=216> (Year: 2021).*

(Continued)

*Primary Examiner* — Aaron A Priest
*Assistant Examiner* — Randi Lynn Beil
(74) *Attorney, Agent, or Firm* — Fenwick & West LLP

(57) ABSTRACT

The present disclosure relates to a novel, engineered enveloped vector that can be used for gene delivery. The engineered enveloped vector comprises an engineered envelope comprising: (a) a viral envelope protein and optionally, (b) a non-viral membrane-bound protein. The present disclosure also provides a method of making and using the engineered enveloped vector.

16 Claims, 23 Drawing Sheets

Specification includes a Sequence Listing.

Related U.S. Application Data

(60) Provisional application No. 63/402,936, filed on Aug. 31, 2022.

(51) Int. Cl.
　　*C12N 15/11*　　　(2006.01)
　　*C12N 15/86*　　　(2006.01)
　　*C12N 15/90*　　　(2006.01)

(56) References Cited

FOREIGN PATENT DOCUMENTS

| WO | WO-2020236263 A1 * | 11/2020 | ........... C07K 14/005 |
|---|---|---|---|
| WO | WO 2021/102585 A1 | 6/2021 | |
| WO | WO 2022/013872 A1 | 1/2022 | |
| WO | WO-2022204071 A1 * | 9/2022 | |
| WO | WO-2022261148 A1 * | 12/2022 | |

OTHER PUBLICATIONS

Q85213 Glyco_Piryv. Entry Version 78, 2021. Uniprot [online]. 2021. [Retrieved on Feb. 10, 2024]. Retrieved from the Internet: <URL:https://rest.uniprot.org/unisave/Q85213?format=txt&versions=78> (Year: 2021).*

Rhabdoviridae. Wikipedia. 9 pages, revision date Jun. 14, 2022 by user "AnomieBOT". [Retrieved on Feb. 10, 2024]. Retrieved from Internet: <URL:https://en.wikipedia.org/w/index.php?title=Rhabdoviridae&oldid=1093077909> (Year: 2022).*

Viral vector. Wikipedia. 9 pages. [Retrieved on Feb. 10, 2024]. Retrieved from Internet: <URL:https://en.wikipedia.org/wiki/Viral_vector> (Year: 2024).*

Frank et al. Surface-engineered lentiviral vectors for selective gene transfer into subtypes of lymphocytes. Molecular Therapy Methods & Clinical Development. 12, 2019, 19-31 (Year: 2019).*

Davidsson, M., et al., "Novel Barcode-Based In Vivo Screening Method for Generating De Novo AAV Serotypes for CNS-Directed Gene Therapy", Molecular Therapy, Elsevier Inc, US, vol. 24, No. Suppl. 1, Apr. 30, 2016 (Apr. 30, 2016), pp. S216-S217, XP009505626, ISSN: 1525-0016, DOI:10.1016/SI525-0016(16)33350-0 the whole document.

International Search Report and Written Opinion, Patent Cooperation Treaty Application No. PCT/US2023/073206, Dec. 5, 2023, 16 pages.

Xu, A., et al., "Integrated measurement of intracellular proteins and transcripts in single cells", Lab on a Chip, vol. 18, No. 21, Jan. 1, 2018 (Jan. 1, 2018), pp. 3251-3262, XP055764503, UK ISSN: 1473-0197, DOI: 10.1039/C8LC00639C, p. 3251-3262.

* cited by examiner

|  | VSV-G | SEQ ID 16530 | SEQ ID 16527 | SEQ ID 16526 | SEQ ID 16522 | SEQ ID 16523 | SEQ ID 16529 | SEQ ID 16525 | SEQ ID 16524 | SEQ ID 16528 |
|---|---|---|---|---|---|---|---|---|---|---|
| SEQ ID 16528 | 26% | 28% | 26% | 27% | 30% | 25% | 29% | 31% | 75% | 100% |
| SEQ ID 16524 | 26% | 27% | 27% | 29% | 30% | 26% | 28% | 32% | 100% | 76% |
| SEQ ID 16525 | 31% | 32% | 29% | 30% | 30% | 30% | 30% | 100% | 32% | 31% |
| SEQ ID 16529 | 39% | 40% | 44% | 51% | 53% | 55% | 100% | 30% | 28% | 29% |
| SEQ ID 16523 | 41% | 43% | 45% | 50% | 55% | 100% | 55% | 30% | 25% | 25% |
| SEQ ID 16522 | 40% | 40% | 47% | 52% | 100% | 55% | 53% | 30% | 30% | 30% |
| SEQ ID 16526 | 38% | 39% | 42% | 100% | 52% | 50% | 51% | 30% | 29% | 27% |
| SEQ ID 16527 | 38% | 40% | 100% | 42% | 47% | 45% | 44% | 29% | 27% | 26% |
| SEQ ID 16530 | 85% | 100% | 40% | 39% | 40% | 42% | 39% | 32% | 27% | 27% |
| VSV-G | 100% | 85% | 38% | 37% | 40% | 41% | 39% | 31% | 26% | 26% |

FIG. 18

| | CD3 | CD4 | CD8 | CD19 |
|---|---|---|---|---|
| SEQ ID 16528 | 0.0055 | 0.0517 | 0.3352 | 0.5293 |
| SEQ ID 16524 | 0.0002 | 0.0418 | 0.0511 | 0.1780 |
| SEQ ID 16525 | 0.0066 | 0.1146 | 0.0986 | 0.4323 |
| SEQ ID 16529 | 0.1513 | 0.0037 | 0.2542 | 0.2764 |
| SEQ ID 16523 | 0.3121 | 0.0343 | 0.5052 | 0.0386 |
| SEQ ID 16522 | 0.3807 | 0.0496 | 0.2600 | 0.0584 |
| SEQ ID 16526 | 0.4484 | 0.2531 | 0.8087 | 0.7297 |
| SEQ ID 16527 | 0.6062 | 0.1304 | 0.6817 | 0.4700 |
| SEQ ID 16530 | 0.3733 | 0.1768 | 0.6201 | 0.4246 |
| VSV-G | 0.2858 | 0.2512 | 0.8298 | 0.6609 |

FIG. 19

| | SEQ ID 16528 | SEQ ID 16524 | SEQ ID 16525 | SEQ ID 16529 | SEQ ID 16523 | SEQ ID 16522 | SEQ ID 16526 | SEQ ID 16527 | SEQ ID 16530 | VSV-G |
|---|---|---|---|---|---|---|---|---|---|---|
| CD3 | 0.9778 | 0.9987 | 0.9858 | 0.9889 | 0.9694 | 0.9707 | 0.8083 | 0.9259 | 0.9671 | 0.9504 |
| CD4 | 0.9939 | 0.9964 | 0.9615 | 0.9997 | 0.9981 | 0.9953 | 0.8637 | 0.9641 | 0.9395 | 0.9336 |
| CD8 | 0.9896 | 0.9980 | 0.9872 | 0.9973 | 0.9911 | 0.9962 | 0.9640 | 0.9765 | 0.9637 | 0.9266 |
| CD19 | 0.9855 | 0.9907 | 0.9899 | 0.9886 | 0.9994 | 0.9972 | 0.9386 | 0.9781 | 0.9531 | 0.9383 |

FIG. 20

```
CLUSTAL O(1.2.4) multiple sequence alignment
YP_008767242.1      ------MVRIICWLGLVLSVQAAKVILPVKLESDWVPVYSGERICQSHREKIPPGIYESL      54
UBB42397.1          -MWSA------VISATIPLVLSVPVILPAGRDGKWNDVPNGFRYCPAVGDEYSYGRAQTT      53
AG00862.1           -----MLSYLILAIIVSPILGKIEIVFPQHTTGDWKRVPHEYNYCPTSADKNSHGTQTGI      55
YP_009505530.1      MKMKMVIAGLILCIGILPAIGKITISFPQSLKGDWRPVPKGYNYCPTSADKNLHGDLIDI      60
ACB47442.1          ----MTPAFILCMLLAGSSWAKFTIVFPQSQKGDWKDVPPNYRYCPSSADQNWHGDLLGV      56
AAC02712.1          ----MNFLLLTFIVLPLCSHAKFSIVFPQSQKGNWKNVPSSYHYCPSSSDQNWHNDLLGI      56
AEI52254.1          -----MLRLFLFCFLALGAHSKFTIVFPHHQKGNWKNVPSTYHYCPSSSDQNWHNDLTGV      55
VSVG                --------------------KFTIVFPHNQKGNWKNVPSNYHYCPSSSDLNWHNDLIGT      39
AJR28459.1          ----MLVLYLLLSLLALGAQCKFTIVFPHNQKGNWKNVPANYQYCPSSSDLNWHNGLIGT      56
AJR28591.1          -MISITFVYLII--ILSLSWGEMMIPFPDVTTTTWKPVLKGEHHCPSSSDVDILSRMSTL      57
AFH89679.1          -MISSTL-ILVI--ISAHAFCDMIIPFPDVTTTSWKPVLRGEHHCPASNDLDMAGGLSTL      56
GI04017.1           -MESL-LKAICVLLLIHCSRCDLPIVFPDQKELLWNPVLKTNRYCPQTREIAPLDKPKTL      58
AEG25354.1          -MSSKIVLAAICLCSVQYVACSFQIVFPEFNNAAWLPYLKTSRYCPQSAEMEFERRVSTT      59
BAA05163.1          ---MDLFPILVVVLMTDTVLGKFQIVFPDQNELEWRPVVGDSRHCPQSSEMQFDGSRSQT      57
ASK84898.1          MKSSVTIGVMLIISFINPSYSSLSIAFPENTKLDWKPVTKNTRYCPMGGEWFLEPGLQEE      60
CAH17547.1          -MTSVLFMVGVLLGAFGSTHCSIQIVFPSETKLVWKPVLKGTRYCPQSAELNLEPDLKTM      59
YP_009513006.1      -MESLPFSALLAVLSITLCDSAIPIFFPSEPQLEWKPVLPGSRYCPQSNEMSLDPDLKKS      59
                                        :  :*        *         .  *          :

YP_008767242.1      KVEGQVPVRQQSQGADGYYCHKTIYSVLCDFKWYGVKRVRHSVKRDTPSYSECLKAVDDE      114
UBB42397.1          AITLLQPKSLEHEGAEGYLCHVAVYEATCDFRWYGVKYKTQKIRRQIPTDAECQAKQKAL      113
AG00862.1           PVELTMPKGLTTHQVDGFMCHSALWMTTCDFRWYGPKYITHSIHNEEPTDYQCLEAIKAY      115
YP_009505530.1      GLRLRAPKSFKGISADGWMCHAARWITTCDFRWYGPKYITHSIHSFRPSNDQCKEAIRLT      120
ACB47442.1          NIRAKMPKVHKAIKADGWMCHAAKWVTTCDYRWYGPQYITHSIHSFIPTKAQCEESIKQT      116
AAC02712.1          TMKVKMPKTHKAIQADGWMCHAAKWITTCDFRWYGPKYITHSIHSIQPTSEQCKESIKQT      116
AEI52254.1          SLHVKIPKSHKAIQADGWMCHAAKWVTTCDFRWYGPKYITHSIHSMSPTLEQCKTSIEQT      115
VSVG                AIQVKMPKSHKAIQADGWMCHASKWVTTCDFRWYGPKYITQSIRSFTPSVEQCKESIEQT      99
AJR28459.1          SLQVKMPKSHKAIQADGWMCHAAKWVTTCDFRWYGPKYVTHSIKSMIPTVDQCKESIAQT      116
AJR28591.1          KLQVRIPTGSVASKSDGLLCHGAKWVTTCDFRWYGSKYITHSLHSIRPTLSQCTEAAKAY      117
AFH89679.1          KMNVKIPSGVVGSKSDGYLCHGAKWVTTCDYRWYGAKYITHSLHPLRPSTSQCFDAIKAY      116
GI04017.1           KITTGVPVRSPKEKIEGYLCHSGKWVTTCDFRWYGAKYVTHSIHHLKPTDQMCRDAISQY      118
AEG25354.1          LLSADVPIGVTPTKSDGYLCHAAKWVTTCDFRWYGPKYVTHSIHDLTPAQVDCHEALARY      119
BAA05163.1          ILTGKAPVGITPSKSDGFICHAAKWVTTCDFRWYGPKYITHSIHHLRPTTSDCETALQRY      117
ASK84898.1          SFLSSTPIGATPSKSDGFLCHAAKWVTTCDFRWYGPKYITHSIHNIKPTRSDCDTALASY      120
CAH17547.1          AFDSKVPIGITPSNSDGYLCHAAKWVTTCDFRWYGPKYITHSVHSLRPTVSDCKAAVEAY      119
YP_009513006.1      TISVKVPIGVTPSKSDGYLCHGAKWVSTCDFRWYGPKYITHSIHNLRPTTNDCEDAIKKY      119
                        .         :*  **     :    **:;***  :   :.:;    *:   .  *

YP_008767242.1      ISGMSEYVGFPPPSCNYLVETRSQNIEIILSKHSVKIDDYKQSWMDSTFLDGGCSHAPCL      174
UBB42397.1          MAGRSDWVGPPSFSCNYASVTTEKHLEIVLVPHHVGVDDYLGLYVDPTLQDGSCVTPPCH      173
AG00862.1           KDGVGFNPGFPPQSCGYGTVTDAEAHIITVTPHSVKVDEYTGEWIDPHFIGGRCKGKICE      175
YP_009505530.1      NEGNWINPGFPPQSCGYASVTDSESVVVTVTKHQVLVDEYSGSWIDSQFPGGSCTSPICD      180
ACB47442.1          KEGVWINPGFPPKNCGYASVSDAESIIVQATAHSVMIDEYSGDWLDSQFPTGRCTGSTCE      176
AAC02712.1          KQGTWMSPGFPPQNCGYATVTDSVAVVVQATPHHVLVDEYTGEWIDSQFPNGKCETEECE      176
AEI52254.1          KQGVWINPGFPPQSCGYATVTDAEVVVVQATPHHVLVDEYTGEWIDSQLVGGKCSKEVCQ      175
VSVG                KQGTWLNPGFPPQSCGYATVTDAEAVIVQVTPHHVLVDEYTGEWVDSQPINGKCSNYICP      159
AJR28459.1          KQGTWLNPGFPPQSCGYATVTDAEAVIVKATPHQVLVDEYTGEWVDSQFPTGKCNKDICP      176
AJR28591.1          KEGRLMAPGFPPPESCGWNSVTDSELLSILVTPHHTGVDDYRGIWIDSMFPGGECKEMVCD      177
AFH89679.1          REGTLLSPGFPPPESCGWNSVTDSELLSIQITPHHSGVDDYRGVWIDSMFPKGECDQRICD      176
GI04017.1           NGGTLLNPGFPPEVCGYASVTDSELIITLITPHTVGVDDYRGLWIDPSFPNGECNSIVCE      178
AEG25354.1          KAGTLFNPGFPPASCGYATITDSEQKVVMTPHHVGIDDYRGKWIDPIFPGGECTTNYCE      179
BAA05163.1          KDGSLINLGFPPESCGYATVTDSEAMLVQVTPHHVGVDDYRGHWIDPLFPGGECSTNFCD      177
ASK84898.1          KSGTLVSPGFPPESCGYASVTDSEFLVIMITPHHVGVDDYRGHWVDPLFVGGECDQSYCD      180
CAH17547.1          NAGTLMYPGFPPESCGYASITDSEFYVMLVTPHPVGVDDYRGHWVDPLFPTSECNSNFCE      179
YP_009513006.1      EAGTLINPGFPPDSCAYATVTDSEHLVILITPHHVGVDDYRGAWDDSFPSGVCETNQCD      179
                       .   ***     *  *   :               *    :*:*   ::*   :   .  *     *
```

FIG. 21

```
YP_008767242.1   TTVPGTLWIPTDN-L-TSACDITFRKQEFTIYYPKQKPAHLSSDQIFITSPYHPVSSLSK    232
UBB42397.1       TLYEDTLWLPKASPKPGGPCDLEFHEHRGIIRYPIPRA-GMSMANFQISGPTIPTATLDG    232
AG00862.1        TVHNSTKWFTSSD-G-ESVCSQLFTLVGGTFFSDSEEITSMGLPETGIRSNYFPYITTEG    233
YP_009505530.1   TVHNSTLWHADHT-L-DSICDQEFVAMDAVLFTESGKFEEFGKPNSGIRSNYFPYESLKD    238
ACB47442.1       TIHNSTLWYADYQ-V-TGLCDSALVSTEVTFYSEDGLMTSIGRQNTGYRSNYFPYEKGAA    234
AAC02712.1       TVHNSTVWYSDYK-V-TGLCDATLVDTEITFFSEDGKKESIGKPNTGYRSNYFAYEKGDK    234
AEI52254.1       TVHNSTVWHADYK-I-TGLCESNLASVDITFFSEDGQKTSLGKPNTGFRSNHFAYESGEK    233
VSVG             TVHNSTTWHSDYK-V-KGLCDSNLISMDITFFSEDGELSSLGKEGTGFRSNYFAYETGGK    217
AJR28459.1       TVHNSTTWHSDYK-V-TGLCDANLISMDITFFSEDGKLTSLGKEGTGFRSNYFAYENGDK    234
AJR28591.1       TVQGHTIWMSTSN-L-TTACGVAFKQIQGQFYYLNSGH-QPNKEGTFFHSPNHPNSPLST    234
AFH89679.1       TVQEHSIWIAANN-V-SSACSIAFKQLEGYFYYRNSGI-QPNKDGTFFHSSHHPNSPMSS    233
GI04017.1        TIHNSTKWVSKGE-MPTDICQQTFTTIKMDVSYPSDTT--SQGSLLSFHSPYHPHISGKD    235
AEG25354.1       TLHNSSVWLPADE-KIVDICAQTFRKIKVTATYPSEGA--VTKETISLHSAYHPVPGTG    236
BAA05163.1       TVHNSSVWIPKSQ-K-TDICAQSFKNIKMTASYPSEGA--LVSDRFAFHSAYHPNMPGST    233
ASK84898.1       TIHNSSVWIPADS-TKKNICGQSFTPLTVTVAYDKTKE--IAAGGIVFKSKYHSHMEGAR    237
CAH17547.1       TVHNATMWIPKDL-KTHDVCSQDFQTIRVSVMYPQTKP--TKGADLTLKSKFHAHMKGDR    236
YP_009513006.1   TTHNSSIWIPKTK-TRHNICSQTFANLSVTISYREGGA--MKGADMVFHSKYHPMVGGH    236
                  *  : *          *                            .

YP_008767242.1   SCLITLCGKTGIRLFGGSWSSLDNHKSFHDIKIE-TLLSNCKSSTEIYSSPPDLRNIRMV    291
UBB42397.1       ACHMGICGKWGIRLRSGVWVGVKERPMLQGMDLYETFMHPCAPNATISAGHFNPGALKMI    292
AG00862.1        ICKMPFCRKPGYKLKNDLWFQITDPDLDKTVRDL-PHIKDCDLSSSIITPGEHATDISLI    292
YP_009505530.1   VCQMDFCKRKGFKLFSGVWFEIEDAEKSHKAQVE-LKIKRCPHGAVISAPNQNAADINLI    297
ACB47442.1       ACRMKYCTHEGIRLPSGVWFEMVDKELLE-----S-VQMPECPAGLTISAPTQTSVDVSLI    289
AAC02712.1       VCKMNYCKHAGVRLPSGVWFEFVDQDVYA----A-AKLPECPVGATISAPTQTSVDVSLI    289
AEI52254.1       ACRMQYCTQWGIRLPSGVWFELVDKDLFQ----A-AKLPECPRGSSISAPSQTSVDVSLI    288
VSVG             ACKMQYCKHWGVRLPSGVWFEMADKDLFA----A-ARFPECPEGSSISAPSQTSVDVSLI    272
AJR28459.1       ACRMQYCKHWGVRLPSGVWFEMADKDIYN----D-AKFPDCPEGSSIAAPSQTSVDVSLI    289
AJR28591.1       ACRKKYCNQEGIVIHTGEWIGVPWNTRIRDVQLD-SYTDLCAESTEIKSTIGSAPIRVIA    293
AFH89679.1       CCRIKYCNQEGLVIGVAWNTKIRDVTLD-SYTDTCPGGTEVKSTIGSSPTRVVA    292
GI04017.1        ICKMSYCGSNGLRLPNGEWFSIINTSKIGNKNLI-DFFSPCKAGVEVRSTLQSEGSQTIA    294
AEG25354.1       ICRMTYCSKEGLRLPNGEWLGIFYDNRIKTTDVR-TVFPACPDGLEVKSTLNSDGANTIA    295
BAA05163.1       VCIMDFCEQKGLRFTNGEWMGLNVEQSIREKKIS-AIFPNCVAGTEIRATLESEGARTLT    292
ASK84898.1       TCRLSYCGRNGIKFPNGEWVSLDVKTKIQEKPLL-PLFKECPAGTEVRSTLQSDGAQVLT    296
CAH17547.1       VCKMKFCNKNGLRLGNGEWIEVGDEVMLDNSKLL-SLFPDCLVGSVVKSTLLSEGVQTAL    295
YP_009513006.1   ICKMNFCNKQGLRLQNEEWIEIPSGTKVGNQDLM-NLFSDCKSGLEVRSTLRSEGANTLT    295
                      *     *    :   *                   *       :  :

YP_008767242.1   WDLERVIENSLCQGTWDKIETRQKITPLDLNYLSPSEPGPGWGFIPKNGSIHKAQILYIR    351
UBB42397.1       WDAGRLLGYSLCQKTWDKLDRGDSITPLDLSYLNPVSPGPGLGFLSINGTLKMAKLRFSR    352
AG00862.1        SDVERILDYALCQNTWGKIEAGEPITPVDLSYLGPKNPVGPVFTIINSSLHYFTSKYLR    352
YP_009505530.1   MDVERILDYSLCQATWSKIQNKEALTPIDISYLGPKNPGPGPAFTIINGTLHYFNTRYIR    357
ACB47442.1       LDVERMLDYSLCQETWSKVHSGLPISPVDLGYIAPKNPGAGPAFTIVNGTLKYFDTRYLR    349
AAC02712.1       LDVERILDYSLCQETWSKIRSKQPVSPVDLYLAPKNPGTGPAFTIINGTLKYFETRYIR    349
AEI52254.1       QDVERILDYSLCQETWSKIRAKLPVSPVDLYLAPKNPSGPAFTIINGTLKYFETRYIR    348
VSVG             QDVERILDYSLCQETWSKIRAGLPISPVDLSYLAPKNPGTGPAFTIINGTLKYFETRYIR    332
AJR28459.1       QDVERILDYSLCQETWSKIRAHLPISPVDLSYLAPKNPGTGPAFTIINGTLKYFETRYIR    349
AJR28591.1       WEMERVMDFALCQTVWDKVNRGDPLSPLDLSYLSSRAPGKGLAYTIINETLHVAHVRYIR    353
AFH89679.1       WEMERIMDFALCQNVWDKVNRGEQLSPLDLSYLSSRAPGKGLAYTIINETLHVAHVRYIR    352
GI04017.1        WETQRMLDYALCQNTWDKFERGEPLSPLDLNYLAPRVPGKGMAYTIINNTLHSSHAVYRR    354
AEG25354.1       WETQRMLDYALCQSTWDKVQNKEPLSAVDLSYLSARSPGKGLAYTVINGTLHFAHVRYVR    355
BAA05163.1       WETQRMLDYALCQNTWDKVSRKEPLSPLDLSYLSPRAPGKGMAYTVINGTLHSAHAKYIR    352
ASK84898.1       SEIQRILDYSLCQNTWDKVEREKPLSPLDLSYLASKSPGKGLAYTVINGTLAFAHTRYVR    356
CAH17547.1       WETDRLLDYSLCQNTWEKIDRKEPLSAVDLSYLAPRSPGKGMAYIVANGSLMSAPARYIR    355
YP_009513006.1   WETQRLLDYALCQNTWDKFDNQGAVSALDLSYLAARSPAGKGVAYTMINGTLHSAPTRYVR    355
                   :*:: ;***  .*   * .         :: .*:.*;    ** *    : *  ::        ;  *
```

FIG. 21 (cont'd)

```
YP_008767242.1   ADVDDDTIALGQ-KYNKGKDEFYPNWNDWELLNGIKIGPNGIITNXTHVRIPYYSVGIGK    410
UBB42397.1       VELPEGMIRNYDSNS----LNPYQFQWQRWVPHGNVLVGPNGITLNGSTVKFPFFMVGVGR    409
AG00862.1        VELESPVIPRMEGRV-AGTRIVRQLWDQWPPFGEAEIGPNGVLKTQGYKFPLHIIGTGE    411
YP_009505530.1   VDIAGPVTKEITGFV-SGTSTSRVLWDQWFPYGENSIGPNGLLKTASGYKYPLFMVGTGV    416
ACB47442.1       IDIEGPVLKKMTGKV-SGTPTKRELWTEWFPYDDVEIGPNGVLKTPEGYKFPLYMIGHGL    408
AAC02712.1       IDIDNPIISKMVGKI-SGSQTERELWTEWFPYEGVEIGPNGILKTPTGYKFPLFMIGHGM    408
AEI52254.1       VDISNPIIPHMVGTM-SGTTTERELWNDWYPYEDVEIGPNGVLKTPTGFKFPLYMIGHGM    407
VSVG             VDIAAPILSRMVGMI-SGTTTERELWDDWAPYEDVEIGPNGVLRTSSGYKFPLYMIGHGM    391
AJR28459.1       VDIAGPIIPQMRGVI-SGTTTERELWTDWYPYEDVEIGPNGVLKTATGYKFPLYMIGHGM    408
AJR28591.1       TYIKAPIMEEIKGSRGDRSAAESVLWTQWFPYGDGEIGPNGLLKTNGSFKFPPFYLVGMGA    413
AFH89679.1       TWIKGPVLKEIKGRRGSSSAAEDTLWIQWFPFGDNQIGPNGLLKSNGTPKFPFYLVGVGA    412
GI04017.1        VWIEGPIIGEMKGKIESATGVAKEIWAQWFPFGDNQIGPNGVIKTNDGIKFPLYAIGTGL    414
AEG25354.1       TWIDGPVLKDLKGSRFDPTAAQKTLWDQWFPFGSNEIGPNGLLKTPKDFKFPLYIIGTGL    415
BAA05163.1       TWIDYGEMKEIKGGRGEYSKAPELLWSQWFDFGPFKIGPNGLLHTGKTPKFPLYLIGAGI    412
ASK84898.1       MWIDGPVLKELKGKRESPSGISSDIWTQWFKYGDMEIGPNGLLKTAGGYKFPWHIGMGI    416
CAH17547.1       VWIDSPILKEIKGKKESASGIDTVLWEQWLPPNGMELGPNGLIKTKSGYKFPLYLLGMGI    415
YP_009513006.1   MWIESPSMEELKAKKESSSGVETSIWNQWPFKGGEIGPNGLIKAGNKYKFPLYLVGMGM    415
                         :       *    *     :***:        :   * . :*  *

YP_008767242.1   LDEDMITPDEVGVIHHIDHLKQRVLVQ---TNLDRVWIHEGENGDLITSVSHWWH--DVI    465
UBB42397.1       LDSDLTEAESIDLLTHHDIKHSHMLHP----VDDRYDWSKSGESGDLIKHIESWFTIPDWI    466
AG00862.1        VDSDIKMERIVKHWEHPHIEPAQTYLKKDDTEEVIYYGDTGISKNPVEVVEGWFS--GWR    469
YP_009505530.1   LDADIHKLGEATVIEHPHAKEAQVKVVD---DSEVIFFGDTGVSKNPVEVVEGWFS--GWR    471
ACB47442.1       LDSDLQKTSQAEVFHHPQIAEAVQKLP---DDETLFFGDTGISKNPVEVIEGWFS--NWR    463
AAC02712.1       LDSDLHKTSQAEVFEHPHLAEAPKQLP---EEETLFFGDTGISKNPVELIEGWFS--SWK    463
AEI52254.1       LDSDLHKSSQAQVFEHPHAKDAASQLP---DDETLFFGDTGLSKNPVELVEGWFS--SWK    462
VSVG             LDSDLHLSSKAQVFEHPHIQDAASQLP---DDESLFFGDTGLSKNPIELVEGWFS--SWK    446
AJR28459.1       LDSDLHISSKAQVFEHPHIQDAASQLP---DDETLFFGDTGLSKNPIELVEGWFS--GWK    463
AJR28591.1       IDDDLIELSNADPIDHPQKAIASVHLN---TDEELFFGNTGSDSNPVEAVEGWFA--SWK    468
AFH89679.1       LDEDLIEMANADPVDHLQRVDAETHMR---GDEELFPGDTGVSKNPIESVEGWFS--NWI    467
GI04017.1        IDQDIHELSEVSPMDHPHLVHAKKYVS---EDDEIYFGDTGVSHNPVEIFSGWFT--NWK    469
AEG25354.1       VDEDLQELSEAGPIDHPQIPDASGILP---NSEQVYYGDTGVSKNPIELIEGWFA--NWK    470
BAA05163.1       IDEDLHELDEAAPIDHPQMPDAKSVLP---EDEEIFPGDTGVSKNPIELIQGWFS--NWR    467
ASK84898.1       VDNELHELSEANPLDHPQLPHAQSIAD---DSEEIFPGDTGVSKNPVELVTGWFT--SWK    471
CAH17547.1       VDQDLQELSSVNPVDHPHVPIAQAFVS---EGEEVFFGDTGVSKNPIELISGWFS--DWK    470
YP_009513006.1   LDDEINALELGGPIDHPQRAHAQAVLG---DEETLFPGDTGVGKNPVELITGWFS--GWK    470
                 :* ::        *  .             .    *     *:  .  .  *

YP_008767242.1   KHSWEIFALIG-----GLFSLSC----ICSLCSCRKKRRE------------SRHQETMSFV    506
UBB42397.1       KYCV----IIVVCVLLIIVLGCMTLV-KLRKRPRPPG----RRDPEIPLSSTS-----FL    512
AG00862.1        SSIMGVVAVIIGFVILIFLIRLIGVLS-SLFRPKRRP----------IYKSDVEMAHFR    517
YP_009505530.1   SSLMSIFGIILLIVCLVLIVRILIALKYCCVRHKKRT-----------IYKEDLEMGRIP    520
ACB47442.1       SSVMAIVFAILLLVITVLMVRLCVAFRH---FCCQKRH----------KIYNDLEMNQLR    510
AAC02712.1       STVVTFFFAIGVFILLYVVARIVIAVRYRYQGSN--NK----------RIYNDIEMSRFR    511
AEI52254.1       STLASFFLIIGLGVALIPIIRIIVAIRYKYKG--RKTQ----------KIYNDVEMSRLG    510
VSVG             SSIASFFFIIGLIIGLFLVLRVGIHLCIKLKHTK--KR----------QIYTDIEMNRLG    494
AJR28459.1       STIASFFFIIGLVIGLYLVLRIGIALCIKRVQEKRP---------KIYTDVEMNRLD    512
AJR28591.1       SAGINMALIVLCVLLVLIFLRSLPALIKLIHRYRVSR---S---------RQTDVELNSIN    517
AFH89679.1       SGLPNISIIVLCVLSVLIVFKSVITLIRVVRRRRRPR--A----------EEDVELNNMN    515
GI04017.1        EGLMKFSILVLSILIFYVVIRLVMCIPLKCKKERKPRL-----EFELQPREWEYSRA---    521
AEG25354.1       ETVMSIVGLVLLITIVFTVLKC---IGTCRSLRRKRK---IEKDIELQE-IGPYQP---T    520
BAA05163.1       ESVMAIVGIVLLIVVTFLAIKT----VRVLNCLWRPKKKRIVRQEVDVESRLNHFEMRGFP    524
ASK84898.1       ESLAAGVVLILVVLS-----FPVLCTFCKPWK---KGV---ERSDSFEMRIFK    522
CAH17547.1       ETAAALGFAAISVLILIIGLMRL----LPLLCRRRKQKK--------V----IYKDVELNSFD    516
YP_009513006.1   ETIMAVVAIFLLVIVLYGVLRC---CPTICVLCKRKS-------R---HRTKDMEMQYIP    517
                 .

YP_008767242.1   ----------------------------------------    506
UBB42397.1       ----------------------------------------    512
AG00862.1        ----------------------------------------    517
YP_009505530.1   RRA-------------------------------------    523
ACB47442.1       R---------------------------------------    511
AAC02712.1       K---------------------------------------    512
AEI52254.1       NK--------------------------------------    512
VSVG             K---------------------------------------    495
AJR28459.1       R---------------------------------------    513
AJR28591.1       ETA--RTGSVGPDIIPGAWRVH---DSGVRQSQFFRNNPRRLGP    556
AFH89679.1       PRPQTRQPVGAPNIIPGAWGIQPSHGRGVRQSQFVKRSALNIVT    559
GI04017.1        ----------------------------------------    521
AEG25354.1       TYRP-------------R----------------------    525
BAA05163.1       EYVK-------------R----------------------    529
ASK84898.1       PNNM-----------RARV---------------------    530
CAH17547.1       PRQA-----------FHR----------------------    523
YP_009513006.1   NNQR-----------HWR----------------------    524
```

FIG. 21 (cont'd)

ENGINEERED ENVELOPED VECTORS AND METHODS OF USE THEREOF

1. CROSS REFERENCE TO RELATED APPLICATIONS

This application is a continuation of International Application No. PCT/US2023/073206, filed Aug. 30, 2023, which claims priority to U.S. Provisional Application No. 63/402,936 filed Aug. 31, 2022, each of which is hereby incorporated by reference in its entirety.

2. SEQUENCE LISTING

The instant application contains a Sequence Listing which has been submitted electronically and is hereby incorporated by reference in its entirety. Said xml file, created on Aug. 30, 2023, is named 53443WO_sequencelisting.xml and is 22,452,493 bytes in size.

3. BACKGROUND

Viral vectors, such as retroviruses, lentiviruses, adenoviruses, adeno-associated viruses (AAVs), have revolutionized the field of gene delivery by offering gene transfer capabilities. Viral vectors have been used for development of gene therapy for treatment of genetic disorders, cancers, and infectious diseases. However, they have limitations that hinder broader clinical applications.

One significant limitation is a low efficiency in delivering genes to certain target cells, particularly non-dividing or hard-to-transduce cell types. This restricts their therapeutic potential and necessitates improvement of transduction efficiency. Additionally, viral vectors often trigger immune responses in the host, leading to complications and reduced efficacy. Immune responses can result in vector clearance, neutralization of vector particles, and inflammatory reactions, thereby limiting repeated administration and long-term gene expression. Precise targeting and selectivity of viral vectors to specific cell types or tissues are also needed. Improving vector specificity would minimize off-target effects, enhance therapeutic efficacy, and reduce potential side effects. Further, we need vectors with improved safety profiles.

Development of vector systems without these improvements are crucial to accelerate the translation of gene therapy into effective clinical treatments.

4. SUMMARY

The present disclosure provides a novel, engineered enveloped vector that can be used for gene transfer. The engineered enveloped vector comprises an engineered envelope comprising: (a) a viral envelope protein and optionally, (b) a non-viral membrane-bound protein.

This disclosure is based on the finding that a vector comprising a viral-envelope protein (e.g., a "fusogen") with limited binding (e.g., tropism) to mammalian cells and overexpression of a second non-viral membrane-bound protein can target and enter into a target cell because the second non-viral membrane-bound protein works for viral entry and gene delivery (e.g., a "target cell tropism protein"). The vector can further comprise a third membrane protein, i.e., a functional modulator protein, that allows modulation of the target cell function upon binding to the target cell (e.g., a "functional modulator").

These discoveries, as described herein, enable new and innovative methodologies to deliver nucleic acids to target cells in a target-specific manner. Additionally, this vector can be used to screen cells that have been notoriously challenging to screen for specific antigens and function (e.g., T cells) and to test interactions between surface proteins on the engineered enveloped vectors and the target cells.

In one aspect, the present disclosure provides an engineered enveloped vector (e.g., an engineered lentivirus) comprising an engineered envelope, wherein the engineered envelope comprises: (a) a viral envelope protein having at least 90%, 95%, 96%, 97%, or 99% sequence identity to a sequence selected from SEQ ID NOs: 1-167 or SEQ ID NOs: 8154-16497; and (b) optionally, a non-viral membrane-bound protein comprising: (i) an optional signal peptide (S); (ii) an extracellular targeting domain (ETD); and (iii) a membrane-bound domain (MBD). In some embodiments, the engineered enveloped vector comprises (i) a non-viral membrane-bound protein having the structure of S-ETD-MBD, wherein S represents a signal sequence, ETD represents an extracellular targeting domain and MBD represents a membrane-bound domain; and (ii) a mutated viral envelope protein comprising at least one mutation that diminishes its native function. In some embodiments, the non-viral membrane-bound protein is encoded by a polynucleotide comprising a structure: S-ETD-MBD-IRES-R, wherein S encodes a signal sequence, ETD encodes an extracellular targeting domain; MBD encodes a membrane-bound domain, IRES encodes an internal ribosome entry site, and R encodes a reporter.

The vector can comprise one or more mutated viral envelope proteins described in patent publications WO 2020/236263 A1 and US 2020/0216502, and in Nikolic et al., *Nature Comm.*, 2018, 9:1029, the relevant disclosures of which are incorporated by reference herein for this particular purpose.

Some aspects of the disclosure provide compositions of an engineered enveloped vector (e.g., an engineered lentivirus), comprising (i) a functional modulator protein (e.g., a cell surface signal protein domain); and (ii) a non-mutated viral envelope protein, a viral envelope protein fragment or truncated viral envelope protein, or mutated comprising at least one mutation that diminishes its native function (fusogen). The functional modulator protein can be an extracellular domain of a natively cell membrane-embedded cell surface protein, or an endogenous secreted protein tethered to the engineered enveloped vector with a fusion domain that embeds the protein in the cell membrane. In some embodiments, the functional modulator protein binds to a receptor on a target cell.

Some aspects of the disclosure provide methods of screening a population of cells, the method comprising (i) providing an engineered enveloped vector (e.g., an engineered lentivirus) comprising a non-mutated "wild type" viral envelope protein, a viral envelope protein fragment or truncated viral envelope protein, or a mutant comprising at least one mutation that diminishes its native function (fusogen), a non-viral membrane-bound protein comprising a membrane-bound domain (MBD) and an extracellular targeting domain (target cell tropism protein) (ETD), a functional modulator protein (e.g., a lentivirus-embedded protein ligand or receptor), and a nucleic acid encoding a reporter; (ii) interacting the engineered enveloped vector with a population of cells; and (iii) sorting the population of cells based on the presence or absence of the reporter. In some embodiments, the nucleic acid delivered by the engineered enveloped vector encodes a nucleic acid barcode which is expressed by the target cell upon delivery of the nucleic acid. In some embodiments, the target cell is previously engineered to express a separate nucleic acid barcode which identifies the cell type or identity. In some embodiments, the vector barcode and the cell barcode are sequenced at a single cell level to identify which vector has been delivered to which cell targets. In some embodiments, the engineered enveloped vector (e.g., an engineered lentivirus) comprises a nucleic acid comprising a coding sequence of a non-viral membrane-bound protein comprising a structure: S-ETD-MBD-IRES-R, wherein S encodes a signal sequence, ETD encodes an extracellular targeting domain; MBD encodes a membrane-bound domain, IRES encodes an internal ribosome entry site, and R encodes a reporter.

In some embodiments, the engineered enveloped vector comprises a viral envelope protein and/or other genomic sequences from a coronavirus, flavivirus, togavirus, arenavirus, bunyavirus, filovirus, orthomyxovirus, paramyxovirus, rhabdovirus, or any retrovirus other than a lentivirus.

In some embodiments, the target cells are somatic cells (e.g., antigen-specific cells, T cells or B cells). In some embodiments, the cells are isolated from a subject (e.g., a human subject). In some embodiments, the cells are isolated from blood or a tumor of a subject. In some embodiments, the cells are maintained in liquid culture prior to interacting with the engineered enveloped vector. In some embodiments, the target cells are primary human or mouse cells which have been immortalized through cell engineering approaches. In some embodiments, the target cells are immortal mammalian cell lines which have been engineered to express target proteins recombinantly.

In some embodiments, the viral envelope protein comprises one or more of any of SEQ ID NOs: 1-167. In some embodiments, the viral envelope protein has at least 90%, 95%, 96%, 97%, or 99% sequence identity to a sequence selected from SEQ ID NOs: 1-167 or SEQ ID NOs: 8154-16497.

In some embodiments, the viral envelope protein is a chimera between two or more of any of SEQ ID Nos: 1-167 or SEQ ID NOs: 8154-16497. In some embodiments, the viral envelope protein is any fragment or domain of any of SEQ ID NOs: 1-167 or SEQ ID NOs: 8154-16497, for example, a sequence substantially comprising the transmembrane domain and a fragment of the extracellular domain. In some embodiments, the viral envelope protein is a VSV-G envelope protein, a measles virus envelope protein, a nipah virus envelope protein, or a cocal virus G protein. In some embodiments, the viral envelope protein is a VSV-G envelope protein have a mutation at any one or more of H8, K47, Y209, and/or R354. In some embodiments, the viral envelope protein is a measles virus envelope protein having a mutation at one or more of Y481, R533, 5548, and/or F549. In some embodiments, the viral envelope protein is a Nipah virus envelope protein having a mutation at one or more of E501, W504, Q530, and/or E533. In some embodiments, the viral envelope protein is a Cocal virus G protein having a mutation at K64 and/or R371. In some embodiments, the viral envelope protein comprises one or more mutations (e.g., deletion, insertion, substitution or chemical modification) to any of SEQ ID NOs: 1-167 or SEQ ID NOs: 8154-16497 which confer beneficial properties, for example, reduced or increased binding to target cells of interest, or reduced or increased immunogenicity, or reduced or increased half-life in vivo or in vitro.

In some embodiments, a non-viral membrane-bound protein comprises a Major Histocompatibility Complex (MHC) protein or a modification thereof. In some embodiments, the a non-viral membrane-bound protein is a protein (e.g., interleukin-13), a peptide, or an antibody (e.g., anti-CD19 antibody (SEQ ID NO: 8130), an anti-TCR antibody, anti-MHC antibody, anti-CD8 antibody (SEQ ID NO: 8137), anti-CD5 antibody (SEQ ID NO: 16512), anti-CD4 antibody (SEQ ID NO: 8135), an anti-CD7 antibody (SEQ ID NOs: 16513, 16514, 16515), an anti-CD3 antibody (SEQ ID 8133), an anti-CD117 antibody (SEQ ID 16511), or an anti-GPRC5D antibody (SEQ ID NOs: 16516-16519), or a modification thereof.

In some embodiments, the viral envelope protein is fused to one or more different molecules. In some embodiments, the one or more different molecules comprise a guide RNA and an exogenous endonuclease.

In some embodiments, the engineered enveloped vector further comprises a nucleic acid construct encapsulated in the engineered envelope.

In some embodiments, the nucleic acid construct comprises a coding sequence of a reporter protein. In some embodiments, the reporter is a fluorescent protein (e.g., green fluorescent protein, yellow fluorescent protein, red fluorescent protein) or an antibiotic resistance marker. In some embodiments, the nucleic acid construct comprises a coding sequence of a transgene, optionally wherein the transgene is a therapeutic gene. In some embodiments, the nucleic acid construct comprises a sequence for inhibitory RNA, catalytic RNA, or CRISPR/Cas9 or other site-specific endonuclease-mediated mutagenesis. In some embodiments, the nucleic acid construct comprises a barcode sequence. In some embodiments, the nucleic acid construct comprises (i) a coding sequence of a reporter protein, (ii) a coding sequence of a therapeutic gene, (iii) inhibitory RNA, (iv) catalytic RNA, or (iii) a sequence for CRISPR/Cas9, CRISPR/Cas12a, or other site-specific endonuclease-mediated mutagenesis.

In some embodiments, the engineered enveloped vector comprises a non-viral membrane-bound protein. In some embodiments, a linker is positioned between the membrane-bound domain and the extracellular targeting domain. A linker may be a rigid linker (e.g., a PDGFR stalk or a CD8a stalk), the Fc domain from an IgG, a flexible linker (e.g., comprising an amino acid sequence comprising GAPGAS, SEQ ID NO 16548 or GGGGS, SEQ ID 16549), or an oligomerized linker (e.g., an IgG4 hinge or an amino acid sequence that can form a tetrameric coiled coil).

In some embodiments, the non-viral membrane-bound protein comprises any one or more of any of SEQ ID NOs: 168-5339, which are known or predicted membrane proteins. In some embodiments, these non-viral membrane bound proteins are functional modulators. In some embodiments, these non-viral membrane bound proteins are cell tropism receptors. In some embodiments, the non-viral membrane-bound protein comprises one or more of any of SEQ ID NOs: 168-5339. In some embodiments, the non-viral membrane-bound protein comprises a secreted protein, for example known or predicted to be secreted proteins SEQ ID NOs: 5340-8121, which must be tethered to the vector surface by fusing the secreted protein to the transmembrane domain of another protein, e.g., to generate a recombinant chimeric protein. In some embodiments, the non-viral membrane-bound protein comprises one or more amino acid mutations to any of SEQ ID NOs: 168-8121 which confer beneficial properties, for example, reduced or increased binding to target cells of interest, or reduced or increased immunogenicity, or reduced or increased half-life in vivo or in vitro.

In some embodiments, a linker is positioned between the membrane-bound domain of the non-viral membrane-bound protein and its extracellular targeting domain. A linker may be a rigid linker (e.g., a PDGFR stalk or a CD8a stalk), the Fc domain from an IgG, a flexible linker (e.g., comprising an amino acid sequence comprising GAPGAS, SEQ ID NO 16548, or GGGGS, SEQ ID 16549), or an oligomerized linker (e.g., an IgG4 hinge or an amino acid sequence that can form a tetrameric coiled coil).

In some embodiments, the non-viral membrane-bound protein comprises any one or more selected from SEQ ID NOs: 168-5339, which are known or predicted membrane proteins. In some embodiments, the non-viral membrane-bound protein comprises a chimera of one or more selected from SEQ ID NOs: 168-5339. In some embodiments, the non-viral membrane-bound protein is a secreted protein, for example known or predicted secreted proteins selected from SEQ ID NOs: 5340-8121, which must be tethered to the vector surface by fusing the secreted protein to the transmembrane domain of another protein, i.e., to generate a recombinant chimeric protein. In some embodiments, the non-viral membrane-bound protein comprises any amino acid mutation to any of SEQ ID NOs: 168-5339 which confer beneficial properties, for example, reduced or increased binding to target cells of interest, or reduced or increased immunogenicity, or reduced or increased half-life in vivo or in vitro. In some embodiments, a linker is positioned between the membrane-bound domain (MBD) of the non-viral membrane-bound protein and its extracellular targeting domain (ETD). A linker may be a rigid linker (e.g., a PDGFR stalk or a CD8a stalk), the Fc domain from an IgG, a flexible linker (e.g., comprising an amino acid sequence comprising GAPGAS, SEQ ID NO 16548, or GGGGS, SEQ ID 16549), or an oligomerized linker (e.g., an IgG4 hinge or an amino acid sequence that can form a tetrameric coiled coil).

In some embodiments, the extracellular targeting domain (ETD) comprises a T cell receptor, antibody, MHC protein, or a modification thereof. In some embodiments, the extracellular targeting domain (ETD) comprises a targeting domain of a target cell tropism protein, and the membrane-bound domain (MBD) comprises a membrane domain of the target cell tropism protein. In some embodiments, the target cell tropism protein has a sequence selected from SEQ ID NOs 168-8121, or a fragment thereof. In some embodiments, the extracellular targeting domain (ETD) comprises an antibody specific to CD3, CD4, CD5, CD7, CD8, CD19, CD20, or CD117.

In some embodiments, the non-viral membrane-bound protein further comprises an Fc domain and a linker positioned between the extracellular targeting domain (ETD) and the membrane-bound domain (MBD). In some embodiments, the viral envelope protein comprises at least one amino acid insertion, deletion or substitution compared to a protein having a sequence selected from SEQ ID NOs: 1-167 or SEQ ID NOs: 8154-16497.

In another aspect, the present disclosure provides a library of engineered enveloped vectors disclosed herein. In some embodiments, the library comprises 10, 100, 1,000, 10,000, 100,000, 1,000,000, or 10,000,000 unique clones of the engineered enveloped vector.

In some embodiments, each clone of the engineered enveloped vectors comprises a unique nucleic acid barcode. In some embodiments, each clone of the engineered enveloped vectors comprises a unique extracellular targeting domain (ETD). In some embodiments, each clone of the engineered enveloped vectors comprises a unique viral envelope protein.

In one aspect, the present disclosure provides a method of delivering a transgene or modifying a target cell using the engineered enveloped vector or the library disclosed herein.

In another aspect, the present disclosure provides a method of gene therapy using the engineered enveloped vector or the library. In some embodiments, the engineered enveloped vector is combined in vitro with the population of cells in (ii) for one minute to seventy-two hours and at a temperature ranging from 4° C. to 42° C. In some embodiments, the engineered enveloped vector and the population of cells are combined in (ii) in the presence of (a) a cell culture media, optionally RPMI or DMEM cell culture media; (b) a buffered saline solution, optionally phosphate-buffered saline or HEPES-buffered saline; and/or (c) an enhancer of retroviral transduction, optionally heparin sulfate, polybrene, protamine sulfate, and/or dextran. In some embodiments, the extracellular targeting domain (ETD) of the engineered enveloped vector is capable of binding to a cognate protein (e.g., a protein receptor) that is present on the cell surface of a subset of the population of cells. In some embodiments, the population of cells is washed between (ii) and (iii) (e.g., using phosphate-buffered saline (PBS), e.g., to remove the remaining engineered enveloped vector from the population of cells). In some embodiments, sorting the population of cells is performed using fluorescence-activated cell sorting, single-cell next-generation sequencing, or antibiotic selection.

In some embodiments, the target cell is an immune cell, optionally selected from a T cell and a Treg cell. In some embodiments, the target cell is an immune cell in a human subject.

In some embodiments, the nucleic acid construct comprises (i) a coding sequence of a reporter protein, (ii) a coding sequence of a therapeutic gene, (iii) inhibitory RNA, (iv) catalytic RNA, or (iii) a sequence for CRISPR/Cas9, CRISPR/Cas12a, or other site-specific endonuclease-mediated mutagenesis. In some embodiments, the nucleic acid construct comprises a coding sequence of a T cell receptor (TCR) or chimeric antigen receptor (CAR). In some embodiments, the nucleic acid construct comprises a coding sequence of an endogenous gene such as dystrophin.

In some embodiments, the engineered enveloped vector is administered by intravenous or subcutaneous administration.

In some embodiments, the methods further comprise use of a second engineered enveloped vector, wherein the second engineered enveloped vector comprises a different extracellular targeting domain (ETD) and/or a different nucleic acid encoding a different reporter compared to the first engineered enveloped vector.

Other aspects of the disclosure provide methods of delivering a nucleic acid (e.g., a gene of interest, e.g., that encodes a protein) to a target cell, the method comprising (i) providing an engineered enveloped vector comprising the nucleic acid, a viral envelope protein or its mutant comprising at least one mutation that diminishes its native function (fusogen), a non-viral membrane-bound protein comprising a membrane-bound domain and an extracellular targeting domain (target cell tropism protein); and (ii) contacting the engineered enveloped vector with the cell, thereby delivering the nucleic acid to the cell. In some embodiments, the engineered enveloped vector enters the cell during (ii). In some embodiments, the methods further comprise delivering a nucleic acid barcode, which can be used to traceback transduction events to a specific engineered enveloped vector of libraries of two or more engineered enveloped vectors. In some embodiments, gene delivery is performed in vivo by subcutaneous, intravenous, intramuscular, or intradermal injection. In some embodiments, gene delivery is performed in vitro or ex vivo using populations of primary cells or immortal cells.

In some embodiments, the engineered enveloped vectors are formulated to be encapsulated in lipid nanoparticles. In some embodiments, the engineered enveloped vectors encapsulated in lipid nanoparticles are administered in vivo by subcutaneous, intravenous, intramuscular, or intradermal injection. In some embodiments, the lipid nanoparticle encapsulation increases the half-life of the engineered enveloped vector, improves pharmacokinetics, improves biodistribution by targeting therapeutically relevant cell types.

In some embodiments, lipid nanoparticles comprising lipids tethered or attached to one or more proteins of any of SEQ ID Nos: 1-167 or SEQ ID NOs: 8154-15596 are used to deliver nucleic acids to target cells. In some embodiments, lipid nanoparticles comprising lipids tethered or attached to one or more proteins of any of SEQ ID Nos: 1-167 or SEQ ID NOs: 8154-15596 are used to deliver CRISPR/Cas proteins, zinc fingers, or other recombinant proteins for genome engineering.

Some aspects of the disclosure provide methods of delivering a nucleic acid to a cell, the method comprising (i) providing a engineered enveloped vector comprising the nucleic acid, a viral envelope protein (fusogen), and a non-viral membrane-bound protein, for example, SEQ ID NOs:168-5339; and (ii) contacting the engineered enveloped vector with the target cell, thereby delivering the nucleic acid to the cell.

Yet other aspects of the disclosure provide methods of blocking an interaction between an engineered enveloped vector and a cell, the method comprising contacting a sample comprising the engineered enveloped vector and a cell with an antibody, wherein the engineered enveloped vector comprises a fusogen, and a non-viral membrane-bound protein, and wherein the antibody binds to the cognate binder of the non-viral membrane-bound protein on the target cell surface. In some embodiments, the antibody blocks the interaction between the non-viral membrane-bound protein and its target cell protein target, thereby preventing transduction of the engineered enveloped vector payload into the target cell. In some embodiments, this method is performed on tens, hundreds, thousands, or tens of thousands of targets of the non-viral membrane-bound protein in parallel, such that the antibody can be used to identify interactions between complex mixtures of the non-viral membrane-bound protein and their cognate protein targets or target cell types.

Some aspects of the disclosure provide libraries of engineered enveloped vectors, comprising a plurality of unique engineered enveloped vectors, wherein each unique vector comprises a viral envelope protein (fusogen), a non-viral membrane-bound protein (e.g., target cell tropism protein), and a nucleic acid encoding a reporter, and wherein each unique vector comprises a different and unique extracellular targeting domain (ETD). Some aspects of the disclosure provide libraries of the engineered enveloped vectors, comprising a plurality of unique vectors, wherein each unique vector comprises a viral envelope protein (fusogen), a non-viral membrane-bound protein (e.g., target cell tropism protein), a functional modulator protein, and a nucleic acid encoding a reporter, and wherein each unique vector comprises a different and unique extracellular targeting domain (ETD). In some embodiments, the library of engineered enveloped vectors comprises a library of barcodes delivered as payloads into target cells. In some embodiments, the libraries of engineered enveloped vectors comprise tens, hundreds, thousands, tens of thousands, hundreds of thousands, or millions of unique vector types in a single mixture.

In some embodiments, a library of engineered enveloped vectors is derived from a library of packaging cells wherein the envelope protein is engineered into a plurality of the genomes of the packaging cells. In some embodiments, a plurality of the genomes of the packaging cells comprises a single envelope protein. In some embodiments, the library of packaging cells is used to make a library of engineered enveloped vectors, by transfecting the library of packaging cells with packaging plasmids which induce secretion of engineered enveloped vectors from the packaging cells. In some embodiments, this library of engineered enveloped vectors is used to transduce target cells. In some embodiments, the library of engineered enveloped vectors comprises a library of lentiviral transgenes expressing viral envelopes. In some embodiments, the transduced target cells are then sequenced to assess which viral envelope proteins were associated with successful transduction. In some embodiments, said transduction is done in vitro, for example into an immortal cell line, a library of different immortal cell lines, or primary peripheral blood mononuclear cells. In some embodiments, said transduction is done by infusing or injecting the library in vivo, i.e., into a mouse, rat, or dog.

In some embodiments, a library of engineered enveloped vectors is derived from a library of packaging cells wherein a non-viral membrane-bound protein (e.g., antibody or antibody fragment, or scFv) is engineered into a plurality of the genomes of the packaging cells. In some embodiments, a plurality of the genomes of the packaging cells comprises a single non-viral membrane-bound protein. In some embodiments, the library of packaging cells is used to make a library of engineered enveloped vectors, by transfecting the library of packaging cells with packaging plasmids which induce secretion of engineered enveloped vectors from the packaging cells. In some embodiments, this library of engineered enveloped vectors is used to transduce target cells. In some embodiments, the library of engineered enveloped vectors comprises a library of lentiviral transgenes expressing non-viral membrane-bound protein (e.g., antibody or antibody fragment, or scFv). In some embodiments, the transduced target cells are then sequenced to assess which non-viral membrane-bound proteins were associated with successful transduction. In some embodiments, said transduction is done in vitro, for example into an immortal cell line, a library of different immortal cell lines, or primary peripheral blood mononuclear cells. In some embodiments, said transduction is done by infusing or injecting the library in vivo, i.e., into a mouse, rat, or dog.

In some embodiments, a library of engineered enveloped vectors is capable of being screened against a population of antigen-specific cells, optionally wherein the antigen-specific cells are B cells or T cells. A library may comprise at least $10^2$, at least $10^3$, at least $10^4$, at least $10^5$, at least $10^6$, at least $10^7$, at least $10^8$, at least $10^9$, or at least $10^{10}$ unique vectors. In some embodiments, each different and unique extracellular targeting domain (ETD) of the engineered enveloped vector is generated through site-directed mutagenesis. In some embodiments, the library or population of cells is engineered recombinantly to comprise a plurality of unique cell types which express as RNA unique nucleic acid barcodes, or which comprise unique nucleic acid barcodes in their genomes, or which have unique RNA expression patterns that can be used to identify specific cells. In some embodiments, the population of cells is engineered into multicellular organisms, optionally as antigen-specific B cells or T cells grafted into immune-deficient mice.

Some aspects of the disclosure provide methods of using single cell capture and high-throughput nucleic acid sequencing to identify interactions between the engineered enveloped vector and target cells. In some embodiments, a single vector type is provided with a library of diverse cell types. In some embodiments, a single cell type is provided with a library of diverse vector types. In some embodiments, a diverse library of vectors is provided with a diverse library of cell types. Some aspects of the invention involve capturing single cells into emulsion microdroplets or microfluidic chambers, such that a plurality of single cells are isolated with a plurality of single engineered enveloped vectors. In some embodiments, transduction of the vector into a target cell is measured by sequencing a nucleic acid barcode delivered to the cell and thereby expressed as RNA in the cell and sequencing a nucleic acid barcode already expressed into the cell as RNA. In some embodiments, a barcode is not used, rather, sequencing is used to identify delivered transgenes directly. In some embodiments, transduction delivers a gene that confers selection resistance, and transduced cells are selected with a drug (e.g., antibiotic). In some embodiments, transduction delivers a reporter, such as a fluorescent protein, and FACS is used to select transduced cells. In some embodiments, the selected transduced cells are subsequently isolated into emulsion microdroplets or microfluidic chambers, and RNA barcodes are linked by overlap extension RT-PCR. In some embodiments, the overlap extension RT-PCR molecules are sequenced en masse using high-throughput sequencing, and interactions between diverse libraries of engineered enveloped vectors and target cells are thereby deconvoluted. In some embodiments, RNA barcodes from engineered enveloped vectors are linked in emulsion microdroplets or microfluidic chambers by overlap extension RT-PCR to the whole transcriptomes of cells, or panels of 10, 100, or 1,000 transcripts, such that cell identity or phenotype is linked to the RNA barcode of the engineered enveloped vector via high-throughput sequencing of the overlap-extension RT-PCR.

In some embodiments, the method comprises (a) contacting a plurality of single cells comprising a first nucleic acid barcode with the engineered enveloped vector of the present disclosure, wherein the engineered enveloped vector comprises a second nucleic acid barcode, such that the engineered enveloped vector delivers the second nucleic acid barcode into said single cells; (b) isolating each of the plurality of said single cells into an individual compartment wherein each individual compartment is a microdroplet in an emulsion; (c) obtaining transcripts from each of the single cells; (d) reacting the transcripts from each of the single cells with a set of first probes and a set of second probes, wherein each of the first probes (i) is configured to bind to a first target polynucleotide comprising the first nucleic acid barcode and (ii) comprises a sequence of or complementary to a non-human, exogenous sequence, and wherein each of the second probes (iii) is configured to bind to a second target polynucleotide comprising the second nucleic acid barcode and (iv) comprises a sequence of or complementary to the non-human, exogenous sequence; and (e) performing reverse transcription followed by PCR amplification using the set of first probes and the set of second probes, thereby generating a fused complex comprising the first nucleic acid barcode and the second nucleic acid barcode.

In some embodiments, the method the step of sequencing the fused complex. In some embodiments, each individual compartment has an average volume of 1 nanoliter (nL). In some embodiments, the step (b) further comprises introducing an mRNA capture agent and a cell lysis solution into the individual compartments. In some embodiments, the method comprises obtaining sequences from at least 10,000 individual cells or at least 5,000 fused complexes.

In some embodiments, the step (e) comprises performing overlap extension reverse transcriptase polymerase chain reaction to link the first nucleic acid barcode and the second nucleic acid barcode. In some embodiments, the first nucleic acid barcode and the second nucleic acid barcode are different.

In some embodiments, the step (a) comprises contacting the plurality of single cells with the library of engineered enveloped vectors disclosed herein. In some embodiments, the plurality of single cells comprises a library of 10, 100, 10,000, 100,000, 1,000,000 or more genetically distinct cells. In some embodiments, the plurality of single cells comprise a library of 10, 100, 10,000, 100,000, 1,000,000 cells, each comprising a unique first nucleic acid barcode.

In other aspects, the present disclosure provides a method of identifying a pair of an engineered enveloped vector and a target cell, comprising (a) contacting a plurality of single cells with the engineered enveloped vector disclosed herein, wherein the engineered enveloped vector comprises an exogenous nucleic acid, such that the engineered enveloped vector delivers the exogenous nucleic acid into said single cells; (b) isolating each of a plurality of said single cells into an individual compartment wherein each individual compartment is a microdroplet in an emulsion and each of said single cells comprises a first nucleic acid barcode; (c) obtaining transcripts from each of the single cells; and (d) performing reverse transcription followed by PCR amplification, thereby generating a fused complex comprising the first nucleic acid barcode and the exogenous nucleic acid. In some embodiments, the exogenous nucleic acid encodes a reporter protein. In some embodiments, the exogenous nucleic acid comprises a second nucleic acid barcode. In some embodiments, the method further comprises the step of sequencing the fused complex. In some embodiments, the first barcode sequence is attached to a bead. In some embodiments, the exogenous nucleic acid comprises a coding sequence of a reporter protein and the method further comprises sorting, selecting, or isolating cells which express the reporter protein.

In some embodiments, each individual compartment has an average volume of 1 nanoliter (nL). In some embodiments, the step (b) further comprises introducing an mRNA capture agent and a cell lysis solution into the individual compartments.

In some embodiments, the method comprises obtaining sequences from at least 10,000 individual cells or at least 5,000 fused complexes. In some embodiments, step (a) comprises contacting the plurality of single cells with the library of engineered enveloped vectors disclosed herein. In some embodiments, the plurality of single cells comprises 10, 100, 10,000, 100,000, 1,000,000 or more unique cells.

Some aspects of the disclosure provide populations of cells, wherein a subset of the population of cells contain an engineered enveloped vector comprising: a viral envelope protein (fusogen), a non-viral membrane-bound protein, and a nucleic acid encoding a reporter. Some aspects of the disclosure provide populations of cells, wherein a subset of the population of cells contain an engineered enveloped vector comprising: a viral envelope protein (fusogen), a non-viral membrane-bound protein, a non-viral functional modulator protein, and a nucleic acid encoding a reporter. In some embodiments, a subset of the population of cells (e.g., antigen-specific cells, e.g., B cells or T cells) contains an engineered enveloped vector as described herein. In some embodiments, the subset of the population of cells contains an engineered enveloped vector inside each cell of the subset. The subset of the population that contain the engineered enveloped vector may be isolated and/or sorted from the cells of the population that do not contain the vector.

5. BRIEF DESCRIPTION OF THE DRAWINGS

FIG. 1 depicts an exemplary schematic of an engineered enveloped vector of the current invention with a functional modulator protein interacting with its cognate ligand in a target cell, thereby generating a signal cascade in the target cell, a non-viral membrane-bound protein (e.g., target cell tropism protein) such as an scFv, interacting with its cognate cell type-specific cell surface target on the target cell, and a fusogenic pseudotype, which drives fusion of the vector into the target cell.

FIG. 2 depicts an exemplary schematic of an engineered enveloped vector of the current invention with a non-viral membrane-bound protein (e.g., a target cell tropism protein such as an scFv), interacting with its cognate cell type-specific cell surface target on the target cell, and a fusogenic pseudotype, which drives fusion of the vector into the target cell.

FIG. 3 depicts an exemplary schematic of an engineered enveloped vector of the current invention with a functional modulator protein interacting with its cognate ligand on a target cell, thereby generating a signal cascade in the target cell, which also serves as a non-viral membrane-bound protein (e.g., a target cell tropism protein), interacting with its cognate cell type-specific cell surface target on the target cell, and a fusogenic pseudotype, which drives fusion of the lentivirus or retrovirus into the target cell.

FIG. 4 depicts methods used to identify novel fusogens which can be used for an engineered enveloped vector of the current invention. A query sequence is used to search a genomic sequencing database using a cloud-based sequence search algorithm. A tree of candidate sequences is generated and the fusogens are tested for function (e.g., cell type-specificity, efficiency of gene delivery, stability, etc.) in vitro.

FIG. 5 depicts methods used to test the function (e.g., cell type-specificity, efficiency of gene delivery, stability, etc.) of novel fusogens in vitro. Unique vector types have unique barcodes, and unique cells or cell types have unique barcodes. After transducing the library of engineered enveloped vectors into the library of cells, microfluidics is used to isolate single cells and link barcodes of the engineered enveloped vectors, thereby determining the functional properties of each unique vector in the library. Optionally, prior to microfluidics, transduced cells are purified or selected on the basis of reporters or cell selection genes.

FIG. 6 depicts methods used to test the function (e.g., cell type-specificity, efficiency of gene delivery, stability, etc.) of novel fusogens and cognate pairs of antibodies or scFvs in vitro. Unique vector types have unique barcodes, and unique cells or cell types have unique barcodes. After transducing the library of engineered enveloped vectors into the library of cells, microfluidics is used to isolate single cells and link vector barcodes, thereby determining the functional properties of each unique vector (specifically, pairings between scFv and fusogen) in the library. Optionally, prior to microfluidics, transduced cells are purified or selected on the basis of reporters or cell selection genes.

FIG. 7 depicts methods used to test the function (e.g., cell type-specificity, efficiency of gene delivery, stability, etc.) of novel fusogens and functional modulator proteins (i.e., "surfaceome" libraries of >1,000 endogenous cell surface proteins displayed on lentivirus) in vitro. Unique vector types have unique barcodes, and unique cells or cell types have unique barcodes. After transducing the library of engineered enveloped vectors into the library of cells, microfluidics is used to isolate single cells and link vector barcodes, thereby determining the functional properties of each unique vector (specifically, pairings between surfaceome and cell types) in the library. Optionally, prior to microfluidics, transduced cells are purified or selected on the basis of reporters or cell selection genes.

FIG. 8 depicts methods used to test the function (e.g., cell type-specificity, efficiency of gene delivery, stability, etc.) of novel fusogens and cognate pairs of functional modulator proteins (i.e., "surfaceome" libraries of >1,000 endogenous cell surface proteins displayed on lentivirus) in vitro. Unique vector types have unique barcodes. After transducing the library of engineered enveloped vectors into the target cells, microfluidics is used to isolate single cells and link vector barcodes to RNA transcripts of interest in the target cells, thereby determining the functional properties of each unique vectors (specifically, any functional changes in the target cells, putatively induced by the functional modulator proteins) in the library. Optionally, prior to microfluidics, transduced cells are purified or selected on the basis of reporters or cell selection genes.

FIG. 9 depicts methods used to identify cells transduced by unique lentivector in a library of engineered enveloped vectors. A population or library of cells is transduced with a library of vectors which comprises unique barcodes, which identify the vector and its particular composition. Optionally, transduced cells are purified or selected on the basis of reporters or cell selection genes. Microfluidics is used to isolate single cells with a bead which comprises an mRNA capture probe and a nucleic acid barcode. Subsequently, cDNA synthesis and PCR are performed, which link the bead's barcode to cDNA generated from at least one RNA transcript from the single cell. The result is a library of cDNA, isolated from a plurality of single cells, barcoded on a single cell level. The library of cDNA is sequenced to identify RNA transcripts expressed by cells transduced by a vector with a unique barcode.

FIG. 10 depicts methods used to identify cells transduced by unique vector in a library of engineered enveloped vectors. A population or library of barcoded cells is transduced with a library of engineered enveloped vectors which comprises unique barcodes or other uniquely identifiable sequences, which identify the vector and its particular composition. Optionally, transduced cells are purified or selected on the basis of reporters or cell selection genes. Microfluidics is used to isolate single cells with a bead which comprises an mRNA capture probe. Subsequently, cDNA synthesis and PCR are performed, which link cDNA generated from a reporter or other RNA transcript comprising the vector barcode to cDNA generated from at least one barcoded RNA transcript from the single cell ("cell barcode"). The result is a library of fused cDNA, isolated from a plurality of single cells, barcoded on a single cell level. The library of cDNA is sequenced to identify pairings between unique vector barcodes and unique cell barcodes, with the goal of mapping interactions between proteins expressed on engineered enveloped vector and cell types.

FIG. 11 depicts a flow cytometry analysis showing mRuby gene delivery to T cells by engineered enveloped vectors comprising (i) one of four different fusogen candidates (Candidate A: SEQ ID NO: 84, Candidate B: SEQ ID NO: 113, Candidate C: SEQ ID NO: 121, and Candidate D: SEQ ID NO: 2) and (ii) a non-viral membrane-bound protein which is anti-CD19 targeting (encoded by DNA construct SEQ ID NO: 8130), anti-CD3 targeting (encoded by DNA construct SEQ ID 8133), or no targeting; a total of 12 engineered enveloped vectors were assessed.

FIG. 12 depicts flow cytometry showing mRuby gene delivery to specific PBMC populations, using engineered enveloped vectors containing fusogen Candidate C: SEQ ID NO: 121. The engineered enveloped vectors also comprise a non-viral membrane-bound protein targeting CD19 (encoded by DNA construct SEQ ID NO: 8130), CD4 (encoded by DNA construct SEQ ID 8135), and CD8 (encoded by DNA construct SEQ ID 8137). The anti-CD19, anti-CD4, or anti-CD8 scFv-directed vector mediated delivery of mRuby (x-axis) into CD4 & CD8 T cells (top; CD3+ parental gating), and CD19 B cells (bottom; CD20+ parental gating) is provided.

Figure 17:
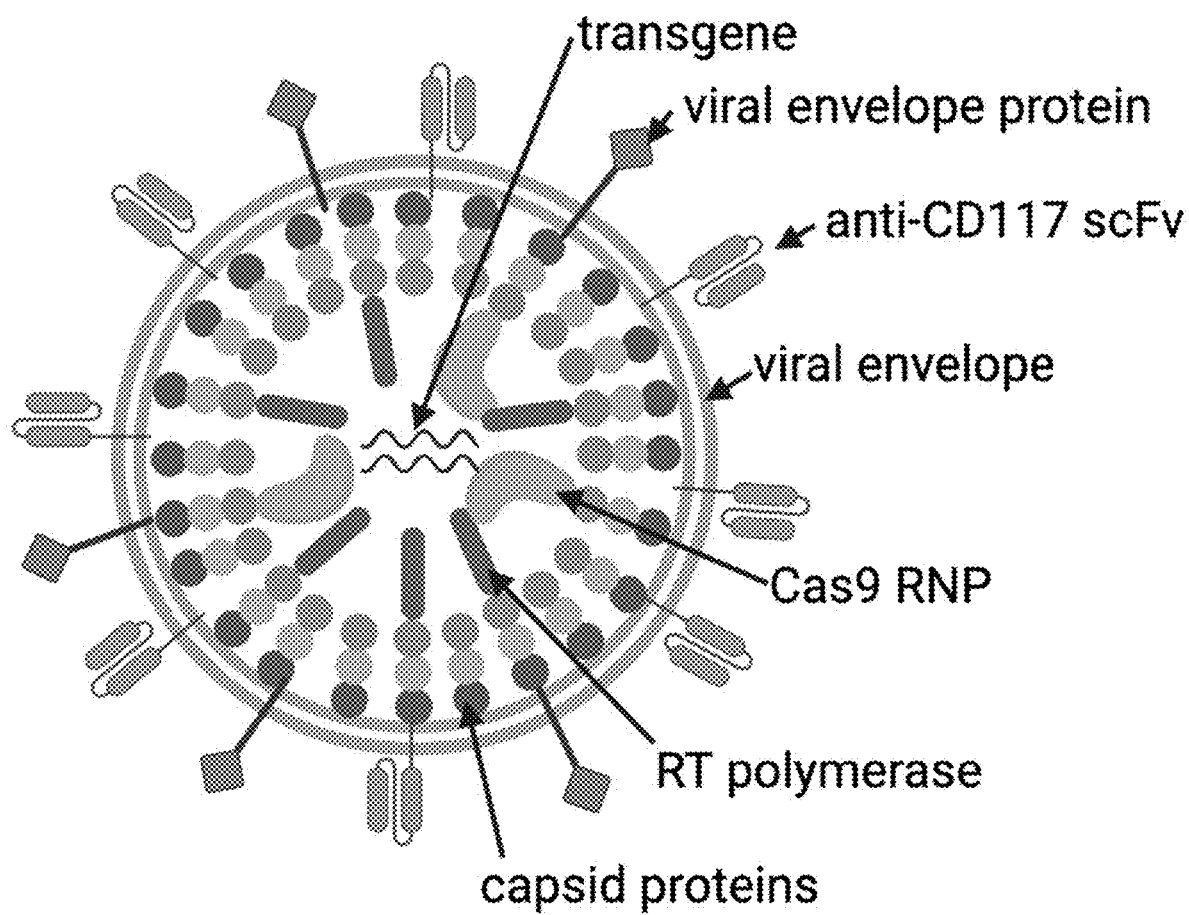

FIG. 17. An example lentivector for delivery of Cas9 RNP to hematopoietic stem cells (HSCs), using anti-CD117 scFv and a viral envelope protein for HSC targeting. The Cas9 RNP is initially attached to viral capsid proteins, but proteolytically cleaved prior to transduction of the target cells.

FIG. 18. Sequences comprising VSV-G and 9 envelope proteins (SEQ ID NOs: 16522-16530) were subjected to a multiple alignment using Clustalw. Clustalw was used to compute the percent amino acid identity for each pairwise sequence comparison. The table shows these percent identities.

FIG. 19. Fifty lentivectors were made, comprising VSV-G and 9 envelope proteins (SEQ ID NOs: 16522-16530), delivering GFP reporter transgene, with and without scFv directed against CD19, CD3, CD4, and CD8 for cell-type-specific tropism (non-viral membrane-bound protein). The scFvs comprised the following sequences: CD19 (encoded by DNA construct SEQ ID NO: 8130), anti-human CD4 (SEQ ID 8135), and anti-human CD8 scFv (encoded by DNA construct SEQ ID 8137), and an anti-CD3 antibody (encoded by DNA construct SEQ ID 8133). Lentivectors were used to transduce human PBMCs, and flow cytometry was used to stain for relevant cell types and GFP. For each lentivector, sensitivity was calculated using the equation Sensitivity=True Positive/(True Positive+False Negative). The table shows the sensitivities for each lentivector.

FIG. 20. Fifty lentivectors were made, comprising VSV-G and 9 envelope proteins (SEQ ID NOs: 16522-16530), delivering GFP reporter transgene, with and without scFv directed against CD19, CD3, CD4, and CD8 for cell-type-specific tropism (non-viral membrane-bound protein). The scFvs comprised the following sequences: CD19 (encoded by DNA construct SEQ ID NO: 8130), anti-human CD4 (encoded by DNA construct SEQ ID 8135), and anti-human CD8 scFv (encoded by DNA construct SEQ ID 8137), and an anti-CD3 antibody (encoded by DNA construct SEQ ID 8133). Lentivectors were used to transduce human PBMCs, and flow cytometry was used to stain for relevant cell types and GFP. For each lentivector, specificity was calculated using the equation Specificity=True Negative/(True Negative+False Positive). The table shows the specificities for each lentivector.

FIG. 21 is a sequence alignment of putative fusogens identified as described in Example 1. YP_008767242.1 is SEQ ID NO. 84, UBB42397.1 is SEQ ID NO. 2, AG00862.1 is SEQ ID NO. 36, YP_009505530.1 is SEQ ID NO. 76, ACB47442.1 is SEQ ID NO. 58, AAC02712.1 is SEQ ID NO. 9, AEI52254.1 is SEQ ID NO. 159, VSVG is SEQ ID NO. 16547, AJR28459.1 is SEQ ID NO. 70, AJR28591.1 is SEQ ID NO. 161, AFH89679.1 is SEQ ID NO. 87, GI04017.1 is SEQ ID NO. 8, AEG25354.1 is SEQ ID NO. 60, BAA05163.1 is SEQ ID NO. 121, ASK84898.1 is SEQ ID NO. 69, CAH17547.1 is SEQ ID NO. 155, and YP_009513006.1 is SEQ ID NO. 142.

6. DETAILED DESCRIPTION OF THE INVENTION

The present disclosure provides an engineered enveloped vector comprising an engineered envelope, wherein the engineered envelope comprises:
(a) a viral envelope protein having at least 90%, 95%, 96%, 97%, or 99% sequence identity to a sequence selected from SEQ ID NOs: 1-167; and
(b) optionally, a non-viral membrane-bound protein (S-ETD-MBD) comprising:
  (i) an optional signal peptide (S);
  (ii) an extracellular targeting domain (ETD); and
  (iii) a membrane-bound domain (MBD).

The engineered enveloped vector can be used to deliver nucleic acids to target cells in a target-specific manner. Accordingly, the new vector system can be used for gene therapy as well as for experimental purposes.

Herein are provided new and innovative methods, for example, to screen cells that are notoriously challenging to screen for specific antigens and function (e.g., T cells). In some embodiments, described herein are systems that enable, for example, repertoire-scale analysis of T cell receptor (TCR)-peptide-Major Histocompatibility Complex (pMHC) specificity, a previously intractable bottleneck, as previously described methods required considerable effort to determine what a single T cell clone can recognize (e.g., as in a typical immune response).

In another aspect, described herein are retrovirus- or retrovirus-based systems that repurpose viral tropism as a method of selecting for molecular interactions and replace the binding functions of wild-type virus surface proteins with those of protein variants of interest, for example, by encoding these protein variants on the corresponding transfer plasmid used to make the virus, thereby ensuring that the resulting virus displays the protein variant on its surface and packaging the corresponding genetic sequence. As such, when the virus enters a target cell (e.g., bearing a receptor that binds the displayed extracellular targeting domain of the protein variant), cell entry results in integration of the genetic sequence of the displayed protein into the genome of the target cell.

Previous approaches for studying T cell specificity required a combination of generated T cell lines, recombinant expression of T cell receptors, and/or the individual validation of T cell binding or activity via a candidate antigen-based approach. Each of these elements provided an inherent limitation in the throughput of T cells or antigens screened. For example, yeast display based methods to deorphanize T cell receptors alleviated the bottleneck of number of antigens examined (with the ability to screen $>10^8$ ligands), but were still severely limited by the need to recombinantly express TCRs. The current strategies of the present invention described herein represents a tremendous advance in the study of T cell specificity and screening of T cells by allowing for screening of $>10^8$ ligands and eliminating needs for recombinant TCR expression.

6.1. Engineered Enveloped Vectors

Described herein is an engineered enveloped vector comprising a viral envelope protein (e.g., "fusogen"). In some embodiments, the engineered enveloped vector further comprises a non-viral membrane-bound protein comprising a membrane-bound domain (MBD), an extracellular targeting domain (target cell tropism protein) (ETD), and optionally a signal peptide. In some embodiments, the engineered enveloped vector further comprises a nucleic acid of a transgene (e.g., a reporter, a gene payload, or a nucleic acid barcode). The nucleic acid can be encapsulated in the engineered envelop comprising the viral envelop protein or a modification thereof, and a non-viral membrane-bound protein.

Figure 1:
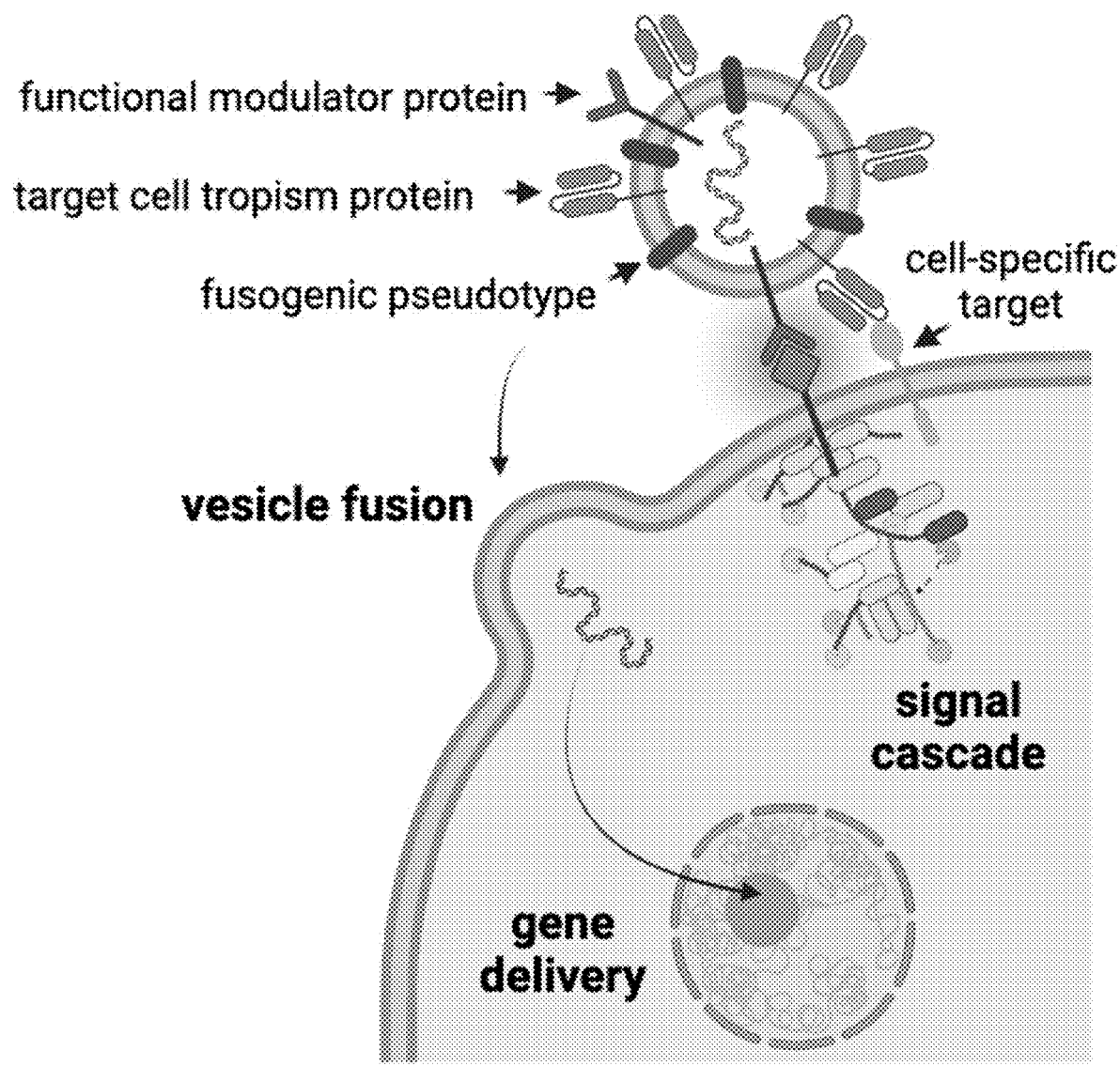
Figure 2:
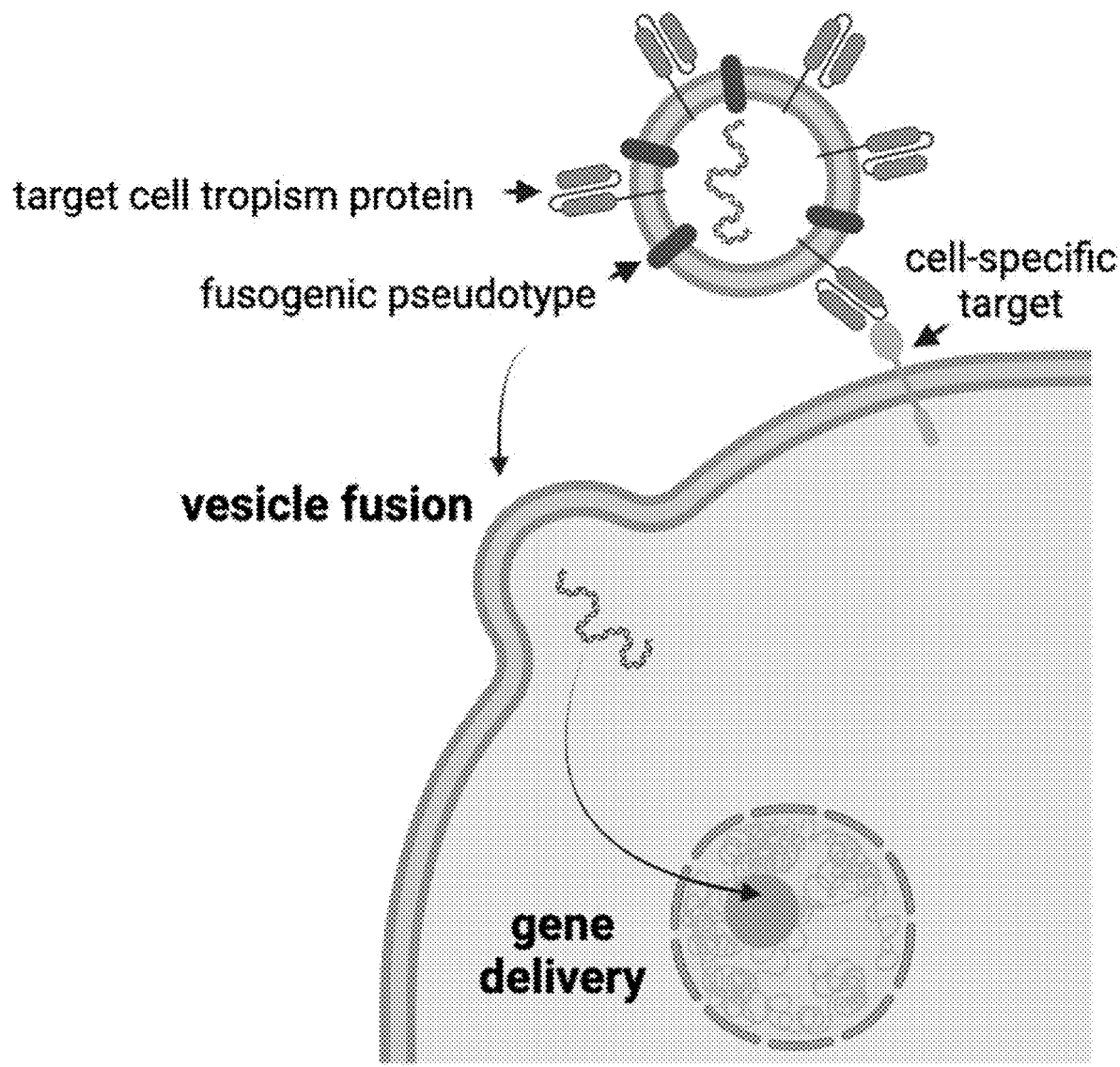
Figure 3:
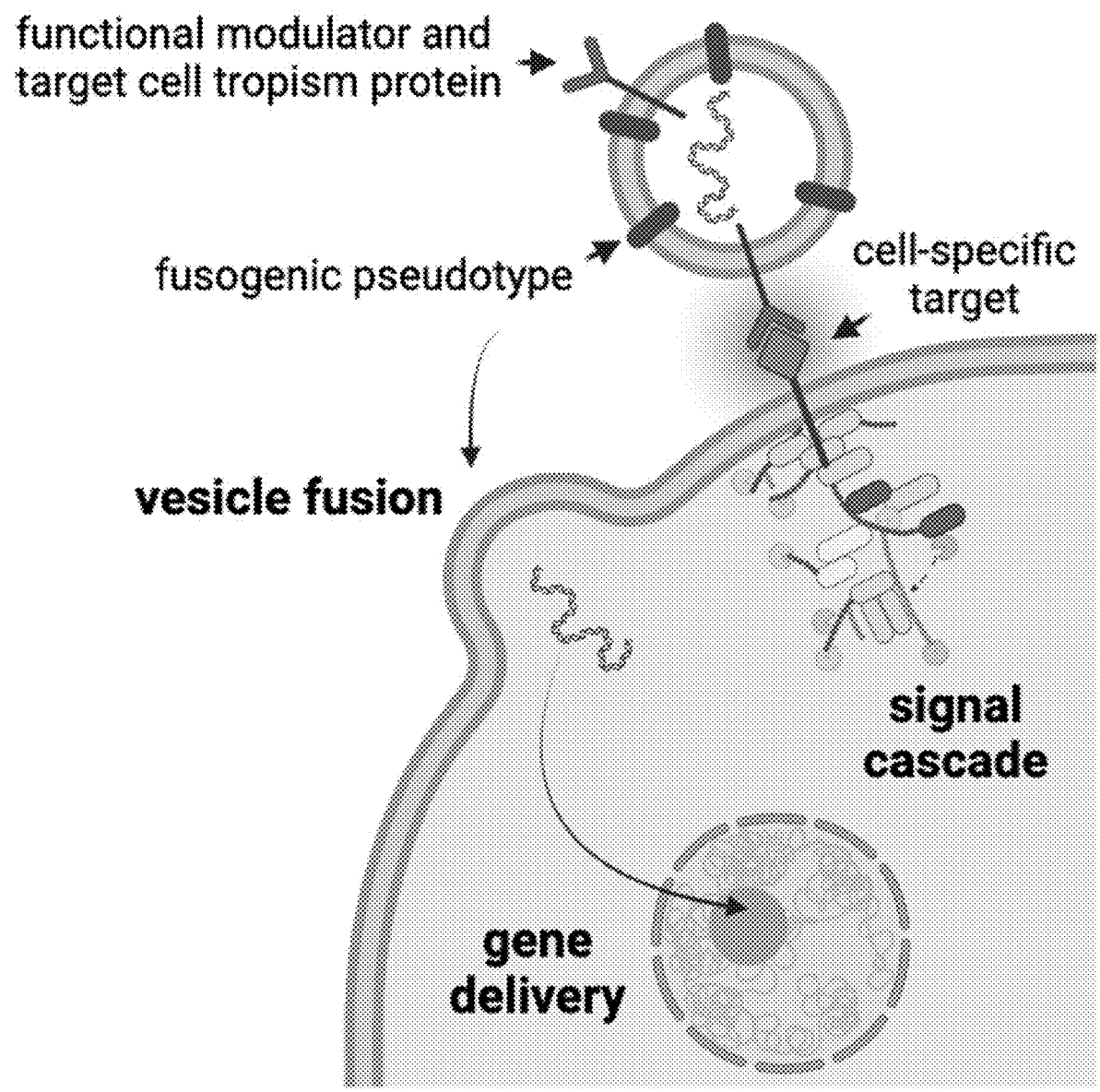
Figure 4:
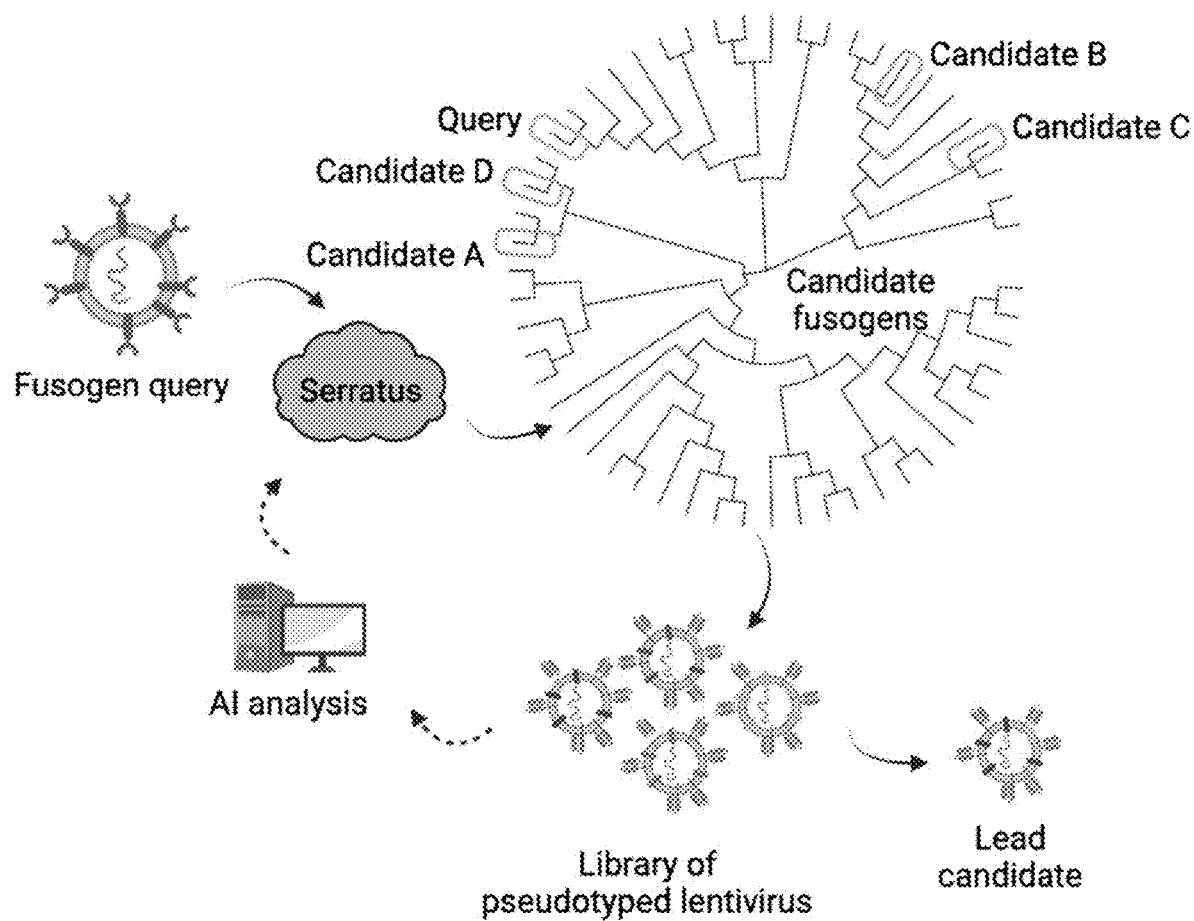
Figure 5:
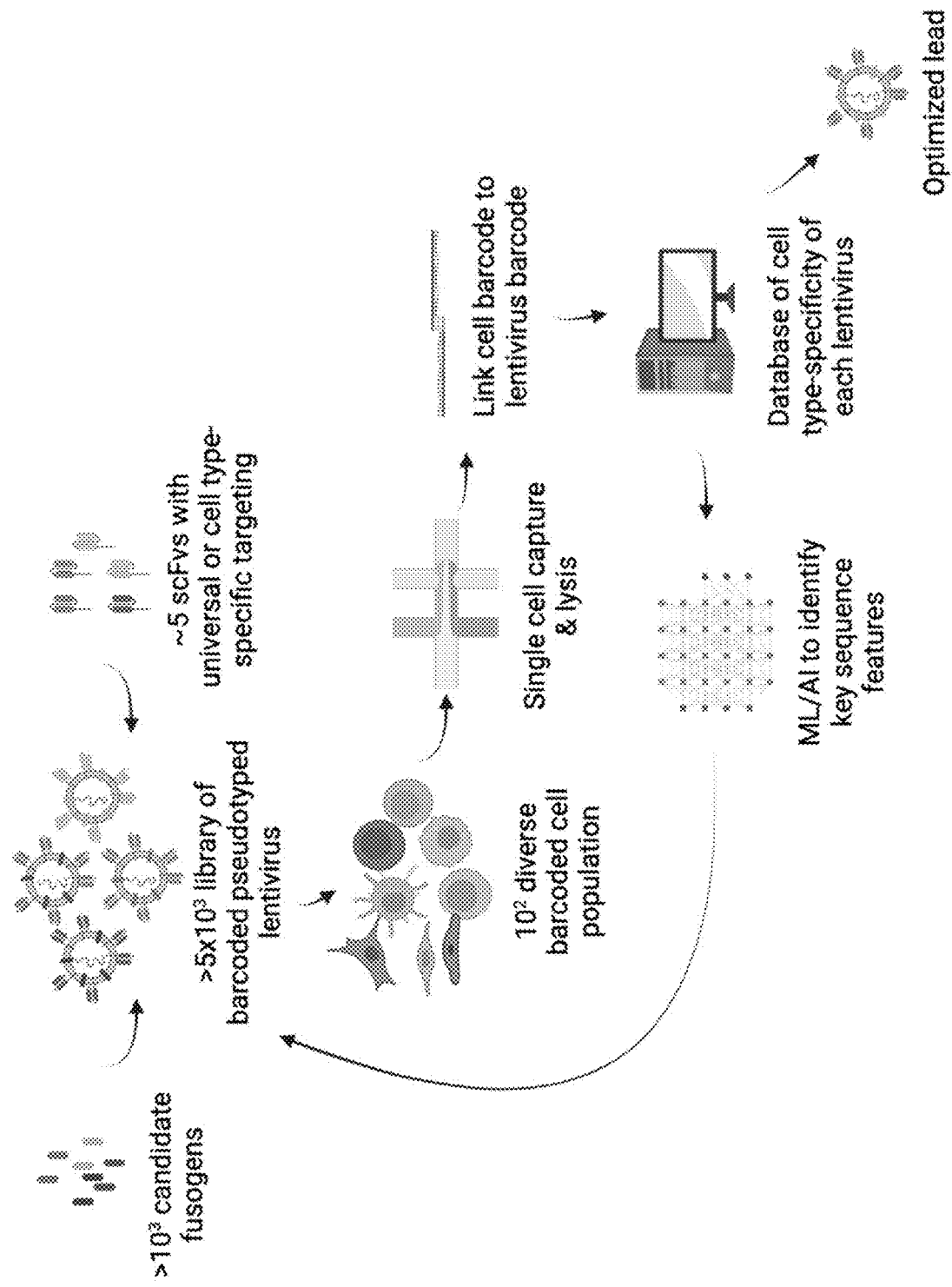
Figure 6:
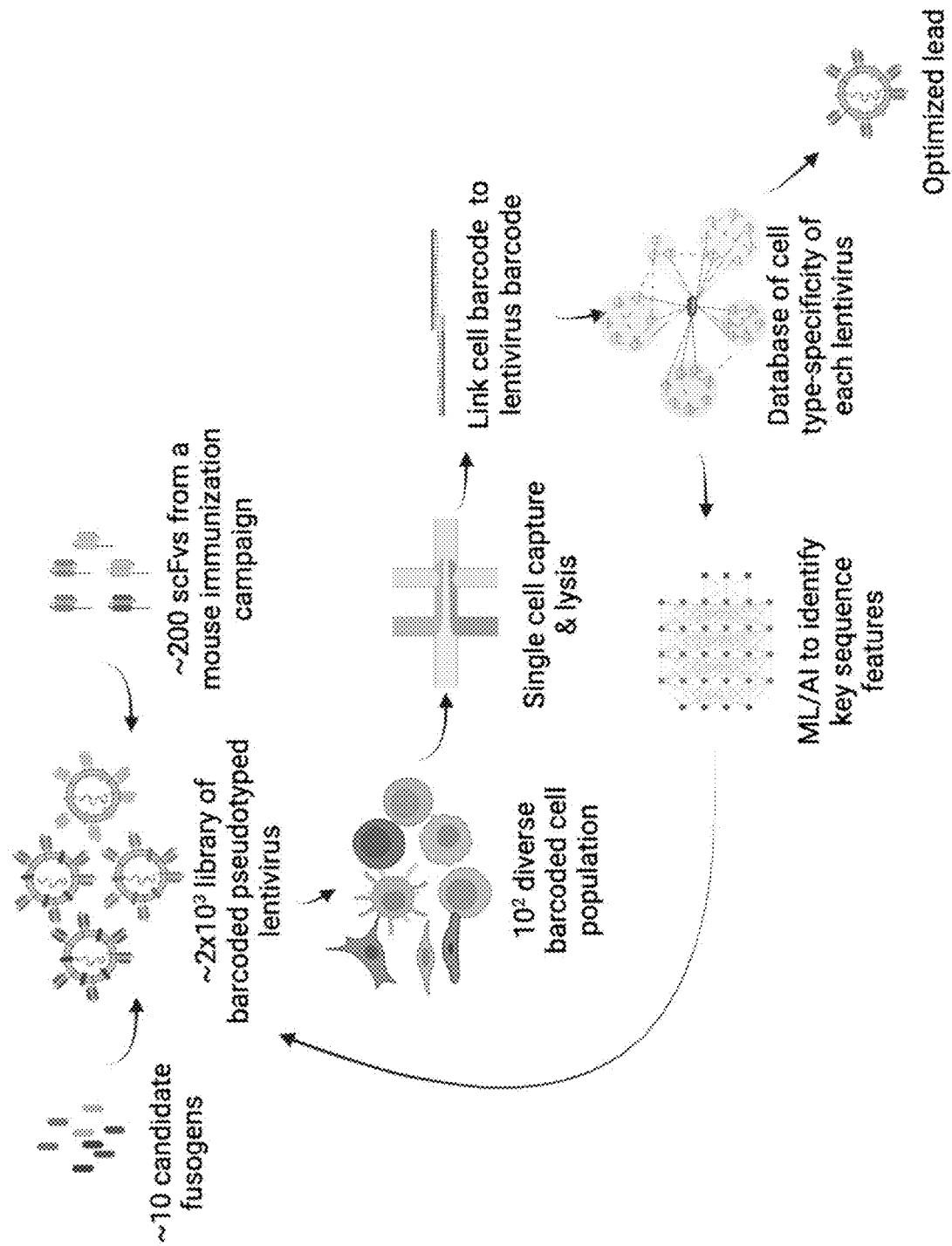
Figure 7:
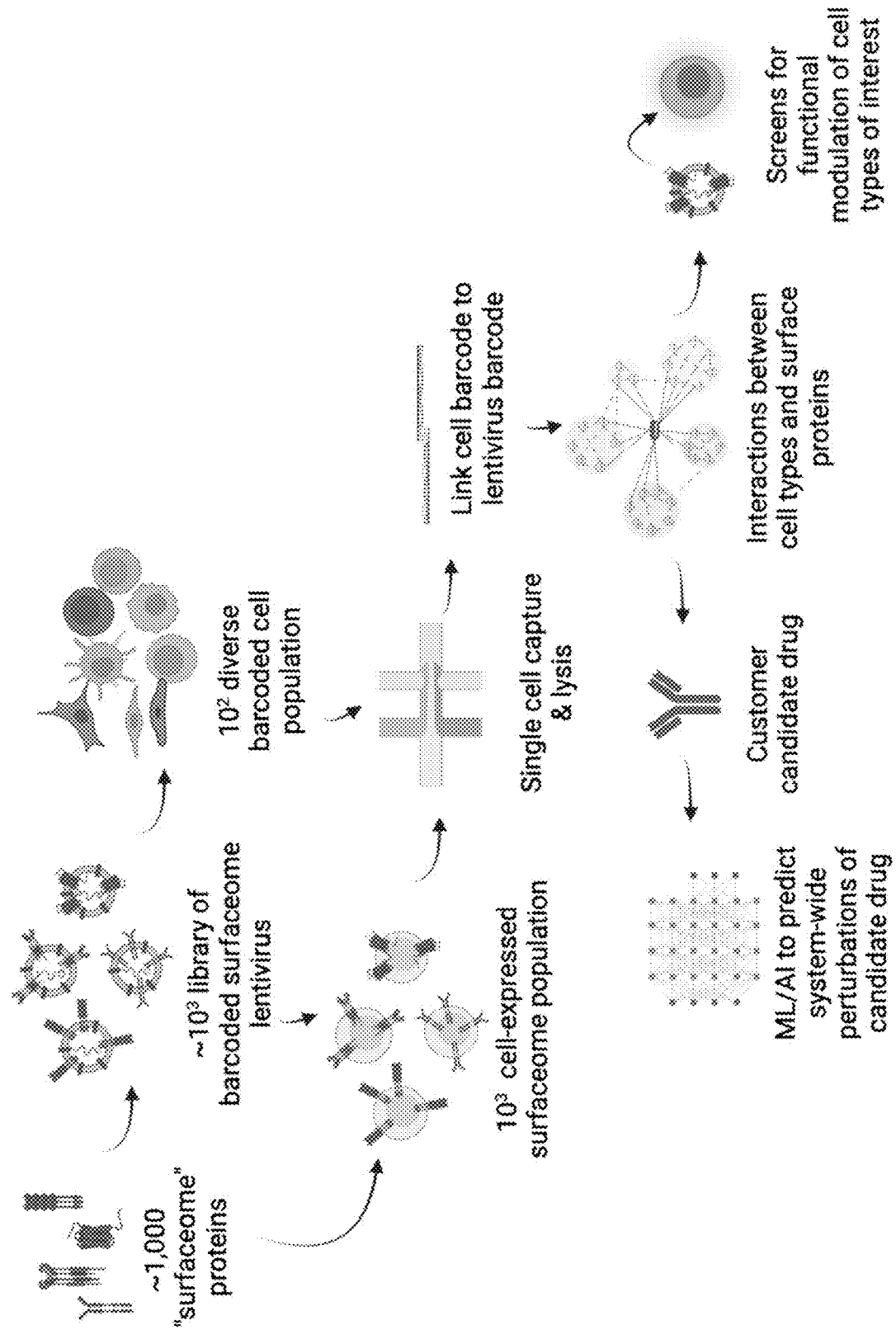
Figure 8:
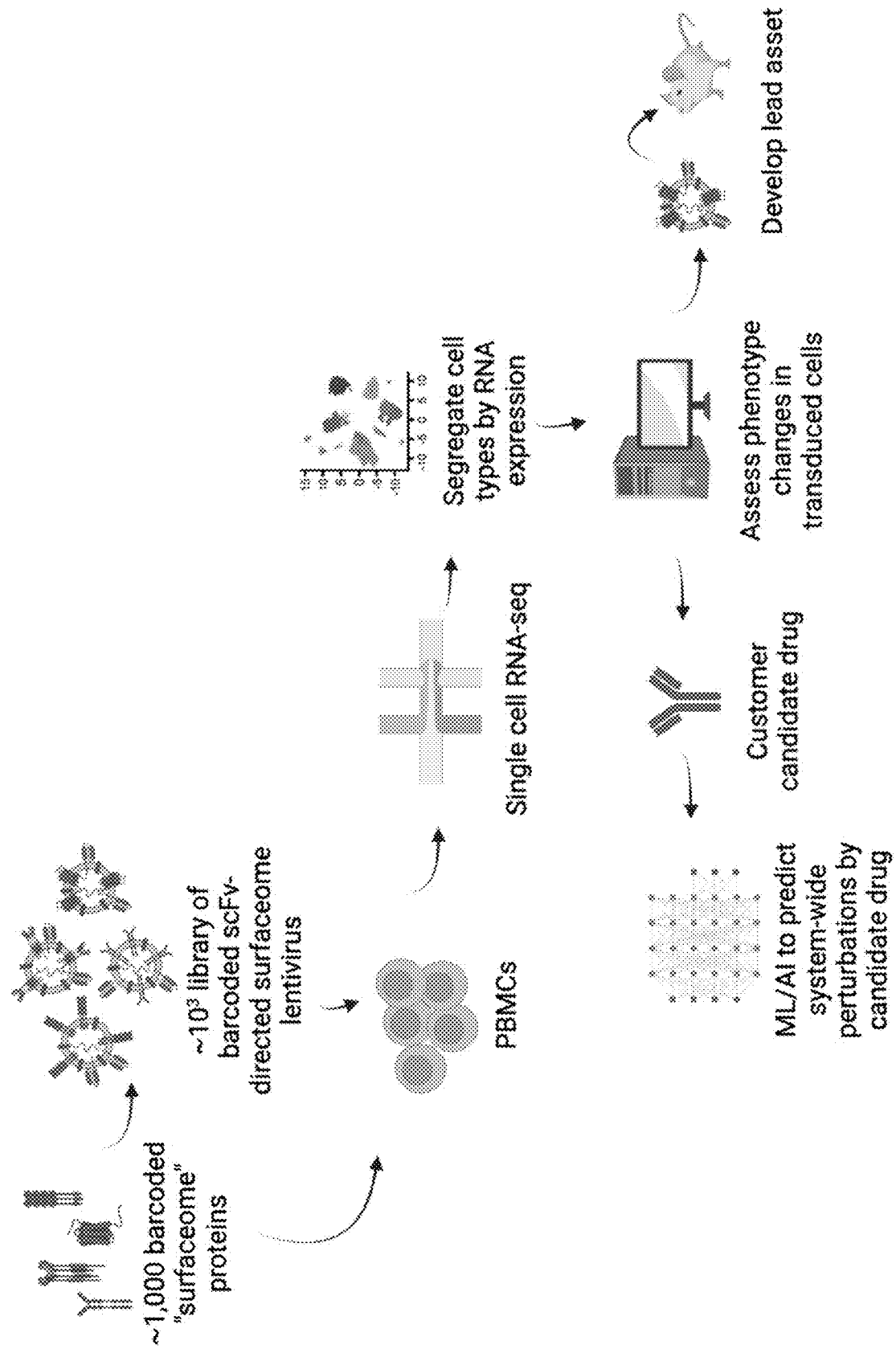
Figure 9:
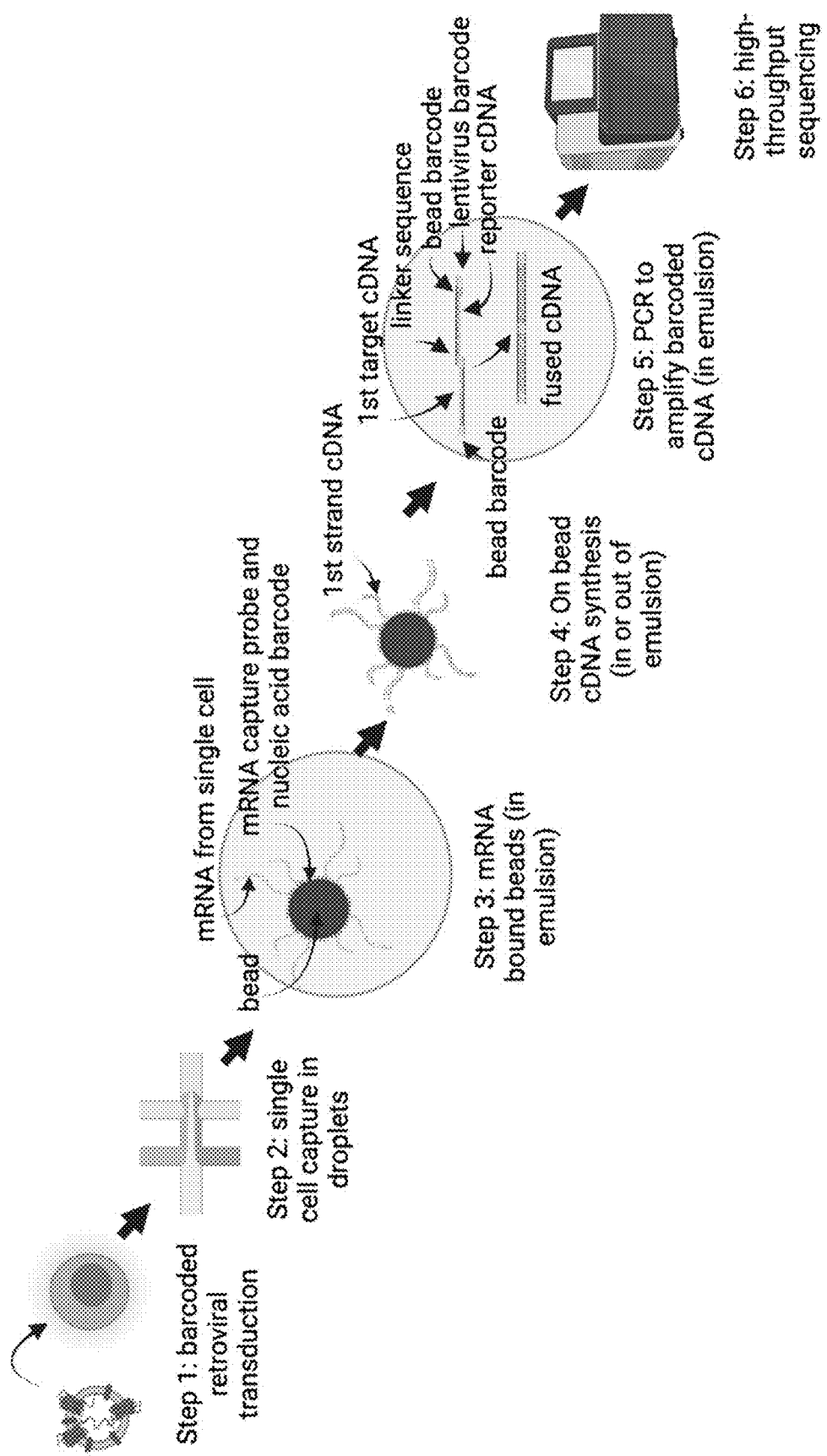
Figure 10:
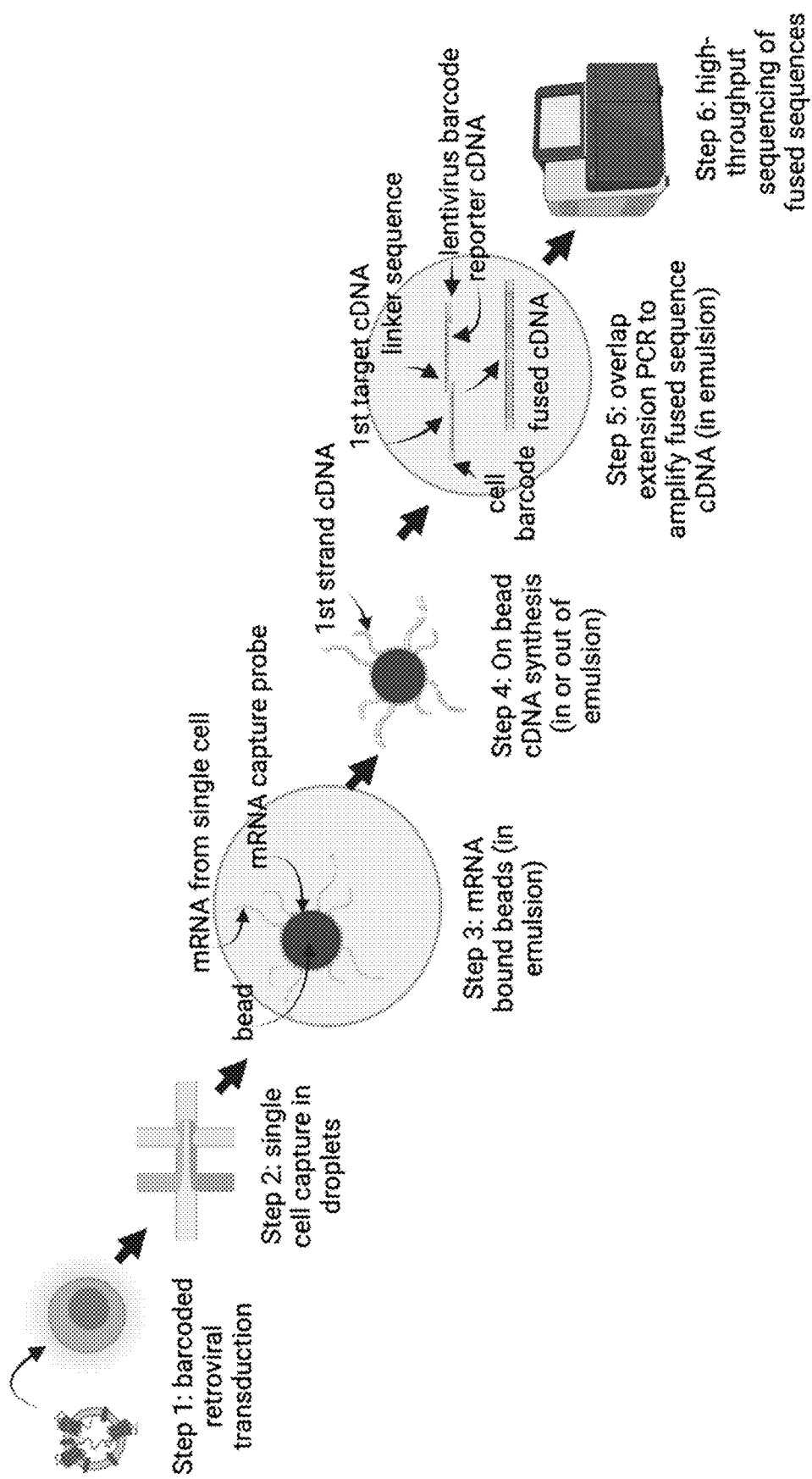

Also described herein is an engineered enveloped vector comprising a viral envelope protein (fusogen), a non-viral membrane-bound protein comprising a membrane-bound domain and an extracellular targeting domain (i.e., target cell tropism protein), a functional modulator protein (e.g., non-viral membrane-bound protein involved in cell signaling), and a nucleic acid of a transgene (e.g., a reporter, a gene payload, or a nucleic acid barcode). In some embodiments, the engineered enveloped vector comprises a viral envelope protein comprising at least one mutation that diminishes its native function, or a truncation or chimera of the viral envelope protein which diminishes its native function. Example engineered vectors are shown in FIGS. 1-3.

The engineered enveloped vector disclosed herein can comprise one or more elements (e.g., a viral envelope protein or a genomic sequence) derived from a retroviral or lentiviral genome (naturally-occurring or modified) of a suitable species. Retroviruses include 7 families: alpharetrovirus (Avian leucosis virus), betaretrovirus (Mouse mammary tumor virus), gammaretrovirus (Murine leukemia virus), deltaretrovirus (Bovine leukemia virus), epsilonretrovirus (Walleye dermal sarcoma virus), lentivirus (Human immunodeficiency virus 1), and spumavirus (Human spumavirus). Six additional examples of retroviruses are provided in U.S. Pat. No. 7,901,671, which is incorporated by reference herein.

In some embodiments, the retrovirus is a lentivirus. Lentivirus is a genus of retroviruses that typically gives rise to slowly developing diseases due to their ability to incorporate into a host genome. Modified lentiviral genomes are useful as viral vectors for the delivery of nucleic acids to a host cell. Host cells can be transfected with lentiviral vectors, and optionally additional vectors for expressing lentiviral packaging proteins (e.g., VSV-G, Rev, and Gag/Pol) to produce lentiviral particles in the culture medium. When the engineered enveloped vector comprises a viral envelope protein or a genomic sequence originated from a retrovirus or a lentivirus, the engineered enveloped vector can be called as a retrovirus, lentivirus, retroviral vector or lentiviral vector.

Retrovirus and lentivirus constructs are well known in the art and any suitable engineered enveloped vector can be used to construct an engineered enveloped vector (or a plurality or library of vectors) as described herein. Non-limiting examples of retrovirus constructs include lentiviral vectors, human immunodeficiency viral (HIV) vector, avian leucosis viral (ALV) vector, murine leukemia viral (MLV) vector, murine mammary tumor viral (MMTV) vector, murine stem cell virus, and human T cell leukemia viral (HTLV) vector. These retrovirus constructs comprise proviral sequences from the corresponding retrovirus.

The engineered enveloped vector described herein may comprise the viral elements such as those described herein from one or more suitable retroviruses, which are RNA viruses with a single strand positive-sense RNA molecule. Engineered enveloped vectors comprise a reverse transcriptase enzyme and an integrase enzyme. Upon entry into a target cell, retroviruses and lentiviruses utilize their reverse transcriptase to transcribe their RNA molecule into a DNA molecule. Subsequently, the integrase enzyme is used to integrate the DNA molecule into the host cell genome. Upon integration into the host cell genome, the sequence from the engineered enveloped vector is referred to as a provirus (e.g., proviral sequence or provirus sequence). The retroviral vectors described herein may further comprise additional functional elements known in the art to address safety concerns and/or to improve vector functions, such as packaging efficiency and/or viral titer. Additional information may be found in US20150316511 and WO2015/117027, the relevant disclosures of each of which are herein incorporated by reference for the purpose and subject matter referenced herein. Additional information for lentiviruses and retroviruses can be found in, e.g., WO2019/056015, the relevant disclosures of which are incorporated by reference herein for this particular purpose.

In some embodiments, the engineered enveloped vector is targeted to specific cells. In some embodiments, the targeting is mediated by the pMHC-TCR interaction or any other protein-protein or cell-to-cell interaction. In some embodiments, T cells with a known and relevant specificity can be enhanced (in the case of cancer or infection) or ablated (in the case of autoimmunity) without affecting other T cells, dramatically limiting the risk of off-target effects. In some embodiments, the engineered enveloped vector can comprise an extracellular domain to target any other surface-expressed molecule on a target cell.

6.1.1. Viral Envelope Protein (Fusogen)

In some embodiments, the viral envelope protein comprises one or more of any of SEQ ID NOS: 1-167 or SEQ ID NOs: 8154-16497. In some embodiments, the viral envelope protein has at least 90%, 95%, 96%, 97%, or 99% sequence identity to a sequence selected from SEQ ID NOs: 1-167. In some embodiments, the viral envelope protein is a chimera between two or more of any of SEQ ID NOs:1-167 or SEQ ID NOs: 8154-16497. In some embodiments, the viral envelope protein is any fragment or domain of any of SEQ ID NOs:1-167 or SEQ ID NOs: 8154-16497, for example, a sequence substantially comprising the transmembrane domain and a fragment of the extracellular domain. In some embodiments, the viral envelope protein comprises at least one mutation or truncation that diminishes its native function (i.e., wild-type function of a non-mutated viral envelope protein). In some embodiments, a viral envelope protein is any viral envelope protein of any retrovirus (e.g., lentivirus).

In some embodiments, the viral envelope protein does not have any, or has very minimal, native cell tropism in mammals, humans, primates, and/or rodents. In some embodiments, the native function that is diminished by a mutation of a viral envelope protein is viral tropism (e.g., ability to infect particular kinds of cells, bind to cells, etc., through interaction with cellular surface targets such as proteins). In some embodiments, the viral envelope protein comprises one or more amino acid mutations (deletion, insertion or substitution) to any of SEQ ID NOs: 1-167 or SEQ ID NOs: 8154-16497 which confer beneficial properties, for example, reduced or increased binding to target cells of interest, or reduced or increased immunogenicity, or reduced or increased half-life in vivo or in vitro. In some embodiments, the viral envelope protein has reduced viral tropism but retains the ability to fuse with a target cell membrane, for example when combined with a second target cell tropism protein (a non-viral membrane-bound protein), such as an scFv, surface receptor, TCR, or pMHC.

In some embodiments, a viral envelope protein comprising at least one mutation or truncation that diminishes its native function is a mutated VSV-G envelope protein or a mutated version of SEQ ID NOS: 1-167 or SEQ ID NOs: 8154-16497. In some embodiments, a viral envelope protein comprising at least one mutation or truncation that diminishes its native function is a mutated measles virus envelope protein. In some embodiments, a viral envelope protein comprising at least one mutation or truncation that diminishes its native function is a mutated nipah virus envelope protein. In some embodiments, a viral envelope protein comprising at least one mutation or truncation that diminishes its native function is a mutated cocal virus G protein.

In some embodiments, a viral envelope protein is mutated or truncated to reduce immunogenicity when administered to organisms in vivo. In some embodiments, HLA-presented peptides comprising amino acid sequences from the viral envelope protein are predicted using computational methods, such as NetMHCPan. Predicted peptides are subsequently mutated, or protein domains comprising the predicted peptides are deleted from the viral envelope protein. In some embodiments, the extra membrane domain of the viral envelope protein is substantially removed, to reduce the epitopes available for antibody binding. In some embodiments, the intracellular domain of the viral envelope protein is replaced with the intracellular domain of another viral envelope protein, such that engineered synthetic engineered enveloped vector is produced more efficiently with the chimeric protein than with the wild type protein.

In some embodiments, the mutated envelope protein is derived from any other enveloped virus including but not limited to baculovirus, herpes simplex virus (HSV), cytomegalovirus (CMV), lymphocytic choriomeningitis virus (LCMV), Epstein-Barr virus (EBV), vaccinia virus, Hepatitis A, B, or C virus, vaccinia virus, alphavirus, dengue virus, yellow fever virus, Zika virus, influenza virus, hantavirus, Ebola virus, rabies virus, human immunodeficiency virus (HIV), coronavirus, and other members of rhabdoviridae.

In some embodiments, a viral envelope protein comprising at least one mutation comprises 1, 2, 3, 4, 5, 6, 7, 8, 9, 10, or more mutations. In some embodiments, a viral envelope protein comprising at least one mutation comprises a nucleotide sequence and/or amino acid sequence that is at least 50%, 60%, 70%, 80%, 90%, 95%, or 97% identical to a wild-type viral envelope protein. In some embodiments, a viral envelope protein comprising at least one mutation that diminishes its native function retains less than 95%, 90%, 80%, 70%, 60%, 50%, 40%, 30%, 20%, or 10% of the function of a wild-type viral envelope protein. In some embodiments, a viral envelope protein comprising at least one mutation lacks all of its native function. In some embodiments, an engineered enveloped vector comprising a viral envelope protein comprising at least one mutation that diminishes its native function comprises less than 95%, 90%, 80%, 70%, 60%, 50%, 40%, 30%, 20%, or 10% of the cellular infectivity of a retrovirus comprising a wild-type viral envelope protein.

Inn some embodiments, an engineered enveloped vector comprising a viral envelope protein fused to a different protein or nucleotides (e.g., guide RNA, siRNA, ASO).

In some embodiments, the viral envelope protein is fused to a CRISPR/Cas enzyme, such that the guide RNA and CRISPR/Cas enzyme. The guide RNA and CRISPR/Cas enzyme can be cleaved away from the viral envelope protein after being delivered to a target cell. The CRISPR/Cas enzyme can comprise any kind of nuclease-based gene editing technology, such as CRISPR/Cas9, CRISPR/Cas12a, or base editors. One example of a construct for generating the fusion protein is a lentiviral packaging plasmid (SEQ ID 16510) containing HIV-1 gag fused to SpCas9 with a 3×NES and proteolytic cleavage site between them. See FIG. 17.

The one or more DNA endonucleases can be a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, codon-optimized thereof, or modified versions thereof, and combinations thereof. In some embodiments, any of the DNA endonucleases disclosed in PCT/US2021/065554 filled on Dec. 29, 2021 and incorporated by reference herein is used.

6.1.2. Non-Viral Membrane-Bound Protein

The engineered enveloped vectors described herein comprise a non-viral membrane-bound protein (target cell tropism protein). A non-viral membrane-bound protein can comprise a membrane-bound domain and an extracellular targeting domain. In some embodiments, the non-viral membrane-bound protein further comprises a signal peptide.

In some embodiments, a non-viral membrane-bound protein is a chimeric protein comprising sequences from at least two different proteins. In some embodiments, a non-viral membrane-bound protein (a target cell tropism protein) is a full-length or truncated protein comprising a sequence from a single protein. In some embodiments, the target cell tropism protein and the fusogen protein are fused together to form a chimeric protein. In some embodiments, the target cell tropism protein is the same protein as the functional modulator protein.

A membrane-bound domain of the non-viral membrane-bound protein is a protein or peptide that has an amino acid sequence that enables the protein or peptide to be fully or partially embedded or associated with the membrane (e.g., envelope) of the engineered enveloped vector. In some embodiments, a membrane-bound domain enables presentation and delivery of the extracellular targeting domain to the extracellular environment. In some embodiments, a membrane-bound domain comprises an intracellular domain, a transmembrane domain, and/or an extracellular domain. In some embodiments, a membrane-bound domain comprises an intracellular domain and a transmembrane domain. In some embodiments, the membrane-bound domain comprises a Major Histocompatibility Complex (MHC) protein or fragment thereof. An MHC protein may be a Class I or Class II MHC protein, or a modification thereof.

In some embodiments, a membrane-bound domain comprises 10-50, 10-100, 25-100, 50-200, 50-150, 100-500, 100-250, 250-500, or any reasonable number of total amino acids.

In some embodiments, an engineered enveloped vector present in a library of engineered enveloped vectors comprises the same membrane-bound domain as some or all of the other vectors in the library. In some embodiments, each vector present in a library of engineered enveloped vectors comprises a different extracellular targeting domain (ETD) relative to some or all of the other vectors in the library. In some embodiments, the library of engineered enveloped vectors comprises a library of non-viral membrane-bound proteins, such as scFvs, TCRs, antibodies, or chimeric antigen receptors (CARs). In some embodiments, the library of engineered enveloped vectors comprises nucleic acid barcodes which can be used for high-throughput sequencing by identifying which vectors transduced which cells. In some embodiments, the library of antibodies or scFvs is a library of antigen binders derived from an immunized mouse, a human subject, or a yeast display library, and subsequently reformatted as an engineered retrovirus or lentivirus display library.

In some embodiments, an extracellular targeting domain (ETD) of the non-viral membrane-bound protein is any protein or peptide that has an amino acid sequence and is a binding partner for a target molecule or ligand (e.g., a cognate protein) on a cell surface. When present in the extracellular environment beyond the interior of the engineered enveloped vector, an extracellular targeting domain is capable of binding to a target cell. In some embodiments, an extracellular targeting domain binds or targets to a cognate protein or ligand (e.g., a protein receptor present on a target cell) that is present on the cell surface of a cell or a subset of a population of cells. In some embodiments, an extracellular targeting domain binds to a cognate protein or ligand that is present on the cell surface of a single T cell or a subset of a population of T cells. In some embodiments, a binding interaction between an extracellular targeting domain of an engineered enveloped vector and a cognate protein or ligand of a cell enables the retrovirus to enter the cell (e.g., an antigen-specific cell, T cell). In some embodiments, an extracellular targeting domain comprises any of SEQ ID NOs: 168-8121 or any portion of any of SEQ ID NOs: 168-8121.

In some embodiments, an extracellular targeting domain comprises 10-50, 10-100, 25-100, 50-200, 50-150, 100-500, 100-250, 250-500, or any reasonable number of total amino acids. In some embodiments, an extracellular targeting domain comprises at least 5, at least 10, at least 15, at least 20, or at least 50 amino acids.

In some embodiments, an extracellular targeting domain is a protein, an antibody or peptide. In some embodiments, an antibody is a full-length antibody, an antibody fragment, a nanobody, or a single chain antibody (scFv). In some embodiments, an extracellular targeting domain is an antibody that binds to a cognate protein of a target cell. In some embodiments, an extracellular targeting domain is an antibody that binds to a B-cell or T cell antigen. In some embodiments, an extracellular targeting domain is an anti-CD19 antibody or antibody fragment (e.g., an antibody that binds to CD19). In some embodiments, an extracellular targeting domain is an antibody or antibody fragment that binds to a cell surface molecule. In some embodiments, an extracellular targeting domain is an antibody that binds to a lineage marker (e.g., CD3, CD4, CD8, CD20, integrins, or other receptors), phenotypic markers (PD-1, CD25, CD45, or others). In some embodiments, an extracellular targeting domain is a protein or peptide that binds to a receptor (e.g., a receptor that is present on the surface of a target cell). In some embodiments, an extracellular targeting domain is a protein or peptide that binds to a cytokine receptor (e.g., interleukin-13 (IL-13) receptor). In some embodiments, an extracellular targeting domain is a cytokine (e.g., IL-2, IL-6, IL-12, IL-13). In some embodiments, an extracellular targeting domain is a chemokine ligand (e.g. CXCL9, CXCL10, CXCL 11, etc.). In some embodiments, an extracellular targeting domain is a cellular receptor, including cytokine receptors (e.g. IL-13Rα1, IL-13Rα2, IL-2 receptors, common gamma chain), GPCRs (including chemokine receptors such as CSCR3, CXCR4, etc.), and integrins. In some embodiments, the extracellular targeting domain comprises stem cell factor (CSF), which binds to its receptor, c-kit, for directing tropism toward CD34+ hematopoietic stem cells (HSCs). In some embodiments, an extracellular targeting domain is a peptide that is displayed by an MHC protein.

In some embodiments, the non-viral membrane-bound protein comprises a membrane-bound domain (MBD) comprising an MHC protein or fragment and an extracellular targeting domain comprising a peptide that is displayed by an MHC protein. In some embodiments, an extracellular targeting domain binds to a T cell receptor and/or a B cell receptor. T-cell receptors are expressed in nature on the surface of T-cells usually as alpha/beta and gamma/delta heterodimeric integral membrane proteins, each subunit comprising a short intracellular segment, a single transmembrane alpha-helix and two globular extracellular Ig-superfamily domains. B-cell receptors are transmembrane receptor proteins located on the outer surface of B cells. In some embodiments, a transmembrane domain of CD28 (e.g., SEQ ID NO: 8129) is used.

In some embodiments, an extracellular targeting domain binds to a target cell or cell surface molecule with a binding affinity of $10^{-9}$ to $10^{-8}$ M, $10^{-8}$ to $10^{-7}$ M, $10^{-7}$ to $10^{-6}$ M, $10^{-6}$ to $10^{-5}$ M, $10^{-5}$ to $10^{-4}$ M, $10^{-4}$ to $10^{-3}$ M, or $10^{-3}$ to $10^{-2}$ M. In some embodiments, an extracellular targeting domain binds to a cognate protein or ligand of a target cell with a binding affinity of $10^{-9}$ to $10^{-8}$ M, $10^{-8}$ to $10^{-7}$ M, $10^{-7}$ to $10^{-6}$ M, $10^{-6}$ to $10^{-5}$ M, $10^{-5}$ to $10^{-4}$ M, $10^{-4}$ to $10^{-3}$ M, or $10^{-3}$ to $10^{-2}$ M. In some embodiments, the binding affinity between an extracellular targeting domain and a cognate protein or ligand is in the picomolar to nanomolar range (e.g., between about $10^{-12}$ and about $10^{-9}$ M). In some embodiments, the binding affinity between an extracellular targeting domain and a cognate protein or ligand is in the nanomolar to micromolar range (e.g., between about $10^{-9}$ and about $10^{-6}$ M). In some embodiments, the binding affinity between an extracellular targeting domain and a cognate protein or ligand is in the micromolar to millimolar range (e.g., between about $10^{-6}$ and about $10^{-3}$ M). In some embodiments, the binding affinity between an extracellular targeting domain and a cognate protein or ligand is in the picomolar to micromolar range (e.g., between about $10^{-12}$ and about $10^{-6}$ M). In some embodiments, the binding affinity between an extracellular targeting domain and a cognate protein or ligand is in the nanomolar to millimolar range (e.g., between about $10^{-9}$ and about $10^{-3}$ M).

As used herein, the term antibody generally refers to a protein that includes at least one immunoglobulin variable domain or immunoglobulin variable domain sequence. For example, an antibody can include a heavy (H) chain variable region (abbreviated herein as $V_H$), and/or a light (L) chain variable region (abbreviated herein as $V_L$). In another example, an antibody includes two heavy (H) chain variable regions and/or two light (L) chain variable regions. An antibody can have the structural features of IgA, IgG, IgE, IgD, IgM (as well as subtypes thereof). The $V_H$ and $V_L$ regions can be further subdivided into regions of hypervariability, termed "complementarity determining regions" ("CDR"), interspersed with regions that are more conserved, termed "framework regions" ("FR"). Each $V_H$ and/or $V_L$ is typically composed of three CDRs and four FRs, arranged from amino-terminus to carboxy-terminus in the following order: FR1, CDR1, FR2, CDR2, FR3, CDR3, FR4. The $V_H$ or $V_L$ chain of the antibody can further include a heavy or light chain constant region, to thereby form a heavy or light immunoglobulin chain, respectively. In some embodiments, the antibody is a tetramer of two heavy immunoglobulin chains and two light immunoglobulin chains, wherein the heavy and light immunoglobulin chains are inter-connected by, e.g., disulfide bonds. In IgGs, the heavy chain constant region includes three immunoglobulin domains, CH1, CH2 and CH3.

In some embodiments, an engineered enveloped vector or a library of the vectors comprises the same extracellular targeting domain as some or all of the vectors in the library. In some embodiments, each engineered enveloped vector in a library of the vectors comprises a different extracellular targeting domain relative to some or all of the other vectors in the library.

In some embodiments, a non-viral membrane-bound protein further comprises a signal sequence (also referred to as a signal peptide of localization sequence). In some embodiments, the signal sequence is at the N- or C-terminal end of the non-viral membrane-bound protein. A signal sequence functions to translocate the non-viral membrane-bound protein to the membrane (or envelope) of the retrovirus. In some embodiments, a signal sequence is 5-10, 5-15, 10-20, 15-20, 15-30, 20-30, or 25-30 amino acids. In some embodiments, the signal sequence is an Ig Kappa leader sequence (e.g., a murine Ig Kappa leader sequence comprising: METDTLLL-WVLLLWVPGSTG, SEQ ID NO. 16550) or a B2M signal peptide sequence (e.g., a B2M signal peptide sequence comprising: MSRSVALAVLALLSLSGLEA, SEQ ID NO. 16551). In some embodiments, an engineered enveloped vector present in a library of the engineered enveloped vectors comprises the same signal sequence as some or all of the other vectors in the library. In some embodiments, each vector present in a library of the engineered enveloped vectors comprises a different signal sequence relative to some or all of the other engineered enveloped vectors in the library.

In some embodiments, a nucleic acid encoding a non-viral membrane-bound protein further comprises an internal ribosome entry site (IRES). An IRES is an RNA sequence that allows for initiation of translation during protein synthesis. In some embodiments, the IRES is located at or near the C-terminal end. In some embodiments, the IRES is located C-terminal relative to the membrane-bound domain and the extracellular targeting domain (ETD). In some embodiments, the IRES is a viral IRES. In some embodiments, the IRES is an IRES that is native to the retrovirus. In some embodiments, the IRES is a sequence derived from encephalomyocarditis virus (EMCV). In some embodiments, a vector present in a library of the engineered enveloped vectors comprises the same IRES as some or all of the other vectors in the library. In some embodiments, each vector in a library of engineered enveloped virus comprises a different IRES relative to some or all of the other vectors in the library.

In some embodiments, a non-viral membrane-bound protein further comprises a linker positioned between the membrane-bound domain and the extracellular targeting domain. A linker can be an amino acid linker, e.g., a rigid linker, a flexible linker, or an oligomerized linker. A rigid linker is an amino acid sequence that lacks flexibility (e.g., may comprise at least one proline). In some embodiments, a rigid linker comprises a platelet-derived growth factor receptor (PDGFR) stalk, an Fc stalk, or a CD8α stalk. In some embodiments, a PDGFR stalk comprises an amino acid sequence comprising AVGQDTQEVIVVPHSLPFK (SEQ ID NO. 16552). In some embodiments, a PDGFR stalk comprises an amino acid sequence comprising ASAKPTTT-PAPRPPTPAPTIASQPLSLRPEAARPAAGGAVHTR-GLDFAK, SEQ ID NO. 16553.

A flexible linker is an amino acid sequence that has many degrees of freedom (e.g., may comprise a plurality of amino acids with small side chains, e.g., glycine or alanine). In some embodiments, a flexible linker comprises an amino acid sequence comprising GAPGAS (SEQ ID NO. 16548). In some embodiments, a flexible linker comprises an amino acid sequence consisting of GAPGSGGGGSGGGGSAS (SEQ ID NO. 16554). In some embodiments, a flexible linker comprises an amino acid sequence comprising GGGGS (SEQ ID NO. 16549). In some embodiments, a flexible linker comprises an amino acid sequence comprising $(GAPGAS)_N$ or $(G_4S)_N$, wherein N is 1, 2, 3, 4, 5, 6, 7, 8, 9, 10, or more. An oligomerized linker is an amino acid that can oligomerize to another related amino acid. In some embodiments, an oligomerized linker is an amino acid sequence that can form a dimer, trimer, or tetramer. In some embodiments, an oligomerized linker comprises an IgG4 hinge domain (e.g., ASESKYGPPCPPCPAVGQDTQEVIV-VPHSLPFK, SEQ ID NO. 16555). In some embodiments, an oligomerized linker comprises an amino acid sequence that can form a tetrameric coiled coil (e.g., ASGGGGSGE-LAAIKQELAAIKKELAAIKWELAAIKQGAG, SEQ ID NO. 16556). In some embodiments, an oligomerized linker comprises an amino acid sequence that can form a dimeric coiled coil (e.g., ASESKYGPPCPPCP, SEQ ID NO. 16557).

6.1.3. Functional Modulator Protein

In some embodiments, the engineered enveloped vector described herein further comprises a functional modulator protein. In some embodiments, the vector comprises a fusogen and a functional modulator protein but not a non-viral membrane-bound protein. In some embodiments, the retroviruses comprise a fusogen and a non-viral membrane-bound protein for targeting and cell tropism but not a functional modulator protein. In some embodiments, the vector comprise a fusogen, a non-viral membrane-bound protein for targeting and cell tropism, and a functional modulator. In some embodiments, the functional modulator and the non-viral membrane-bound protein for targeting and cell tropism comprise the same protein. In some embodiments, the functional modulator and the non-viral membrane-bound protein for targeting and cell tropism are fused together to form a chimeric protein. In some embodiments, the functional modulator and the fusogen are fused together to form a chimeric protein.

In some embodiments, the functional modulator protein has activity to the target cells when the engineered enveloped vector is delivering a genetic payload to the target cell. In some embodiments, the functional modulator protein activates the target cell into a more active state from a quiescent or less active state. In some embodiments, the target cell is induced from a stem cell state to a non-stem cell state. In some embodiments, the functional modulator protein induces a change in immune cell phenotype. In some embodiments, the functional modulator protein induces changes in the target cell that make genome editing (for example, modifications using CRISPR/Cas9) more efficient. In some embodiments, the functional modulator protein induces changes to the cell cycle state of the target cell. In some embodiments, the functional modulator protein delivers a signal that induces apoptosis or programmed cell death. In some embodiments, the functional modulator induces changes in chromatin structure, for example, from a heterochromatin state to a euchromatin state, or from a euchromatin state to a heterochromatin state. In some embodiments, the functional modulator induces changes in the epigenetic state of the target cell. In some embodiments, the functional modulator binds to a cell surface protein on the target cell, thereby inducing an intracellular signaling cascade. In some embodiments, the functional modulator induces a kinase signaling cascade. In some embodiments, the functional modulator binds to a cell surface protein in the target cell, thereby directly or indirectly inducing transcription, translation, or activation of a transcription factor. In some embodiments, the functional modulator binds to a cell surface protein in the target cell, thereby blocking interaction between the cell surface protein in the target cell and its endogenous ligand. In some embodiments, the functional modulator protein blocks an interaction between a cell surface protein in the target cell and its endogenous ligand, thereby preventing activation of intracellular cell signals and thereby blocking cell functions. In some embodiments, the functional modulator protein prevents the lentivirus from being degraded by a lymphocyte by providing a signal to the lymphocyte. In some embodiments, the functional modulator protein is a "don't eat me" signal such as CD47 which provides a signal to lymphocytes to not degrade the lentivirus. In some embodiments, the functional modulator protein induces function in the same cell as the protein target of the target cell tropism protein. In some embodiments, the functional modulator protein induces function in a cell other than the target cell of the target cell tropism protein. In some embodiments, the functional modulator protein improves the serum half-life of the engineered enveloped vector, thereby improving the pharmacological properties of the vector. In some embodiments, the functional modulator comprises a post-translational modification important for binding to molecular targets or for stability.

In some embodiments, the functional modulator protein comprises an extracellular signaling domain which is a binding partner for a target molecule or ligand (e.g., a cognate protein) on a cell surface. When present in the extracellular environment beyond the interior of the viral envelope, an extracellular signaling domain is capable of binding to a target cell. In some embodiments, an extracellular signaling domain binds or targets to a cognate protein or ligand (e.g., a protein receptor present on a target cell) that is present on the cell surface of a cell or a subset of a population of cells. In some embodiments, an extracellular signaling domain binds to a cognate protein or ligand that is present on the cell surface of a single T cell or a subset of a population of T cells. In some embodiments, an extracellular targeting domain comprises any of SEQ ID NOs: 168-8121 or any portion of any of SEQ ID NOs: 168-8121. In some embodiments, an extracellular targeting domain has a sequence having at least 90%, 95%, 97%, 98%, or 99% identity to any one of SEQ ID NOs: 168-8121.

In some embodiments, the non-viral functional modulator protein is a secreted protein, for example known or predicted secreted proteins having a sequence selected from SEQ ID NOs: 5340-8121, which can be tethered to the vector surface by fusing the secreted protein to the transmembrane domain of another protein, i.e., to generate a recombinant chimeric protein. In some embodiments, the functional modulator protein comprises one or more amino acid mutations (insertion, deletion or substitution) to any of SEQ ID NOs: 168-5339 which confer beneficial properties, for example, reduced or increased binding to target cells of interest, or reduced or increased immunogenicity, or reduced or increased half-life in vivo or in vitro.

In some embodiments, a functional modulator protein is a protein or peptide that binds to a receptor (e.g., a receptor that is present on the surface of a target cell). In some embodiments, a functional modulator protein is a protein or peptide that binds to a cytokine receptor (e.g., interleukin-13 (IL-13) receptor). In some embodiments, a functional modulator protein is a cytokine (e.g., IL-2, IL-6, IL-12, IL-13). In some embodiments, a functional modulator protein is a chemokine ligand (e.g. CXCL9, CXCL10, CXCL 11, etc.). In some embodiments, a functional modulator protein is a cellular receptor, including cytokine receptors (e.g. IL-13Rα1, IL-13Rα2, IL-2 receptors, common gamma chain), GPCRs (including chemokine receptors such as CSCR3, CXCR4, etc.), and integrins. In some embodiments, a functional modulator protein is a peptide that is displayed by an MHC protein. In some embodiments, the non-viral functional modulator protein comprises an MHC protein or fragment and an extracellular targeting domain comprising a peptide that is displayed by an MHC protein. In some embodiments, a functional modulator protein binds to a T cell receptor and/or a B cell receptor. T-cell receptors are expressed in nature on the surface of T-cells usually as alpha/beta and gamma/delta heterodimeric integral membrane proteins, each subunit comprising a short intracellular segment, a single transmembrane alpha-helix and two globular extracellular Ig-superfamily domains. B-cell receptors are transmembrane receptor proteins located on the outer surface of B cell.

In some embodiments, a functional modulator protein binds to a target cell or cell surface molecule with a binding affinity of $10^{-9}$ to $10^{-8}$ M, $10^{-8}$ to $10^{-7}$ M, $10^{-7}$ to $10^{-6}$ M, $10^{-6}$ to $10^{-5}$ M, $10^{-5}$ to $10^{-4}$ M, $10^{-4}$ to $10^{-3}$ M, or $10^{-3}$ to $10^{-2}$ M. In some embodiments, a functional modulator protein binds to a cognate protein or ligand of a target cell with a binding affinity of $10^{-9}$ to $10^{-8}$ M, $10^{-8}$ to $10^{-7}$ M, $10^{-7}$ to $10^{-6}$ M, $10^{-6}$ to $10^{-5}$ M, $10^{-5}$ to $10^{-4}$ M, $10^{-4}$ to $10^{-3}$ M, or $10^{-3}$ to $10^{-2}$ M. In some embodiments, the binding affinity between the functional modulator protein and a cognate protein or ligand is in the picomolar to nanomolar range (e.g., between about $10^{-12}$ and about $10^{-9}$ M). In some embodiments, the binding affinity between a functional modulator protein and a cognate protein or ligand is in the nanomolar to micromolar range (e.g., between about $10^{-9}$ and about $10^{-6}$ M). In some embodiments, the binding affinity between a functional modulator protein and a cognate protein or ligand is in the micromolar to millimolar range (e.g., between about $10^{-6}$ and about $10^{-3}$ M). In some embodiments, the binding affinity between a functional modulator protein and a cognate protein or ligand is in the picomolar to micromolar range (e.g., between about $10^{-12}$ and about $10^{-6}$ M). In some embodiments, the binding affinity between a functional modulator protein and a cognate protein or ligand is in the nanomolar to millimolar range (e.g., between about $10^{-9}$ and about $10^{-3}$ M).

In some embodiments, a functional modulator protein further comprises a signal sequence (also referred to as a signal peptide of localization sequence). In some embodiments, the signal sequence is at the N- or C-terminal end of the functional modulator protein. A signal sequence functions to translocate the functional modulator protein to the membrane (or envelope) of the engineered enveloped vector. In some embodiments, a signal sequence is 5-10, 5-15, 10-20, 15-20, 15-30, 20-30, or 25-30 amino acids. In some embodiments, the signal sequence is an Ig Kappa leader sequence (e.g., a murine Ig Kappa leader sequence comprising: METDTLLLWVLLLWVPGSTG, SEQ ID NO. 16550) or a B2M signal peptide sequence (e.g., a B2M signal peptide sequence comprising: MSRSVALAVLALLSLS-GLEA, SEQ ID NO. 16551). In some embodiments, an engineered enveloped vector present in a library of vectors comprises the same signal sequence as some or all of the other vectors in the library. In some embodiments, each engineered enveloped vector present in a library of the vectors comprises a different signal sequence relative to some or all of the other engineered enveloped vectors in the library.

In some embodiments, a nucleic acid encoding a functional modulator protein further comprises an internal ribosome entry site (IRES). An IRES is an RNA sequence that allows for initiation of translation during protein synthesis. In some embodiments, the IRES is located at or near the C-terminal end. In some embodiments, the IRES is located C-terminal relative to the membrane-bound functional modulator protein domain and the extracellular functional modulator protein domain. In some embodiments, the IRES is a viral IRES. In some embodiments, the IRES is an IRES that is native to the retrovirus. In some embodiments, the IRES is a sequence derived from encephalomyocarditis virus (EMCV). In some embodiments, a retrovirus present in a library of engineered enveloped vectors comprises the same IRES as some or all of the other vectors in the library. In some embodiments, each engineered enveloped vector present in a library of the vectors comprises a different IRES relative to some or all of the other vectors in the library.

In some embodiments, a functional modulator protein further comprises a linker positioned between the membrane-bound domain and the extracellular domain. A linker can be an amino acid linker, e.g., a rigid linker, a flexible linker, or an oligomerized linker. A rigid linker is an amino acid sequence that lacks flexibility (e.g., may comprise at least one proline). In some embodiments, a rigid linker comprises a platelet-derived growth factor receptor (PDGFR) stalk, an Fc stalk, or a CD8α stalk. In some embodiments, a PDGFR stalk comprises an amino acid sequence comprising AVGQDTQEVIVVPHSLPFK, SEQ ID NO. 16552. In some embodiments, a PDGFR stalk comprises an amino acid sequence comprising ASAKPTTT-PAPRPPTPAPTIASQPLSLRPEAARPAAGGAVHTR-GLDFAK, SEQ ID NO. 16553.

A flexible linker is an amino acid sequence that has many degrees of freedom (e.g., may comprise a plurality of amino acids with small side chains, e.g., glycine or alanine). In some embodiments, a flexible linker comprises an amino acid sequence comprising GAPGAS, SEQ ID NO. 16548. In some embodiments, a flexible linker comprises an amino acid sequence consisting of GAPGSGGGGSGGGSAS (SEQ ID NO. 16554). In some embodiments, a flexible linker comprises an amino acid sequence comprising GGGGS (SEQ ID NO. 16549). In some embodiments, a flexible linker comprises an amino acid sequence comprising (GAPGAS)$_N$ or (G$_4$S)$_N$, wherein N is 1, 2, 3, 4, 5, 6, 7, 8, 9, 10, or more. An oligomerized linker is an amino acid that can oligomerize to another related amino acid. In some embodiments, an oligomerized linker is an amino acid sequence that can form a dimer, trimer, or tetramer. In some embodiments, an oligomerized linker comprises an IgG4 hinge domain (e.g., ASESKYGPPCPPCPAVGQDTQEVIV-VPHSLPFK, SEQ ID NO. 16555). In some embodiments, an oligomerized linker comprises an amino acid sequence that can form a tetrameric coiled coil (e.g., ASGGGGSGE-LAAIKQELAAIKKELAAIKWELAAIKQGAG, SEQ ID NO. 16556). In some embodiments, an oligomerized linker comprises an amino acid sequence that can form a dimeric coiled coil (e.g., ASESKYGPPCPPCP, SEQ ID NO. 16557).

In some embodiments, a functional modulator protein tethered to the engineered enveloped vector comprises at least one mutation or comprises 1, 2, 3, 4, 5, 6, 7, 8, 9, 10, or more mutations compared to the corresponding wild-type sequence. In some embodiments, a functional modulator protein comprising at least one mutation comprises a nucleotide sequence and/or amino acid sequence that is at least 50%, 60%, 70%, 80%, 90%, 95%, or 97% identical to a wild-type functional modulator protein. In some embodiments, a functional modulator protein comprising at least one mutation that diminishes its native function retains less than 95%, 90%, 80%, 70%, 60%, 50%, 40%, 30%, 20%, or 10% of the function of a wild-type functional modulator protein. In some embodiments, a functional modulator protein comprising at least one mutation lacks some or all of its native function. In some embodiments, a functional modulator protein comprising at least one mutation that increases its native function by 1,000%, 500%, 100%, 95%, 90%, 80%, 70%, 60%, 50%, 40%, 30%, 20%, or 10% more than the function of a wild-type functional modulator protein. In some embodiments, increases or decreases in function of a functional modulator protein are related to increases or decreases in binding affinity between the functional modulator protein and cognate ligands or receptors. In some embodiments, increases or decreases in function of a functional modulator protein are related to abrogation of binding between the functional modulator protein and cognate ligands or receptors.

6.1.4. Transgenes

The engineered enveloped vector can comprise a nucleic acid construct encapsulated in the engineered envelope. In some embodiments, the nucleic acid construct comprises a transgene.

The introduction of a particular foreign or native gene into a host or target cell is facilitated by introducing a transgene sequence into a suitable gene delivery vector. The transferred nucleic acid containing the structural and/or regulatory sequence is subsequently termed the transgene, the cell or organism comprising the transgene is termed transgenic cell and organism, respectively. A variety of methods have been developed to introduce such a recombinant gene delivery vector into a desired host cell. In contrast to methods which involve DNA transformation or transfection, the use of viral vectors can result in the rapid introduction of the recombinant nucleic acid (and its RNA transcript and/or its translated protein product) in a wide variety of host cells. In particular, viral vectors have been employed in order to increase the efficiency of introducing a recombinant nucleic acid (gene) vector into host or target cells.

Retrovirus- and lentivirus-based vectors have been used as tools to achieve stable, integrated gene transfer of foreign genes into cells. Retroviruses that have been employed as vectors for the introduction and expression of exogenous genes in cells include the Moloney murine sarcoma virus (T. Curran et al., J. ViroL. 44, 674-682 (1982); A. Gazit et al, J Virol. 60, 19-28 (1986)) and murine leukemia viruses (MuLV; A. D. Miller, Curr. Tsp. Microbiol. Immunol. 158, 1-24 (1992). Other viruses that have been employed as vectors for the transduction and expression of exogenous genes in mammalian cells include SV40 virus (see, e.g., H. Okayama et al., Molec. Cell Biol. 5, 1136-1142 (1985)); bovine papilloma virus (see, e.g., D. DiMalo et al., Proc. Natl. Acad. Sci. USA 79, 4030-4034 (1982)); adenovirus (see, e.g., J. E. Morin et al., Proc. Natl. Acad. Sci. USA 84, 4626 (1987)), adeno-associated virus (AAV; see, e.g., N. Muzyczka et al., J Clin. Inveit. 94, 1351 (1994)); herpes simplex virus (see, e.g., A. I. Geller, et al., Science 241, 1667 (1988)), and others.

In some embodiments, a transgene is encoded in a DNA plasmid which is transfected into packaging cells, which thereby is secreted encapsulated in the engineered enveloped vector. In some embodiments, the transgene is inserted into the genome of the packaging cells, which thereby is secreted encapsulated in the engineered enveloped vector. In some embodiments, the transgene inserted into the genome of the packaging cells is under control of an inducible promoter, e.g., a promoter comprising an element which is conditionally activated in the presence of a molecule such as tetracycline or mifepristone.

In some embodiments, the nucleic acid construct comprises regulatory elements that influence the transcription or translation of the transgene. For example, the nucleic acid construct can comprise a promoter of eukaryotic or prokaryotic origin, which is sufficient to direct the transcription of a distally located sequence (e.g., a sequence linked to the 5' end of the promoter sequence) in a cell. In some embodiments, the promoter region additionally comprises control elements for the enhancement or repression of transcription. Suitable promoters may include the cytomegalovirus immediate early promoter (pCMV), the Rous Sarcoma virus long terminal repeat promoter (pRSV), and the SP6, T3, or T7 promoters. Enhancer sequences upstream from the promoter or terminator sequences downstream of the coding region can also be included in the gene delivery vectors of the present invention to facilitate expression of the transgene. The nucleic acid constructs of the present invention can also comprise additional nucleic acid sequences, such as a polyadenylation sequence, a localization sequence, or a signal sequence, sufficient to permit a cell to efficiently and effectively process the protein expressed by the nucleic acid of the engineered enveloped vector. Exampled of preferred polyadenylation sequences are the SV40 early region polyadenylation site (C. V. Hall et al., *J Molec. App. Genet.* 2, 101 (1983)) and the SV40 late region polyadenylation site (S. Carswell and J. C. Alwine, *Mol. Cell Biol.* 9, 4248 (1989)). Such additional sequences can be included in the gene delivery vector so that they are operably linked with the promoter sequence, if transcription is desired, or additionally with the initiation and processing sequence if translation and processing are desired. Alternatively, the inserted sequences can be placed at any position in the vector. The term "operably linked" is used to describe a linkage between a gene sequence and a promoter or other regulatory or processing sequence such that the transcription of the gene sequence is directed by an operably linked promoter sequence, the translation of the gene sequence is directed by an operably linked translational regulatory sequence, and the post-translational processing of the gene sequence is directed by an operably linked processing sequence.

As will be appreciated by one skilled in the art, the nucleotide sequence of the inserted heterologous transgene sequence or sequences may be of any nucleotide sequence. For example, the inserted heterologous gene sequence may be a reporter gene sequence or a selectable marker gene sequence. A reporter transgene sequence, as used herein, is any gene sequence which, when expressed, results in the production of a protein whose presence or activity can be monitored. Examples of suitable reporter genes include the gene for green fluorescent protein (GFP), luciferase, etc. Alternatively, the reporter gene sequence may be any gene sequence whose expression produces a gene product which affects cell physiology. Preferred reporter or selectable marker gene sequences are sufficient to permit the recognition or selection of the vector in normal cells. In one embodiment of the invention, the reporter gene sequence will encode an enzyme or other protein which is normally absent from mammalian cells, and whose presence can, therefore, definitively indicate the presence of the vector in such a cell. Heterologous gene sequences of the present invention may comprise one or more gene sequences that already possess one or more promoters, initiation sequences, or processing sequences.

The heterologous gene sequence may also comprise the coding sequence of a desired product such as a suitable biologically active protein or polypeptide, immunogenic or antigenic protein or polypeptide, or a therapeutically active protein or polypeptide. Alternatively, the heterologous gene sequence may comprise a sequence complementary to an RNA sequence, such as an antisense RNA sequence, which antisense sequence can be administered to an individual to inhibit expression of a complementary polynucleotide in the cells of the individual.

Expression of the heterologous gene may provide an immunogenic or antigenic protein or polypeptide to achieve an antibody response, after which response antibodies can be collected from an animal in a body fluid such as blood, serum or ascites. Expression of the heterologous gene may provide immunogenic or antigenic protein or polypeptide to achieve an T cell response, after which response T cell receptor sequences can be captured from T cells.

Transgenes of the present invention can also be applied to provide a means to control expression of a protein and to assess its capacity to modulate cellular events. Some functions of proteins, such as their role in differentiation, may be studied in tissue culture, whereas others will require reintroduction into in vivo systems at different times in development in order to monitor changes in relevant properties.

Transgenes also possess substantial potential use in understanding and providing therapy for disease states. There are a number of inherited diseases in which defective genes are known and have been cloned. In some cases, the function of these cloned genes is known. In general, the above disease states fall into two classes: deficiency states, usually of enzymes, which are generally inherited in a recessive manner, and unbalanced states, at least sometimes involving regulatory or structural proteins, which are inherited in a dominant manner. For deficiency state diseases, transgenes delivered by engineered enveloped vectors could be used to bring a normal gene into affected tissues for replacement therapy, as well as to create animal models for the disease using antisense mutations. For unbalanced disease states, transgenes delivered by engineered enveloped vectors could be used to create a disease state in a model system, which could then be used in efforts to counteract the disease state. Thus the methods of the present invention permit the treatment of genetic diseases. As used herein, a disease state is treated by partially or wholly remedying the deficiency or imbalance which causes the disease or makes it more severe. The use of site-specific integration of nucleic sequences to cause mutations or to correct defects is also possible, for example, using CRISPR/Cas9 engineering systems.

Hematopoietic stem cells, lymphocytes, vascular endothelial cells, respiratory epithelial cells, keratinocytes, skeletal and muscle cardiac cells, satellite muscle cells, neurons and cancer cells are among proposed targets for therapeutic gene transfer, either ex vivo or in vivo. See, e.g., A. D. Miller, Nature 357, 455-460 (1992); R. C. Mulligan, Science 260, 926-932 (1993). These cells and others are suitable target cells for the engineered retroviral or lentiviral vectors and methods of the present invention.

Within the disclosure and claims of this invention, the term "expression cassette" can both refer to a transgene containing regulatory sequences comprising an adjacent structural gene, or alternatively it can refer a transgene comprising regulatory sequences only. The transgene to be introduced by means of the inventive lentivirus based vector may comprise at least one structural and/or regulatory gene, preferably of animal origin, more preferably of vertebrate or mammalian origin, or of human origin. Alternatively or additionally, the transgene may comprise nucleotide sequences encoding antisense RNA, a ribozyme, or siRNA (inhibitory RNA).

The expression cassette can include one or more, e.g. two, three, or more structural genes, preferably each one adjacent its regulatory sequences, e.g. tissue specific promoters, enhancer sequences, internal ribosomal entry sites (IRES-sequences) and additional selection markers.

In one embodiment, the engineered enveloped vector can be used to transduce cells of a subject without resulting in significant toxicity or immunogenicity in the subject, and, following transduction, the transgene is expressed. Upon transduction of the cells of a subject, the therapeutic protein is expressed in a therapeutically acceptable amount. In some embodiments, the cells to be transduced are non-dividing cells, such as neuronal, muscle, liver, skin, heart, lung, and bone marrow cells. In some embodiments, the cells to be transduced are dividing cells, such as T cells, B cells, hematopoietic stem cells (HSCs), macrophages, NK cells, dendritic cells, or monocytes. In some embodiments, the cells of the subject are liver cells.

In some embodiments, expression of the transgene is under the control of a tissue specific promoter and/or enhancer. For example, the promoter or other expression control sequence selectively enhances expression of the transgene in liver cells. Examples of liver specific promoters include, but are not limited to, the mouse thyretin promoter (mTTR), the endogenous human factor VIII promoter (F8), human alpha-1-antitrypsin promoter (hAAT), human albumin minimal promoter, and mouse albumin promoter. In some embodiments, the mTTR promoter is used. The mTTR promoter is described in R. H. Costa et al., 1986, Mol. Cell. Biol. 6:4697. The F8 promoter is described in Figueiredo and Brownlee, 1995, J. Biol. Chem. 270:11828-11838. In some embodiments, promoters are specific to neuronal, muscle, liver, skin, heart, lung, bone marrow cells, stem cells, T cells, regulatory T cells, B cells, hematopoietic stem cells, macrophages, NK cells, dendritic cells, or monocytes.

Expression levels can be further enhanced to achieve therapeutic efficacy using one or more enhancers. One or more enhancers can be provided either alone or together with one or more promoter elements. Typically, the expression control sequence comprises a plurality of enhancer elements and a tissue specific promoter.

In one embodiment of the invention, the nucleic acid constructs are constructed to encode an antibody, a fragment of an antibody (scFv) or a modification thereof.

In one embodiment of the invention, the nucleic acid constructs are constructed to encode T cell receptors (TCRs). TCRs are receptors found on the surface of T cells and play a crucial role in recognizing antigens presented by major histocompatibility complex (MHC) molecules. The nucleic acid construct encoding TCRs are designed to express TCR α and β chains, or γ and δ chains, depending on the specific T-cell subset or therapeutic strategy. These transgenes incorporate regulatory elements, such as promoters and enhancers, to drive the expression of the TCR genes in target cells. In some embodiments, the expression of the TCR transgene is conditional on delivery to a particular cell type, such as a T cell. In some embodiments, TCRs are used to redirect T cells toward a tumor target. In some embodiments, TCRs are used to redirect regulatory T cells toward a tissue or cell type, through which the engineered regulatory T cells modulate autoimmune disease or tolerance of organ transplant. In some embodiments, the TCR is directed against NY-ESO-1, MAGE-A3, MART-1, gp100, WT1, PRAME, LAGE-1, AFP, HER2, MUC1, Survivin, p53, CEA, PSMA, HPV, PR1, hTERT, TRP2, or neoantigens arising in the course of a patient's cancer progression.

In another embodiment, the nucleic acid construct comprise chimeric antigen receptors (CARs). CARs are synthetic receptors that combine an antigen-binding domain, typically derived from an antibody fragment, with intracellular signaling domains derived from T-cell receptor signaling molecules. The nucleic acid constructs encoding CARs allow for the expression of these chimeric receptors on the surface of T cells, enhancing their antigen recognition and cytotoxic activities. The transgenes include the necessary regulatory elements to drive CAR expression, including promoters, enhancers, and signaling sequences. In some embodiments, the CAR is directed against CD123 (encoded by DNA construct SEQ ID 16504), CD19 (encoded by DNA construct SEQ ID 16506), CD20 (encoded by DNA construct SEQ ID 16505), CD22, GPRC5D (encoded by DNA constructs SEQ ID NOs 16507, 16508, 16509), BCMA, CD30, CD33, EGFRvIII, HER2, GD2, mesothelin, PSMA, ROR1, CD38, CLL1, CD138, NKG2D ligands, MUC1, OX40, or CD171.

The nucleic acid constructs described herein can be customized to target specific antigens associated with a particular disease or condition. For TCR-based transgenes, the antigen specificity is conferred by the α and β or γ and δ chains, which recognize the specific antigen-MHC complex. CAR-based transgenes, on the other hand, can be designed to recognize cell surface antigens directly, without the requirement of MHC presentation.

In some embodiments, nucleic acid constructs described herein drive expression of an antigen-MHC complex in the target cell. In some embodiments, the antigen-MHC complex is expressed in T cells. In some embodiments, the antigen-MHC complex expressed in T cells redirects the target T cells to kill other T cells which express TCRs directed against the anti-MHC complex expressed by the transgene. In some embodiments, the T cells being killed are T cell malignancies, such as Adult T-cell Leukemia/Lymphoma (ATLL), Angioimmunoblastic T-cell Lymphoma (AITL), or Large Granular Lymphocytic Leukemia (LGLL). In some embodiments, a TCR clone driving Adult T-cell Leukemia/Lymphoma (ATLL), Angioimmunoblastic T-cell Lymphoma (AITL), or Large Granular Lymphocytic Leukemia (LGLL) is identified in a patient, and subsequently a cognate antigen-MHC complex is identified.

In one aspect, the extracellular binding domain, e.g., scFv, portion of a CAR of the invention is encoded by the nucleic acid construct whose sequence has been codon optimized for expression in a mammalian cell. In one aspect, entire CAR construct of the invention is encoded by a transgene whose entire sequence has been codon optimized for expression in a mammalian cell. Codon optimization refers to the discovery that the frequency of occurrence of synonymous codons (i.e., codons that code for the same amino acid) in coding DNA is biased in different species. Such codon degeneracy allows an identical polypeptide to be encoded by a variety of nucleotide sequences. A variety of codon optimization methods is known in the art, and include, e.g., methods disclosed in at least U.S. Pat. Nos. 5,786,464 and 6,114,148.

The present invention encompasses lentivirus- or retrovirus-based gene therapy strategies for inherited genetic disorders, aiming to restore or modulate the function of mutated genes. Lentiviral or retroviral gene delivery vectors are utilized to deliver therapeutic transgenes into target cells, where the therapeutic transgenes are integrated into the genome and produce functional proteins. The engineered lentivirus- or retrovirus based gene therapy described herein offers innovative solutions for a wide range of inherited genetic disorders, providing potential therapeutic options for affected individuals.

In one embodiment of the invention, engineered enveloped vector is employed to replace a defective gene with a functional copy. The engineered enveloped vector comprises a transgene cassette encoding the functional version of the mutated gene under the control of specific regulatory elements, such as promoters and enhancers. The engineered enveloped vector is capable of efficiently transducing target cells, including dividing and non-dividing cells, allowing for the delivery and integration of the therapeutic gene into the host genome.

In another embodiment, the engineered enveloped vector utilizes nuclease-based gene editing technologies, such as CRISPR/Cas9, CRISPR/Cas12a, or base editors, in combination with engineered enveloped vectors to correct genetic mutations. The engineered enveloped vector can carry the necessary components for gene editing, including guide RNA sequences and a coding sequence of the nuclease. Upon transduction, the engineered enveloped vector can induce expression of the gene editing machinery to target cells, enabling precise modification of the mutated gene. This approach allows for the correction of genetic mutations at the genomic DNA level, providing a potential cure for inherited genetic disorders.

The one or more DNA endonucleases can be a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, codon-optimized thereof, or modified versions thereof, and combinations thereof. In some embodiments, any of the DNA endonucleases disclosed in PCT/US2021/065554 filed on Dec. 29, 2021 and incorporated by reference herein is used.

Furthermore, the engineered enveloped vector can be employed to modulate gene expression in inherited genetic disorders. In certain cases, the underlying genetic defect may not involve a complete loss or mutation of a gene, but rather dysregulated gene expression. The engineered enveloped vectors can be designed to deliver transgenes comprising regulatory elements, such as microRNAs or transcription factors, to modulate the transcription or translation of specific genes. This approach aims to restore the balance of gene expression and alleviate the symptoms associated with the inherited genetic disorder.

The engineered enveloped vector described herein can be applied to a wide range of inherited genetic disorders, including but not limited to cystic fibrosis, Duchenne muscular dystrophy, hemophilia, sickle cell disease, and lysosomal storage disorders. The selection of the therapeutic gene and the design of the engineered enveloped vector can be tailored to the specific genetic defect and the requirements of the target cells.

In one embodiment of the invention, the engineered enveloped vector utilizes siRNAs as RNA inhibitors to silence the expression of disease-causing genes. The siRNAs are designed to be complementary to the target RNA sequence, triggering the degradation of the RNA molecule through the RNA interference (RNAi) pathway. The engineered enveloped vector comprises a transgene cassette encoding the siRNA sequence under the control of specific regulatory elements, such as promoters and enhancers. Upon transduction of target cells, the engineered enveloped vector delivers the siRNA, leading to the specific degradation of the target RNA and subsequent modulation of gene expression.

In some embodiments, the engineered enveloped vector-based gene therapy employs antisense oligonucleotides (ASOs) as RNA inhibitors to modulate gene expression by interfering with RNA processing, splicing, or translation. ASOs are oligonucleotides designed to be complementary to specific RNA sequences, allowing them to hybridize with the target RNA and modulate its function. In some embodiments, the engineered enveloped vector carries the transgene cassette encoding the ASO sequence, which can be designed to either promote RNA degradation or prevent the translation or processing of the target RNA. The engineered enveloped vector efficiently delivers the ASOs into target cells, enabling the modulation of gene expression and therapeutic intervention.

Additionally, the engineered enveloped vector can deliver transgenes comprising other RNA inhibitors, such as ribozymes or RNA aptamers, to achieve specific gene modulation or targeting. Ribozymes are RNA molecules with catalytic activity that can selectively cleave target RNA molecules at specific sites, while RNA aptamers are short RNA sequences that can bind to specific target molecules with high affinity and specificity. The engineered enveloped vectors carrying the transgene cassettes encoding ribozymes or RNA aptamers allow for the precise and targeted modulation of gene expression or interaction with specific cellular components.

The engineered enveloped vector utilizing RNA inhibitors described herein can be applied to various genetic disorders, including but not limited to neurodegenerative diseases, muscular dystrophies, inherited metabolic disorders, and oncology. The selection of the RNA inhibitor and the design of the engineered enveloped vector can be tailored to the specific target RNA molecule and the requirements of the target cells.

In one embodiment of the invention, the nucleic acid construct comprises transgenes comprising promoters to drive the expression of therapeutic genes in target cells. Promoters are DNA sequences that interact with transcription factors and RNA polymerase to initiate transcription. The nucleic acid construct incorporates a transgene cassette containing the promoter region upstream of the therapeutic transgene of interest. The selection of the promoter depends on the desired expression profile, tissue specificity, and regulatory requirements of the therapeutic gene. Examples of commonly used promoters include viral promoters (e.g., cytomegalovirus (CMV) promoter), cellular promoters (e.g., human elongation factor-1α (EF1α) promoter), and tissue-specific promoters (e.g., neuron-specific enolase (NSE) promoter). The choice of promoter can be tailored to achieve optimal expression levels and tissue specificity in the target cells.

In another embodiment, the nucleic acid construct incorporates enhancers to augment the activity of the promoter and enhance gene expression. Enhancers are DNA sequences that interact with specific transcription factors to increase the transcriptional activity of the promoter. The engineered enveloped vector comprises a transgene comprising enhancer elements within the transgene cassette, either in conjunction with the promoter or independently. The selection and combination of enhancers can be customized to achieve the desired level and pattern of gene expression in target cells. Enhancers can be derived from viral or cellular sources, or they can be synthetic in nature. Examples of commonly used enhancers include the cytomegalovirus immediate-early enhancer (CMV enhancer) and the SV40 enhancer. The incorporation of enhancers allows for the fine-tuning of gene expression, enabling precise control over therapeutic outcomes.

The engineered enveloped vector utilizing promoters and enhancers described herein can be applied to various diseases, including but not limited to genetic disorders, cancer, autoimmune disease, neurodegenerative diseases, and cardiovascular diseases. The selection of the appropriate promoters and enhancers depends on the specific therapeutic gene, target cells, and desired expression profiles.

6.1.5. Reporter Transgenes and Nucleic Acid Barcodes

In some embodiments, the nucleic acid construct described herein comprises a reporter transgene (e.g., a gene encoding a reporter protein). In some embodiments, the nucleic acid construct encodes a reporter transgene (e.g., a reporter protein). As used herein, a reporter transgene is generally a protein or gene that can be detected when expressed in a target cell. In some embodiments, the presence or absence of a reporter in a target cell or a subset of a target cells in a population of cells allows the ability to sort cells (e.g., using flow cytometry and/or fluorescence-activated cell sorting).

In some embodiments, a reporter is a fluorescent protein. A fluorescent protein may be a green fluorescent protein (GFP), yellow fluorescent protein (YFP), red fluorescent protein (RFP). A fluorescent protein may be as described in U.S. Pat. No. 7,060,869, entitled "Fluorescent protein sensors for detection of analytes". In some embodiments, the fluorescent protein is used with FACS to isolate or purify a library of cells which have been transduced with a library of retroviruses or lentiviruses.

In some embodiments, a reporter is an antibiotic resistance marker. In some embodiments, an antibiotic resistance marker is a protein or gene that confers a competitive advantage to a target cell that contains the marker. In some embodiments, the antibiotic resistance marker comprises a hygromycin resistance protein or gene, a kanamycin resistance protein or gene, ampicillin resistant protein or gene, streptomycin resistant protein or gene, or a neomycin resistance protein or gene. In some embodiments, the antibiotic resistance marker is used to isolate or purify a library of cells which have been transduced with a library of engineered retroviruses or lentiviruses.

In some embodiments, the engineered enveloped vector described herein comprises a nucleic acid comprising a nucleic acid barcode. In some embodiments, the engineered enveloped vectors described herein deliver a nucleic acid payload to a target cell, such that the target cell subsequently expresses an RNA transcript comprising a nucleic acid barcode. In some embodiments, the target cell additionally expresses an RNA nucleic acid barcode or comprises a DNA nucleic acid barcode, and isolating transduced cells into reaction containers (e.g., microfluidic chambers, well plates, or emulsion microdroplets) plus overlap extension RT-PCR or overlap extension PCR and high-throughput sequencing are used to match the engineered retrovirus- or lentivirus-delivered barcode and the cell barcode in a high throughput manner.

6.2. Cells

A cell as described herein may be any bacterial, mammalian, or yeast cell. In some embodiments, a cell is a human, mouse, rat, or a non-human primate cell. In some embodiments, a cell is a somatic cell or a reproductive cell. In some embodiments, a cell is an epithelial cell, a neural cell, a hormone-secreting cell, an immune cell, a secretory cell, a blood cell, an interstitial cell, or a germ cell. In some embodiments, a cell is an antigen-specific cell (e.g., a cell that binds to a specific antigen). In some embodiments, an antigen-specific cell is an immune cell. In some embodiments, an antigen-specific cell is a B cell or a T cell. In some embodiments, a cell is a target cell (e.g., that comprises a cognate protein or ligand capable of being targeted by an engineered enveloped vector described herein).

A population of cells as described herein may be any bacterial, mammalian, or yeast cell population. In some embodiments, a population of cells is a population of human, mouse, rat, or non-human primate cells. In some embodiments, a population of cells is a somatic cell population or a reproductive cell population. In some embodiments, a population of cells comprises epithelial cells, neural cells, hormone-secreting cells, immune cells, secretory cells, blood cells, interstitial cells, and/or germ cells. In some embodiments, a population of cells comprises antigen-specific cells (e.g., cells that binds to a specific antigen). In some embodiments, a population of antigen-specific cells comprises immune cells. In some embodiments, a population of antigen-specific cells comprises B cells and/or T cells. In some embodiments, a population of cells comprises a homogenous population of cells. In some embodiments, a population of cells comprises a heterogeneous population of cells.

In some embodiments, a population of cells is a population of cells isolated from a subject. The subject can be a human subject (e.g., a human subject suffering from a disease), a mouse subject, a rat subject, or a non-human primate subject. In some embodiments, a population of cells is isolated from the blood or a tumor of a subject. In some embodiments, a subject comprises a population of cells. In some embodiments, a population of cells remains in the subject. In some embodiments, a population of cells is removed from the subject.

In some embodiments, a population of cells has been previously frozen and thawed (e.g., 1, 2, 3, 4, 5, or more freeze/thaw cycles). In some embodiments, a population of cells are maintained in liquid culture media. In some embodiments, a population of cells have been passaged 1, 2, 3, 4, 5, or more times, using any known method. In some embodiments, a population of cells are maintained in liquid culture media prior to being combined with an engineered enveloped vector. In some embodiments, a population of cells are maintained in liquid culture media after being combined with an engineered enveloped vector or plurality of engineered enveloped vectors. In some embodiments, a population of cells are maintained in liquid culture media prior to while being combined with an engineered enveloped vector or plurality of engineered enveloped vectors.

In some embodiments, a population of cells comprises any of the engineered enveloped vectors (e.g., engineered retroviruses or lentiviruses) described herein. In some embodiments, a subset of a population of cells contains any of the engineered enveloped vectors (e.g., engineered retroviruses or lentiviruses) described herein. In some embodiments, a subset of a population of cells contains the engineered enveloped vector inside each cell of the subset (e.g., inside the nucleus of each cell of the subset). In some embodiments, a population of cells or a subset thereof expresses a reporter (e.g., a fluorescent protein or an antibiotic resistance marker). In some embodiments, a population of cells or a subset thereof (e.g., containing an engineered enveloped vector) are isolated and/or sorted based on the presence or absence of a reporter. In some embodiments, a subset of a population of cells that contain engineered enveloped vector described herein are isolated and/or sorted based on the presence or absence of a reporter away from the cells of the population that do not contain the engineered enveloped vector. In some embodiments, at least 50%, 60%, 70%, 80%, 90%, or 95% of a population of cells prior to cell sorting contain an engineered enveloped vector. In some embodiments, at least 70%, 80%, 90%, 95%, or 100% of a population of cells contain an engineered enveloped vector following isolation and/or sorting based on the presence or absence of a reporter.

In some embodiments, a population of cells comprises packaging cells which are used to produce the engineered enveloped vector (lentivirus or other retrovirus). In some embodiments, the packaging cells are a population of cells which are substantially equivalent to each other, i.e., largely clonal. In some embodiments, the packaging cells comprise a library of cells which produce a library of distinct engineered enveloped vectors (e.g., lentivirus or other retrovirus). In some embodiments, the packaging cells comprise a library of cells which encode a library of nucleic acid barcodes. In some embodiments, the transgene comprises a nucleic acid barcode. In some embodiments, nucleic acid barcodes are not used, rather, the envelope sequences or scFv sequences or other surface receptors are delivered to target cells as transgenes and sequenced directly. In some embodiments, the library of cells is engineered to express nucleic acid barcodes using a library of engineered enveloped vector (engineered lentivirus or retrovirus). In some embodiments, the library of cells is engineered to express nucleic acid barcodes using a library of plasmids. In some embodiments, the nucleic acid barcodes in the library of cells are measured or characterized using high-throughput DNA sequencing. In some embodiments, the library of cells expresses a library of recombinant proteins. In some embodiments, the nucleic acid barcode comprises the same RNA transcript as the RNA transcript which expresses the recombinant proteins. In some embodiments, the nucleic acid barcode comprises a different transcript from the RNA transcript which expresses the recombinant proteins. In some embodiments, the library of recombinant proteins expressed by packaging cells comprises a library of non-viral membrane-bound proteins. In some embodiments, the library of recombinant proteins expressed by packaging cells comprises a library of fusogens. In some embodiments, the library of recombinant proteins expressed by packaging cells comprises a library of functional modulator proteins. In some embodiments, the transgenes of the lentivirus comprise the recombinant proteins of the library.

In some embodiments, a population of cells comprises target cells for engineered enveloped vectors (engineered lentivirus or population of lentivirus or engineered retrovirus or a population of retrovirus). In some embodiments, the target cells are a population of cells which are substantially equivalent to each other, i.e., largely clonal. In some embodiments, the target cells comprise a library of cells which produce a library of distinct recombinant proteins. In some embodiments, the target cells comprise a library of cells which encode a library of nucleic acid barcodes. In some embodiments, the library of target cells is engineered to express nucleic acid barcodes using a library of lentivirus or retrovirus. In some embodiments, the library of cells is engineered to express nucleic acid barcodes using a library of CRISPR/Cas9 guide RNAs. In some embodiments, the nucleic acid barcodes in the library of cells are measured or characterized using high throughput DNA sequencing. In some embodiments, the library of cells comprises a library of recombinant proteins. In some embodiments, the library of cells comprises a library of immortalized primary cells. In some embodiments, the library of cells comprises a library of immortalized primary cells, each cell type or clone within the library expressing or comprising a unique nucleic acid barcode. In some embodiments, the nucleic acid barcode comprises the same RNA transcript as the RNA transcript which expresses the recombinant proteins. In some embodiments, the nucleic acid barcode comprises a different transcript from the RNA transcript which expresses the recombinant proteins. In some embodiments, the library of target cells expresses one or more of SEQ ID NOs: 168-5339 or SEQ ID NOs: 5340-8121, or sequences comprising fragments or fusion proteins of one or more of SEQ ID NOs: 168-5339 or SEQ ID NOs: 5340-8121. In some embodiments, the library of target cells comprises 10, 100, 1,000, 10,000, 100,000, 1,000,0000, 10,000,000, or more than 10,000,000 unique nucleic acid barcodes. In some embodiments, the library of cells comprises a mutated library of one or more proteins. In some embodiments, the library of cells comprises a scanning alanine mutagenesis library of one or more proteins. In some embodiments, the library of cells comprises library of one or more proteins generated using error-prone PCR.

6.3. Polynucleotide Constructs Encoding Proteins of the Engineered Enveloped Vectors In another aspect, the present disclosure provides polynucleotide constructs encoding one or more proteins of the engineered enveloped vectors provided herein. In some embodiments, the polynucleotide construct encodes a viral envelope protein (fusogene). In some embodiments, the polynucleotide construct encodes a non-viral membrane-bound protein for targeting and tropism. In some embodiments, the polynucleotide construct encodes a functional modulator protein. In some embodiments, the polynucleotide construct comprises a sequence of a transgene. In some embodiments, the transgene construct comprises one or more long terminal repeat (LTR) sequences. In some embodiments, the LTR sequences are wild type, and in some embodiments, the LTR sequences are chimeric or mutated. In some embodiments, the polynucleotide construct is used for generation of the engineered enveloped vector.

In some embodiments, the polynucleotide construct further comprises a regulatory sequence. In some embodiments, the regulatory sequence is a tissue or cell type specific regulatory element such as an enhancer or a promoter. In some embodiments, the regulatory element is a synthetic sequence. In some embodiments, the regulatory element is an endogenous, naturally-occurring sequence.

In some embodiments, the polynucleotide construct is a plasmid. In some embodiments, the polynucleotide construct is a non-plasmid vector. In some embodiments, the polynucleotide construct is a viral vector. In some embodiments, the polynucleotide construct is inserted into the genome of the cell.

In some embodiments, a plasmid encodes more than one component selected from a viral envelope protein (fusogene), a non-viral membrane-bound protein for tropism, and a functional modulator protein. When a plasmid includes multiple components, the plasmid can include one or more promoters. In some embodiments, a plasmid includes IRES (internal ribosome entry site). In some embodiments, a plasmid encodes a viral envelope protein (fusogene), a non-viral membrane-bound protein for targeting and tropism, or a functional modulator protein.

6.4. Methods of Making Engineered Enveloped Vectors

Another aspect of the present disclosure provides a method of making an engineered enveloped vector disclosed herein. In some embodiments, the method comprises delivering the one or more polynucleotide constructs disclosed above (e.g., a polynucleotide construct encoding a viral envelope protein (fusogen), non-viral membrane-bound protein, functional modulator protein, and/or transgene) into packaging cells, culturing the packaging cells and harvesting the engineered enveloped vectors. In some embodiments, the method further comprises enriching full engineered enveloped vectors containing a nucleic acid construct.

In some embodiments, one or more of the polynucleotide constructs are delivered into the packaging cells as one or more plasmids. In some embodiments, one or more of the polynucleotide constructs are incorporated into the genome of the packaging cells. Second generation lentivirus packaging plasmids encode for Gag, Pol, Pro, Rev, and Tat genes from a single plasmid. Plasmid psPAX2 (SEQ ID NO.: 16498) is an example of a 2nd generation lentivirus packaging plasmid. Second generation lentiviral transfer plasmids express the viral RNA from the 5' LTR and this is Tat-dependent. pLOC-TurboRFP is an example of a 2nd generation transfer plasmid (SEQ ID NO. 16499). 3rd generation lentivirus packaging plasmids split the packaging system into 2 plasmids, with one encoding for Rev (ex. pRSV-Rev, SEQ ID NO. 16500) and a second encoding for Gag, Pro and Pol (ex. pMDLg/pRRE, SEQ ID NO. 16501; and pCgpV, SEQ ID NO. 16502). The Tat gene is removed from 3rd generation packaging systems. Therefore, an exogenous promoter like CMV or RSV must be used to drive expression of the viral RNA from the transfer vector. pReceiver-EF1a-GFP (SEQ ID NO. 16503) is an example of a 3rd generation lentiviral transfer plasmid. 4th generation lentivirus packaging plasmids further split the packaging system with one plasmid encoding for Gag and Pro, a second plasmid encoding for Pol, and a third plasmid encoding for Tat and Rev. 4th generation lentivirus packaging systems typically use a tetracycline (Tet)-Off expression plasmid to drive the expression of the Gag-Pro and Tat-Rev expression plasmids which contain Tat transactivator sequences. In this system, the expression of Gag, Pro, Tat, and Rev require expression of Tet-Off in tetracycline free medium. 4th generation lentiviral packaging systems can package either 2nd or 3rd generation transfer plasmids.

In some embodiments, the packaging cells are human and animal (e.g., pig, cattle, dog, horse, donkey, mouse, hamster, monkeys) cells.

6.5. Library of Engineered Enveloped Vectors

Described herein includes a library of engineered enveloped vectors. In some embodiments, the library comprises a plurality of unique engineered enveloped vectors, wherein each unique vector comprises a viral fusogen protein, a non-viral membrane-bound protein, and a nucleic acid encoding a reporter or a nucleic acid barcode, and wherein each unique vector comprises a different and unique extracellular targeting domain. Also described herein are libraries of engineered enveloped vectors, wherein a library comprises a plurality of unique engineered enveloped vectors, wherein each unique engineered enveloped vector comprises a viral fusogen protein, a non-viral membrane-bound protein, a functional modulator protein, and a nucleic acid encoding a reporter or a nucleic acid barcode, and wherein each unique vector comprises a different and unique extracellular targeting domain. Also described herein are libraries of engineered enveloped vectors, wherein a library comprises a plurality of unique engineered enveloped vectors, wherein each unique vector comprises a viral fusogen protein, a functional modulator protein, and a nucleic acid encoding a reporter or a nucleic acid barcode, and wherein each unique vector comprises a different and unique extracellular targeting domain. Also described herein are libraries of cells comprising engineered enveloped vectors, wherein a library comprises a plurality of unique cells, wherein each unique cell comprises a unique engineered enveloped vector.

In some embodiments, the library of engineered enveloped vectors comprises a library of transfer vectors further comprising a library of nucleic acids encoding viral envelope proteins. In some embodiments, the library of engineered enveloped vector comprises a library of transfer vectors further comprising a library of nucleic acids encoding non-viral membrane-bound proteins. In some embodiments, the library of engineered enveloped vector comprises a library of transfer vectors further comprising a library of nucleic acids encoding genome editing proteins and/or nucleic acids required for genome editing, e.g., CRISPR/Cas proteins and/or cognate guide RNAs for genome editing.

The one or more DNA endonucleases can be a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, codon-optimized thereof, or modified versions thereof, and combinations thereof.

In some embodiments, the library of engineered enveloped vectors comprises a library of packaging cells further comprising a library of nucleic acids encoding viral envelope proteins. In some embodiments, the library of engineered enveloped vectors comprises a library of packaging cells further comprising a library of nucleic acids encoding non-viral membrane-bound proteins. In some embodiments, the library of engineered enveloped vectors comprises a library of packaging cells further comprising a library of nucleic acids encoding genome editing proteins and/or nucleic acids required for genome editing, e.g., CRISPR/Cas proteins and/or cognate guide RNAs for genome editing. In some embodiments, the non-viral membrane-bound proteins, viral envelope proteins, and/or genome editing proteins are engineered stably into a plurality of the genomes of the cells.

In some embodiments, libraries include pMHC-encoded (peptide/MHC-encoded) retroviral (e.g., lentiviral) libraries for use in screening populations of T cells. In such libraries, the pMHC displayed on the virus surface will enable T cell infection in a TCR-specific manner. Infected T cells can be collected and sequenced, allowing for the identification of pMHC ligands that can infect a subset of a T cell population of interest and the ability to simultaneously track TCR sequences and reactive pMHC ligands. In some embodiments, pMHC retroviral libraries minimally comprise randomized transfer vectors containing randomized pMHC targeting elements. In some embodiments, randomly derived libraries are generated using degenerate oligonucleotide primers. In some embodiments, targeted libraries that are specific for a unique set of antigens (e.g., all possible viral or bacterial antigens for a particular target of interest—human immunodeficiency virus, tuberculosis TB, etc.; or all possible neoantigens for a particular subject) are generated.

In some embodiments, a library is capable of being screened against a population of antigen-specific cells (e.g., B cells or T cells). In some embodiments, a library comprises at least $10^2$, at least $10^3$, at least $10^4$, at least $10^5$, at least $10^6$, at least $10^7$, at least $10^8$, at least $10^9$, or at least $10^{10}$ unique engineered enveloped vectors. In some embodiments, a library comprising unique engineered enveloped vectors comprise extracellular targeting domains that are at least 5, at least 10, at least 15, at least 20, or at least 50 amino acids in length. In some embodiments, each different and unique extracellular targeting domain is generated through site-directed mutagenesis.

Retroviral, lentiviral, or cell libraries can vary in size from hundreds to hundreds of thousands, millions, or more unique retroviruses, lentiviruses, or unique cells. In some embodiments, the libraries of the disclosure comprise at least 500,000 unique engineered enveloped vector (retroviruses or lentiviruses) or unique cells. The libraries of the invention include retroviral libraries and cellular libraries. A library is a synthetic (i.e., isolated, synthetically produced, free from components that are naturally found together in a cell, purified before being put into the library) collection of members having a common element and at least one distinct element. The library comprises a thousand or more (e.g., at least: 1,000; 2,000; 3,000; 4,000; 5,000; 10,000; 50,000; 100,000; 500,000; 600,000; 700,000; 800,000; 900,000; 1,000,000; 2,000,000; 3,000,000; 4,000,000; or more) members. The upper limit of the library size is defined by the combinatorics of domains or modules providing distinctness or diversity among the members. For instance, an upper limit may be 4,000,000 members. Thus, in some embodiments, the engineered library is highly diverse, and includes at least 500,000 distinct members. The highly diverse library may have a diversity of $10^6$ or greater. In some embodiments, a library of engineered enveloped vectors is generated using site-directed mutagenesis of a nucleic acid described herein. In some embodiments, the site-directed mutagenesis involves the use of primers and a low-fidelity RNA polymerase to allow for randomized mutagenesis of a common nucleic acid as described herein.

In some embodiments, a population of cells comprises packaging cells which are used to produce engineered enveloped vectors. In some embodiments, the packaging cells are a population of cells which are substantially equivalent to each other, i.e., largely clonal. In some embodiments, the packaging cells comprise a library of cells which produce a library of distinct engineered enveloped vectors (lentivirus or other retrovirus). In some embodiments, the packaging cells comprise a library of cells which encode a library of nucleic acid barcodes. In some embodiments, the library of cells is engineered to express nucleic acid barcodes using a library of engineered enveloped vectors (engineered enveloped vector). In some embodiments, the library of cells is engineered to express nucleic acid barcodes using a library of plasmids (e.g., transfer plasmids that encode lentiviral transgenes). In some embodiments, the nucleic acid barcodes in the library of cells are measured or characterized using high-throughput DNA sequencing. In some embodiments, no barcode is used. In some embodiments, the library of cells express a library of recombinant proteins. In some embodiments, the nucleic acid barcode comprises the same RNA transcript as the RNA transcript which expresses the recombinant proteins. In some embodiments, the nucleic acid barcode comprises a different transcript from the RNA transcript which expresses the recombinant proteins. In some embodiments, the library of recombinant proteins expressed by packaging cells comprises a library of non-viral membrane-bound protein (e.g., target cell tropism proteins). In some embodiments, the library of recombinant proteins expressed by packaging cells comprises a library of fusogens (e.g., viral envelope proteins). In some embodiments, the library of envelope proteins comprises transgenes for transduction into target cells. In some embodiments, transduction of libraries of envelope proteins in vivo or in vitro, followed by sequencing of transgenes delivered to target cells, is used to screen for and identify envelope proteins of utility. In some embodiments, the library of recombinant proteins expressed by packaging cells comprises a library of functional modulator proteins. In some embodiments, the library of recombinant proteins expressed by packaging cells comprises TCRs, CARs, or pMHC lentiviral transgenes. In some embodiments, in vivo or in vitro transduction with libraries of TCRs, CARs, or pMHC lentiviral transgenes followed by sequencing and/or functional analysis (i.e., antigenic activation followed by flow cytometry of an activation marker) is used to identify TCRs, CARs, or pMHCs of high therapeutic potential.

In some embodiments, a library of engineered enveloped vectors comprises a library of antibodies, scFv, or other antibody fragments. In some embodiments, the library of antibodies, scFv, or other antibody fragments is generated by first immunizing at least one humanized or wild type mouse, chicken, rat, monkey, or human subject with an immunogen (e.g., protein, glycoprotein, peptide, cell, lysed cell, etc.) and amplifying nucleic acids encoding antibodies, scFv, or other antibody fragments from B cells, plasmablasts, plasma cells, or other antibody-producing cells from the subject, and then generating a library of engineered enveloped vectors from the amplified nucleic acids. In some embodiments, said amplified nucleic acid library comprising antibodies, scFv, or other antibody fragments from a mammalian subject is generated by steps comprising isolating a plurality of single cells from said mammalian subject into emulsion microdroplets, in order to obtain pairs of heavy and light chain sequences linked at a single cell level. In some embodiments, said amplified nucleic acid library comprising antibodies, scFv, or other antibody fragments from a mammalian subject is generated by steps comprising yeast, mammalian, bacterial or phage scFv, full-length antibody, or Fab display to identify binders of interest, followed by re-formatting the library of binders into a lentiviral or other retrovirus library. In some embodiments, yeast, mammalian, bacterial or phage scFv, full-length antibody, or Fab display libraries are generated with single cell pairing between heavy and light chain sequences intact, in other embodiments, pairing between heavy and light chain sequences is random.

In some embodiments, a library of engineered enveloped vectors (retroviruses or lentiviruses) comprises a library of TCRs. In some embodiments, the library of TCRs is generated by first immunizing at least one humanized or wild type mouse, chicken, rat, monkey, or human subject with an immunogen (e.g., protein, glycoprotein, peptide, cell, lysed cell, etc.) and amplifying nucleic acids encoding TCRs or TCR fragments from T cells from the subject, and then generating an engineered retroviral or lentiviral library from the amplified nucleic acids. In some embodiments, said amplified nucleic acid library comprising TCRs from a mammalian subject is generated by steps comprising isolating a plurality of single cells from said mammalian subject into emulsion microdroplets. In some embodiments, said amplified nucleic acid library TCRs or TCR fragments from a mammalian subject is generated by steps comprising yeast, mammalian, bacterial or phage displayed TCRs to identify binders of interest, followed by re-formatting the library of binders into a lentiviral or other retrovirus library. In some embodiments, TCR libraries are generated with single cell pairing between alpha and beta chain TCR sequences intact, in other embodiments, pairing between alpha and beta chain TCR sequences is random.

In some embodiments, a library of engineered enveloped vectors is derived from a library of packaging cells wherein the envelope protein is engineered into a plurality of the genomes of the packaging cells. In some embodiments, a plurality of the genomes of the packaging cells comprise a single envelope protein. In some embodiments, the library of packaging cells is used to make a library of engineered enveloped vector, by transfecting the library of packaging cells with packaging plasmids which induce secretion of engineered enveloped vector from the packaging cells. In some embodiments, this library of engineered enveloped vector is used to transduce target cells. In some embodiments, the transduced target cells are then sequenced to assess which envelope proteins were associated with successful transduction. In some embodiments, said transduction is done in vitro. In some embodiments, said transduction is done by infusing or injecting the library in vivo, i.e., into a mouse, rat, or dog.

In some embodiments, a library of engineered enveloped vectors is derived from a library of packaging cells wherein a non-viral target cell tropism protein (e.g., antibody or antibody fragment, or scFv) is engineered into a plurality of the genomes of the packaging cells. In some embodiments, a plurality of the genomes of the packaging cells comprise a single non-viral target cell tropism protein. In some embodiments, the library of packaging cells is used to make a library of engineered enveloped vector, by transfecting the library of packaging cells with packaging plasmids which induce secretion of engineered enveloped vector from the packaging cells. In some embodiments, this library of engineered enveloped vector is used to transduce target cells. In some embodiments, the transduced target cells are then sequenced to assess which non-viral target cell tropism proteins were associated with successful transduction. In some embodiments, said transduction is done in vitro. In some embodiments, said transduction is done by infusing or injecting the library in vivo, i.e., into a mouse, rat, or dog.

6.6. Methods of Screening

Described herein include the methods of screening using the engineered enveloped vector disclosed herein. In some embodiments, the screening method comprises: (i) providing an engineered enveloped vector comprising a viral envelope fusogen protein, a target cell tropism protein, and a nucleic acid encoding a reporter; (ii) combining the engineered enveloped vector with a population of cells; and (iii) sorting the population of cells based on the presence or absence of the reporter. The method can further comprise identifying cells or cell types that can become a target of the engineered enveloped vector. In some embodiments, the method comprises identifying the target cell tropism protein that can be used for targeting the specific cells or cell type.

Also described herein are methods of screening a population of cells comprising: (i) providing an engineered enveloped vector comprising a viral envelope fusogen protein, a target cell tropism protein, a functional modulator protein, and a nucleic acid encoding a reporter; (ii) combining the retrovirus with a population of cells; and (iii) sorting the population of cells based on the presence or absence of the reporter. The method can further comprise identifying cells or cell types that are responsive to the functional modulator protein. In some embodiments, the method comprises identifying the functional modulator protein that can modulate the specific cells or cell types. In some embodiments, the method further comprises identifying cells or cell types that can become a target of the engineered enveloped vector. In some embodiments, the method comprises identifying the target cell tropism protein that can be used for targeting the specific cells or cell type.

For the method, any of the engineered enveloped vectors disclosed herein can be used. In some embodiments, the engineered enveloped vector of (i) comprises a nucleic acid comprising a structure: S-ETD-MBD, wherein S encodes a signal sequence, ETD encodes an extracellular targeting domain; and MBD encodes a membrane-bound domain; and a viral envelope fusogen protein. In some embodiments, the engineered enveloped vector of (i) comprises a nucleic acid comprising a structure: S-ETD-MBD-IRES-R, wherein S encodes a signal sequence, ETD encodes an extracellular targeting domain; MBD encodes a membrane-bound domain, IRES encodes an internal ribosome entry site, and R encodes a reporter; and a viral envelope fusogen protein.

As used herein, the term "combining" (which, in some embodiments, is synonymous with the terms "providing" and "contacting") generally refers to the act of bringing an engineered enveloped vector into close, physical contact with a population of cells, such that the extracellular targeting domain of the vector is capable of binding to the cognate ligand present on a subset of cells of the population. In some embodiments, combining of an engineered enveloped vector and a population of cells occurs when a solution comprising the engineered enveloped vector and a solution comprising the population of cells are mixed. In some embodiments, combining of an engineered enveloped vector and a population of cells occurs when a lyophilized engineered enveloped vector and a solution comprising the population of cells are mixed. In some embodiments, combining of an engineered enveloped vector and a population of cells occurs when a lyophilized engineered enveloped vector and a lyophilized population of cells are mixed and reconstituted with a solution. In some embodiments, the cells of the population are maintained in cell culture media, in a monolayer of cells, and/or are attached to a tissue culture plate or petri dish.

Generally, an engineered enveloped vector and a population of cells are combined (e.g., physically combined or contacted) for a defined period of time. In some embodiments, a period of time is measured in seconds, minutes, hours or days. In some embodiments, the period of time is 0-30 seconds, 15-45 seconds, 30-60 seconds, 45-90 seconds, 60-90 seconds, or 60-120 seconds. In some embodiments, a retrovirus and a population of cells are combined and in contact for 0-30 seconds, 15-45 seconds, 30-60 seconds, 45-90 seconds, 60-90 seconds, or 60-120 seconds. In some embodiments, the period of time is 1-2 minutes, 1-5 minutes, 1-10 minutes, 2-10 minutes, 5-10 minutes, 5-20 minutes, 10-20 minutes, 25-30 minutes, 25-60 minutes, 30-45 minutes, 30-40 minutes, 40-60 minutes, 50-70 minutes, or 60-120 minutes. In some embodiments, an engineered enveloped vector and a population of cells are combined and in contact for 1-2 minutes, 1-5 minutes, 1-10 minutes, 2-10 minutes, 5-10 minutes, 5-20 minutes, 10-20 minutes, 25-30 minutes, 25-60 minutes, 30-45 minutes, 30-40 minutes, 40-60 minutes, 50-70 minutes, or 60-120 minutes. In some embodiments, the period of time is at least 1 minute, at least 2 minutes, at least 5 minutes, at least 10 minutes, at least 20 minutes, at least 30 minutes, at least 60 minutes, at least 45 minutes, at least 40 minutes, at least 70 minutes, or at least 120 minutes. In some embodiments, an engineered enveloped vector and a population of cells are combined and in contact for 1-2 minutes, 1-5 minutes, 1-10 minutes, 2-10 minutes, 5-10 minutes, 5-20 minutes, 10-20 minutes, 25-30 minutes, 25-60 minutes, 30-45 minutes, 30-40 minutes, 40-60 minutes, 50-70 minutes, or 60-120 minutes.

In some embodiments, the period of time is 1-2 hours, 1-5 hours, 1-3 hours, 2-5 hours, 3-6 hours, 3-12 hours, 6-12 hours, 12-18 hours, 12-24 hours, 15-30 hours, 18-24 hours, 24-48 hours, 24-36 hours, or 36-50 hours. In some embodiments, the period of time is at least 1 hour, at least 2 hours, at least 5 hours, at least 3 hours, at least 6 hours, at least 12 hours, at least 18 hours, at least 24 hours, at least 15 hours, at least 30 hours, at least 48 hours, at least 36 hours, or at least 50 hours. In some embodiments, an engineered enveloped vector and a population of cells are combined and in contact for 1-2 hours, 1-5 hours, 1-3 hours, 2-5 hours, 3-6 hours, 3-12 hours, 6-12 hours, 12-18 hours, 12-24 hours, 15-30 hours, 18-24 hours, 24-48 hours, 24-36 hours, or 36-50 hours. In some embodiments, a period of time is 1, 2, 3, 4, 5, 6, 7, 8, 9, 10, or 5-15 days. In some embodiments, an engineered enveloped vector and a population of cells are combined and in contact for 1, 2, 3, 4, 5, 6, 7, 8, 9, 10, or 5-15 days.

In some embodiments, a population of cells are sorted based on the presence or absence of the reporter. In some embodiments, a subset of the population of cells containing the reporter (e.g., express the reporter) are sorted from the remaining subset of the population of cells that do not contain the reporter. In some embodiments, sorting of the population of cells is performed using flow cytometry (e.g., fluorescence-activated cell sorting), next-generation DNA sequencing (e.g., single-cell next-generation sequencing), or antibiotic selection.

In some embodiments, the conditions of step (ii) that allow for the engineered enveloped vector to have interactions with a subset of the population of cells comprise combining the engineered enveloped vector and the population of cells in the presence of defined solutions, compositions and at specific temperatures. In some embodiments, the engineered enveloped vector and the population of cells are combined in the presence of a cell culture media (e.g., RPMI or DMEM cell culture media). In some embodiments, the lentivirus or retrovirus and the population of cells are combined in the presence of a buffered saline solution. In some embodiments, a buffered saline solution is a phosphate-buffered saline or HEPES-buffered saline. In some embodiments, a buffered saline solution comprises bovine serum albumin and/or EDTA. In some embodiments, the retrovirus and the population of cells are combined in the presence of an enhancer of retroviral or lentiviral transduction (e.g., heparin sulfate, polybrene, protamine sulfate, or dextran). In some embodiments, the engineered enveloped vector sand the population of cells are combined in (ii) at a temperature ranging from 4° C. to 42° C., 4° C. to 8° C., 4° C. to 10° C., 8° C. to 15° C., 10° C. to 20° C., 18° C. to 23° C., 20° C. to 30° C., 25° C. to 35° C., 30° C. to 40° C., or 37° C. to 42° C.

In some embodiments, the methods of screening described herein further comprise washing the population of cells between steps (ii) and (iii) with a wash solution. In some embodiments, a wash solution is any liquid solution that allows for maintenance of healthy cells (e.g., solution comprising neutral pH, low-to-moderate levels of ionic strength). In some embodiments, washing the population of cells removes excess and/or remaining engineered enveloped vector from the population of cells. In some embodiments, the population of cells are washed using a cell culture media (e.g., RPMI or DMEM cell culture media). In some embodiments, the population of cells are washed using a buffered saline solution. In some embodiments, a buffered saline solution is a phosphate-buffered saline or HEPES-buffered saline. In some embodiments, a buffered saline solution comprises bovine serum albumin and/or EDTA. In some embodiments, the population of cells are washed at a temperature ranging from 4° C. to 42° C., 4° C. to 8° C., 4° C. to 10° C., 8° C. to 15° C., 10° C. to 20° C., 18° C. to 23° C., 20° C. to 30° C., 25° C. to 35° C., 30° C. to 40° C., or 37° C. to 42° C.

In some embodiments, the population of cells are maintained in liquid culture prior to being combined with the engineered enveloped vector. In some embodiments, the population of cells are maintained in liquid culture after being combined with the engineered enveloped vector. In some embodiments, the population of cells are maintained in liquid culture during the combining step with the engineered enveloped vector. In some embodiments, the population of cells are attached to a cell culture plate or petri dish. In some embodiments, the population of cells are maintained in a monolayer, an embryoid body, or any cell aggregate.

In some embodiments, methods of screening comprise the use of a plurality of engineered enveloped vectors. In certain embodiments, a plurality of engineered enveloped vectors comprises at least $10^2$, $10^3$, $10^4$, $10^5$, $10^6$, $10^7$, $10^8$, $10^9$, $10^{10}$, $10^{11}$, or $10^{12}$ unique engineered enveloped vectors. In some embodiments, there may be at least $10^2$, $10^3$, $10^4$, $10^5$, $10^6$, $10^7$, $10^8$, $10^9$, $10^{10}$, $10^{11}$, or $10^{12}$ copies of each unique retrovirus present in a plurality of retroviruses.

In some embodiments, the methods of screening comprise screening a population of cells with at least two different, unique engineered enveloped vectors. In some embodiments, a different, unique engineered enveloped vector comprises a different extracellular targeting domain and/or a different reporter. In some embodiments, methods of screening comprise a first retrovirus (or lentivirus) and a second retrovirus (or lentivirus), wherein the first and second retrovirus (or lentivirus) comprise different extracellular targeting domains and/or different reporters. In some embodiments, methods of screening comprise screening a population of cells with 2, 3, 4, 5, 6, 7, 8, 9, 10, 50, 100 or more different engineered enveloped vectors. In some embodiments, methods of screening comprise screening a population of cells with a library of engineered enveloped vectors. In some embodiments, a library of engineered enveloped vectors comprises at least $10^2$, at least $10^3$, at least $10^4$, at least $10^5$, at least $10^6$, at least $10^7$, at least $10^8$, at least $10^9$, or at least $10^{10}$ unique retroviruses or lentiviruses.

6.7. Methods for Screening Libraries of Engineered Enveloped Vectors and Cells

Certain quantitative genetic analyses of biological tissues and organisms are best performed at the single cell level. However, single cells only contain picograms of genetic material. Conventional methods, such as polymerase chain reaction (PCR), RNA sequencing (Mortazavi et al., 2008 Nature Methods 5:621-8), chromatin immunoprecipitation sequencing (Johnson et al., 2007 Science 316:1497-502), or whole genome sequencing (Lander et al., 2001 Nature 409:860-921), require more genetic material than is found in a single cell and are usually performed with thousands to millions of cells. These techniques provide useful genetic information at the cell population level but have serious limitations for understanding biology at the single cell level.

Single cells are used as reaction compartments for performing various genetic analyses (Embleton et al., 1992 Nucleic Acids Research 20:3831-37; Hviid, 2002 Clinical Chemistry 48:2115-2123; U.S. Pat. No. 5,830,663). Single cells are sorted in aqueous-in-oil microdroplet emulsions, and molecular analyses are performed in the microdroplets (Johnston et al., 1996 Science 271:624-626; Brouzes et al., 2009 PNAS 106:14195-200; Kliss et al., 2008 Anal Chem 80:8975-81; Zeng et al., 2010 Anal Chem 82:3183-90). These single cell assays are limited to single cell PCR in emulsions, or in situ PCR in single fixed and permeabilized cells. Moreover, when analyzing large populations of cells, it is difficult to trace back each gene product to a single cell or subpopulations of cells.

Massively parallel methods related to analysis of nucleic acids in single cells are disclosed in US45960010P and related patents from Johnson, incorporated herein by reference in their entireties. These methods provide protocols for performing a bulk sequencing reaction to generate sequence information for at least 100,000 fused complexes from at least 10,000 cells within the population of cells, wherein the sequence information is sufficient to co-localize the first target nucleic acid sequence and the second target nucleic acid sequence to a single cell from the population of at least 10,000 cells. Methods of screening or any other methods of using the engineered enveloped vectors disclosed herein can be used performed using the single cell analysis system.

In some embodiments, target cells transduced with the engineered enveloped vectors of the current invention are subjected to single cell genetic analysis (e.g., FIGS. 5-10). In one aspect, the single cell is isolated in an emulsion microdroplet. In another aspect, the single cell is isolated in a reaction container. In some embodiments, single cell genetic analysis is used to provide single-cell coexpression or colocalization between a nucleic acid barcode delivered by a retrovirus and a barcode comprising the target cell prior to transduction. In some embodiments, single cell genetic analysis is used to provide single-cell coexpression or colocalization between a nucleic acid barcode delivered by the engineered vector and any nucleic acid comprising the target cell prior to transduction, including the whole transcriptome or 10, 100, 1,000, 10,000, 100,000 or 1,000,000 endogenous nucleic acid targets or RNA transcripts. In some embodiments, single cell genetic analysis is used to provide single-cell coexpression or colocalization between a nucleic acid encoding a reporter delivered by an engineered enveloped vector and any nucleic acid comprising the target cell prior to transduction, including the whole transcriptome or 10, 100, 1,000, 10,000, 100,000 or 1,000,000 endogenous nucleic acid targets or RNA transcripts. In some embodiments, single cell genetic analysis is used to provide single-cell coexpression or colocalization between a nucleic acid encoding a protein reporter delivered by a retrovirus (or lentivirus) and a barcode comprising the target cell prior to transduction. In some embodiments, the massively parallel single cell analysis is performed to profile 100, 1,000, 10,000, 100,000, 1,000,000, or 10,000,000 or more single cells in parallel. In some embodiments, the massively parallel single cell analysis is performed to profile 100, 1,000, 10,000, 100,000, 1,000,000, or 10,000,000 or more single cells in parallel, which have been transduced with a library of 100, 1,000, 10,000, 100,000, 1,000,000, or 10,000,000 or more retrovirus (or lentivirus) types in parallel. In some embodiments, a plurality of single nucleic acid barcodes are isolated with the single cells, and the single nucleic acid barcodes are used to uniquely identify nucleic acids derived from the single cells. In some embodiments, a bead is used to deliver the nucleic acid barcode to the isolated single cell.

In one embodiment, the amplifying step includes performing a polymerase chain reaction, wherein the amplifying step comprises performing a polymerase chain reaction, and wherein the first and third probes are forward primers and the second and fourth probes are reverse primers for the polymerase chain reaction. In another embodiment, the amplifying step includes performing a polymerase chain reaction, wherein the first and third amplification primers are forward primers and the second and fourth amplification primers are reverse primers for the polymerase chain reaction. In some embodiments, the amplifying step comprises performing a ligase chain reaction. The amplifying step can include performing a polymerase chain reaction, a reverse-transcriptase polymerase chain reaction, a ligase chain reaction, or a ligase chain reaction followed by a polymerase chain reaction.

In some embodiments, the method for analyzing the single cell includes a single cell contained within a population of at least 25,000 cells, at least 50,000 cells, at least 75,000 cells, or at least 100,000 cells. In some embodiments, the single cell is a unique cell with respect to the remaining cells in the population. In other embodiments, the single cell is a representative of a subpopulation of cells within the population. The population can be considered in some embodiments to be the total number of cells analyzed in a method of the invention. In one embodiment, performing the high-throughput sequencing reaction to generate sequence information is carried out for at least 1,000,000 fused complexes from at least 10,000 cells within the population of cells.

In some embodiments, the method includes introducing a unique barcode sequence comprising at least six nucleotides into each of the plurality of single cells, wherein each barcode sequence is selected from a pool of barcode sequences with greater than 1,000-fold diversity in sequences. For each of the plurality of single cells, the method includes providing at least one set of nucleic acid probes. The method includes steps for analyzing at least two nucleic acid sequences in a single cell contained within a population of at least 10,000 cells, comprising isolating each of a plurality of single cells from a population of at least 10,000 cells in an emulsion microdroplet or a reaction container. The method includes introducing a unique barcode sequence comprising at least six nucleotides into each of the plurality of single cells, wherein each barcode sequence is selected from a pool of barcode sequences with greater than 1,000-fold diversity in sequence.

In some embodiments, the barcode sequence is affixed to a bead or a solid surface. The bead or the solid surface can be isolated in the emulsion microdroplet or the reaction container. In other embodiments, the method includes introducing a unique barcode sequence comprises fusing the emulsion microdroplet or a reaction container comprising the single cell with the emulsion microdroplet or a reaction container comprising the barcode sequence affixed to the bead or the solid surface. The second target nucleic acid sequence can be complementary to an RNA sequence. The second target nucleic acid sequence can be complementary to a DNA sequence. In certain embodiments, amplifying comprises performing a polymerase chain reaction, performing a ligase chain reaction, or performing by ligase chain reaction followed by polymerase chain reaction.

In one embodiment, the single cell is contained within a population of at least 25,000 cells. In other embodiments, the single cell is contained within a population of at least 50,000 cells. The single cell can be contained within a population of at least 75,000 cells or within a population of at least 100,000 cells. In certain embodiments, the method also includes quantifying the fused complexes.

In some embodiments, a microfluidic device is used to generate single cell emulsion droplets. The microfluidic device ejects single cells in aqueous reaction buffer into a hydrophobic oil mixture. The device can create thousands of emulsion microdroplets per minute. After the emulsion microdroplets are created, the device ejects the emulsion mixture into a trough. The mixture can be pipetted or collected into a standard reaction tube for thermocycling.

Custom microfluidics devices for single-cell analysis are routinely manufactured in academic and commercial laboratories (Kintses et al., 2010 *Current Opinion in Chemical Biology* 14:548-555). For example, chips may be fabricated from polydimethylsiloxane (PDMS), plastic, glass, or quartz. In some embodiments, fluid moves through the chips through the action of a pressure or syringe pump. Single cells can even be manipulated on programmable microfluidic chips using a custom dielectrophoresis device (Hunt et al., 2008 *Lab Chip* 8:81-87). In one embodiment, a pressure-based PDMS chip comprised of flow-focusing geometry manufactured with soft lithographic technology is used (Dolomite Microfluidics (Royston, UK)) (Anna et al., 2003 *Applied Physics Letters* 82:364-366). The stock design can typically generate 10,000 aqueous-in-oil microdroplets per second at size ranges from 10-150 μm in diameter. In some embodiments, the hydrophobic phase will consist of fluorinated oil containing an ammonium salt of carboxy-perfluoropolyether, which ensures optimal conditions for molecular biology and decreases the probability of droplet coalescence (Johnston et al., 1996 *Science* 271:624-626). To measure periodicity of cell and droplet flow, images are recorded at 50,000 frames per second using standard techniques, such as a Phantom V7 camera or Fastec InLine (Abate et al., 2009 *Lab Chip* 9:2628-31).

The microfluidic system can optimize microdroplet size, input cell density, chip design, and cell loading parameters such that greater than 98% of droplets contain a single cell. There are three common methods for achieving such statistics: (i) extreme dilution of the cell solution; (ii) fluorescent selection of droplets containing single cells; and (iii) optimization of cell input periodicity. For each method, the metrics for success include: (i) encapsulation rate (i.e., the number of drops containing exactly one cell); (ii) the yield (i.e., the fraction of the original cell population ending up in a drop containing exactly one cell); (iii) the multi-hit rate (i.e., the fraction of drops containing more than one cell); (iv) the negative rate (i.e., the fraction of drops containing no cells); and (v) encapsulation rate per second (i.e., the number of droplets containing single cells formed per second).

In some embodiments, a simple microfluidic chip with a drop-making junction is used, such that an aqueous stream flows through a 10 μm square nozzle and dispenses the aqueous-in-oil emulsion mixtures into a reservoir. The emulsion mixture can then be pipetted from the reservoir and thermocycled in standard reaction tubes. This method will produce predictably high encapsulation rates and low multi-hit rates, but a low encapsulation rate per second. A design that can achieve filled droplet throughput of 1000 Hz is capable of sorting up to $10^6$ cells in less than 17 minutes. In some embodiments, the methods of the invention use single cells in reaction containers, rather than emulsion droplets. Examples of such reaction containers include 96 well plates, 0.2 mL tubes, 0.5 mL tubes, 1.5 mL tubes, 384-well plates, 1536-well plates, etc.

PCR is used to amplify many kinds of sequences, including but not limited to SNPs, short tandem repeats (STRs), variable protein domains, methylated regions, and intergenic regions. Methods for overlap extension PCR are used to create fusion amplicon products of several independent genomic loci in a single tube reaction (Johnson et al., 2005 *Genome Research* 15:1315-24; U.S. Pat. No. 7,749,697).

In some embodiments, at least two nucleic acid target sequences (e.g., first and second nucleic acid target sequences, or first and second loci) are chosen in the cell and designated as target loci. Forward and backward primers are designed for each of the two nucleic acid target sequences, and the primers are used to amplify the target sequences. "minor" amplicons are generated by amplifying the two nucleic acid target sequences separately, and then fused by amplification to create a fusion amplicon, also known as a "major" amplicon. In one embodiment, a "minor" amplicon is a nucleic acid sequence amplified from a target genomic loci, and a "major" amplicon is a fusion complex generated from sequences amplified between multiple genomic loci.

PCR primers are designed against targets of interest using standard parameters, i.e., melting temperature (Tm) of approximately 55-65° C., and with a length 20-50 nucleotides. The primers are used with standard PCR conditions, for example, 1 mM Tris-HCl pH 8.3, 5 mM potassium chloride, 0.15 mM magnesium chloride, 0.2-2 μM primers, 200 μM dNTPs, and a thermostable DNA polymerase. Many commercial kits are available to perform PCR, such as Platinum Taq (Life Technologies), Amplitaq Gold (Life Technologies), Titanium Taq (Clontech), Phusion polymerase (Finnzymes), HotStartTaq Plus (Qiagen). Any standard thermostable DNA polymerase can be used for this step, such as Taq polymerase or the Stoffel fragment.

In one embodiment, a set of nucleic acid probes (or primers) are used to amplify a first target nucleic acid sequence and a second target nucleic acid sequence to form a fusion complex. The first probe includes a sequence that is complementary to a first target nucleic acid sequence (e.g., the 5' end of the first target nucleic acid sequence). The second probe includes a sequence that is complementary to the first target nucleic acid sequence (e.g., the 3' end of the first target nucleic acid sequence) and a second sequence that is complementary to an exogenous sequence. In some embodiments, the exogenous sequence is a non-human nucleic acid sequence and is not complementary to either of the target nucleic acid sequences. The first and second probes are the forward primer and reverse primer for the first target nucleic acid sequence.

The third probe includes a sequence that is complementary to the portion of the second probe that is complementary to the exogenous sequence and a sequence that is complementary to the second target nucleic acid sequence (e.g., the 5' end of the second target nucleic acid sequence). The fourth probe includes a sequence that is complementary to the second target nucleic acid sequence (e.g., the 3' end of the second target nucleic acid sequence). The third probe and the fourth probe are the forward and reverse primers for the second target nucleic acid sequence.

The second and third probes are also called the "inner" primers of the reaction (i.e., the reverse primer for the first locus and the forward primer for the second locus) and are limiting in concentration, (e.g., 0.01 µM for the inner primers and 0.1 µM for all other primers). This will drive amplification of the major amplicon preferentially over the minor amplicons. The first and fourth probes are called the "outer" primers.

In other embodiments, a plurality of barcodes are fused to RNA transcripts from single cells by binding to a probe affixed to a bead followed by first strand cDNA synthesis, subsequently followed by PCR.

The first and second nucleic acid sequences are amplified independently, such that the first nucleic acid sequence is amplified using the first probe and the second probe, and the second nucleic acid sequence is amplified using the third probe and the fourth probe. Next, a fusion complex is generated by hybridizing the complementary sequence regions of the amplified first and second nucleic acid sequences and amplifying the hybridized sequences using the first and fourth probes. This is called overlap extension PCR amplification. In other embodiments, a plurality of barcodes are fused to RNA transcripts from single cells by binding to a probe affixed to a bead followed by first strand cDNA synthesis, subsequently followed by PCR.

During overlap extension PCR amplification, the complementary sequence regions of the amplified first and second nucleic acid sequences act as primers for extension on both strands and in each direction by DNA polymerase molecules. In subsequent PCR cycles, the outer primers prime the full fused sequence such that the fused complex is duplicated by DNA polymerase. This method produces a plurality of fusion complexes. In other embodiments, a plurality of barcodes are fused to RNA transcripts from single cells by binding to a probe affixed to a bead followed by first strand cDNA synthesis, subsequently followed by PCR.

In some embodiments, multiple loci are targeted in a single cell, and many sets of probes can be multiplexed into a single analysis, such that several loci or even the entire transcriptome or genome is analyzed. Multiplex PCR is a modification of PCR that uses multiple primer sets within a single PCR mixture to produce amplicons of varying sizes that are specific to different DNA sequences. By targeting multiple genes at once, additional information may be gained from a single test run that otherwise would require several times the reagents and more time to perform. In one embodiment, 10-20 different transcripts are targeted in a single cell and linked to a second target nucleic acid (e.g., linked to a variable region such as a mutated gene sequence, a barcode, or an immune variable region). In some embodiments, a plurality of barcodes are fused to RNA transcripts from single cells by binding to a probe affixed to a bead followed by first strand cDNA synthesis, subsequently followed but PCR.

In one embodiment, single cells are encapsulated in aqueous-in-oil picoliter microdroplets. The droplets enable compartmentalization of reactions such that molecular biology can be performed on millions of single cells in parallel. Monodisperse aqueous-in-oil microdroplets can be generated on microfluidic devices at size ranges from 10-150 vim in diameter. Alternatively, droplets can be generated by vortexing or by a TissueLyser (Qiagen). Two embodiments of oil and aqueous solutions for creating PCR microdroplets are: (i) PCR buffer that contains 0.5 µg/µL bovine serum albumin (New England Biolabs) combined with mixture of fluorocarbon oil (3M), Krytox 157FSH surfactant (Dupont), and PicoSurf (Sphere Microfluidics); and (ii) PCR buffer with 0.1% Tween 20 (Sigma) combined with a mixture of light mineral oil (Sigma), EM90 (Evonik), and Triton X-100 (Sigma). Several replicate assays quantifying 1 million amplicons by next-generation sequencing have shown that both chemistries form monodisperse microdroplets that are >99.98% stable after 40 cycles of PCR. PCR can occur in a standard thermocycling tube, a 96-well plate, or a 384-well plate, using a standard thermocycler (Life Technologies). PCR can also occur in heated microfluidic chips, or any other kind of container that can hold the emulsion and transfer heat.

After thermocycling and PCR, the amplified material must be recovered from the emulsion. In one embodiment, ether is used to break the emulsion, and then the ether is evaporated from the aqueous/ether layer to recover the amplified DNA in solution. Other methods include adding a surfactant to the emulsion, flash-freezing with liquid nitrogen, and centrifugation. Once the linked and amplified products are recovered from the emulsion, there are a number of methods to prepare the product for bulk sequencing. In one embodiment, the major amplicon is isolated from the minor amplicons using gel electrophoresis. If yield is not sufficient, the major amplicon is amplified again using PCR and the two outer primers. This material can then be sequenced directly using bulk sequencing. In some embodiments, the outer primers are used to produce molecules than can be sequenced directly. In other embodiments, adapters must be added to the major amplicon before bulk sequencing. Once the sequencing library is synthesized, bulk sequencing can be performed using standard methods and without significant modification.

Bulk sequencing requires destruction of cells or emulsion microdroplets, such that all polynucleic acid analytes are pooled into a single reaction mixture. Trace back of a particular sequence target from bulk sequencing data to a particular cell is typically not possible. However, many applications will require trace back of sequences to their original single cells. For example, an investigator may wish to analyze a cell population for single cell expression patterns for two RNA transcripts. Overlap extension reverse transcriptase PCR amplification of two RNA transcript targets followed by bulk sequencing is not adequate for such an analysis because all of the transcripts are mixed together, and transcripts from high-expressing cells are indistinguishable from transcripts from low-expressing cells. To address this problem, polynucleic acid barcodes are used. Each single cell emulsion microdroplet or physical reaction container contains a single unique clonal polynucleic acid barcode. This barcode is then linked to the target polynucleic acids (i.e., RNA transcripts), and is used to trace back the major amplicons to a single cell (See FIGS. 4-10). With trace back of each sequence to an original single cell, it is possible to tabulate genetic data for each single cell, which then enables single cell quantification (i.e., single cell gene expression levels).

In one embodiment, the linker barcode oligonucleotide is highly diluted, such that less than 1% of picoliter emulsion microdroplets carry more than one linker barcode. This enables the linking of a single cell to a single barcode. The linker barcode oligonucleotide is amplified by PCR using universally primers inside each droplet, such that each droplet will contain millions of copies of only one linker barcode sequence, and that barcode will be unique to that droplet. The dilution follows Poisson statistics such that for P (k=1) 0.99, the linker barcodes need to be diluted to $\lambda \approx 0.01$. The barcode is then physically linked to the target molecule by overlap extension PCR or by binding to a probe affixed to a bead followed by first strand cDNA synthesis. Nucleic acid amplification using bead emulsions is described in U.S. Pat. No. 7,842,457.

In another embodiment, a microfluidic device injects beads coated with clonal linker barcode oligonucleotides into the single cell emulsion microdroplets. Such a device enables visualization of single beads and single cells in each drop, eliminating the requirement for highly dilute linker barcode oligonucleotides. In this embodiment, PCR is also used to amplify the linker barcode oligonucleotide, such that each droplet contains millions of copies of the same barcode sequence, but each barcode would be unique to a single microdroplet. The barcode is then linked to the target nucleic acid sequence using overlap extension PCR. During overlap extension PCR amplification, the complementary sequence regions of the amplified first and second nucleic acid sequences act as primers for extension on both strands in each direction by DNA polymerase molecules. In other embodiments, the barcode is linked to endogenous RNA transcripts by binding to a probe affixed to a bead followed by first strand cDNA synthesis, followed by PCR. In some embodiments, in overlap extension PCR, in subsequent PCR cycles, the outer primers prime the full fused sequence such that it is duplicated by DNA polymerase. These methods produce a plurality of fusion complexes.

There are a number of commercial methodologies for polynucleic acid sequencing. These technologies are often referred to as "high-throughput sequencing", "next generation sequencing," "massively parallel sequencing," or "bulk sequencing." These terms are used interchangeably to describe any sequencing method that is capable of acquiring more than one million polynucleic acid sequences in a single run. Typically these methods function by making highly parallelized measurements, i.e., parallelized screening of millions of DNA clones on glass slides. The methods for linking multiple polynucleic acid targets in single cells could be used in combination with any commercialized bulk sequencing method. These methods include reversible terminator chemistry (Illumina), single molecule sequencing (Pacific Biosciences), and others (IonTorrent, Element Biosciences, Ultima Genomics, etc.).

After the molecular linkage protocols are performed, and before high-throughput sequencing, it is useful to specifically amplify and purify major amplicons to reduce the overall sequencing required to obtain useful data. Otherwise, many minor amplicons and other kinds of unwanted background sequences will be sequenced unnecessarily. This is accomplished by PCR using only the outer primers and the nucleic acid analyte obtained from the lysed cells, followed by size selection using a method such as gel agarose electrophoresis. Other methods, such as size exclusion columns, microfluidic electrophoresis, or micropore filters, might be used to select the proper size molecules.

In one embodiment, the method provides the step of performing a high-throughput sequencing reaction to generate sequence information for at least 100,000 fused complexes from at least 10,000 cells within a population of cells. In another embodiment, the high-throughput sequencing reaction generates sequence information for at least 75,000, 50,000, or 25,000, or 10,000 fused complexes from at least 10,000 cells within a population of cells. The fused complexes can then be used to quantify the particular biological or clinical phenomenon of interest.

In the case of functional T or B cell analysis, particular clonotypes can be analyzed by first determining the CDR3 peptide sequence of the fused complex, and then tabulating the instances of that CDR3 peptide linked to a particular barcode or nucleic acid encoding a reporter protein. In this way high-throughput sequencing quantifies which clonotypes were transduced by the retrovirus of the current invention, or which clonotypes were displayed on the surface of the lentivirus or retrovirus in order to efficiently transduce the target cells. In some aspects, the invention involves knowledge of lentiviral or retroviral libraries comprising nucleic acid barcodes linked to scFv or other target cell tropism proteins displayed on the surface of the engineered enveloped vector, followed by transduction with the library into target cells, followed by single cell methods which identify which scFv or other target cell tropism proteins were associated with successful transduction into target cells.

In the case of linkage between barcodes and transcript targets, high-throughput sequencing data is stratified by barcode and then tabulated by the instances of a particular barcode linked to a transcript target. When primers targeting multiple transcripts are multiplexed into a single assay, one uses barcodes to infer multigenic expression patterns for single cells traced back to single droplets. In the case of linkage between a mutant or variable sequence and other mutant or variable sequences, one analyzes the bulk sequencing data to determine the sequence at each locus in each molecule in the high-throughput sequencing library, and then tabulates the instances of each sequence type.

6.8. Methods of Delivering Nucleic Acid to a Cell

The engineered enveloped vectors and methods of the present invention are useful in in vitro expression systems, wherein the inserted heterologous genes comprising the engineered enveloped vector encode proteins or peptides which are desirably produced in vitro. The engineered enveloped vectors and methods of the present invention are useful in in vivo expression systems, wherein the inserted heterologous genes comprising the engineered enveloped vector encode proteins or peptides which are desirably produced in vivo.

Described herein are methods of delivering a nucleic acid to a cell, comprising (i) providing an engineered enveloped vector of the present invention; and (ii) contacting the engineered enveloped vector with the cell such that the engineered enveloped vector enters or infects the cell. In some embodiments, the nucleic acid encodes an mRNA molecule, optionally wherein the mRNA is a gene of interest. In some embodiments, the nucleic acid encodes a double-stranded RNA, an antisense RNA, a microRNA, or any other RNA molecule. In some embodiments, the gene of interest encodes a protein. In some embodiments, the nucleic acid encodes CRISPR/Cas proteins, zinc fingers, or other recombinant proteins for genome engineering. In some embodiments, the gene of interest encodes a therapeutic protein (e.g., a protein to compensate for a diseased condition in a subject).

In some embodiments, the nucleic acid is delivered to the cell when the engineered enveloped vector enters or infects the cell during step (ii). In some embodiments, the methods of delivering a nucleic acid described herein do not require a transfection agent (e.g., a lipophilic transfection agent such as Lipofectin).

In some embodiments, the engineered encapsulated vectors are further formulated to be encapsulated into lipid nanoparticles.

In some embodiments, lipid nanoparticles comprising lipids tethered or attached to one or more of any of SEQ ID NOs: 1-167 are used to deliver nucleic acids to target cells. In some embodiments, lipid nanoparticles comprising lipids tethered or attached to one or more of any of SEQ ID NOs: 1-167 are used to deliver CRISPR/Cas proteins, zinc fingers, or other recombinant proteins for genome engineering.

6.9. Methods for Vaccination and Gene Therapy

Pharmaceutical formulations, such as vaccines, of the present invention comprise an immunogenic amount of the engineered enveloped vector as disclosed herein in combination with a pharmaceutically acceptable carrier. An "immunogenic amount" is an amount of the infectious virus particles which is sufficient to evoke an immune response in the subject to which the pharmaceutical formulation is administered. Exemplary pharmaceutically acceptable carriers include, but are not limited to, sterile pyrogen-free water and sterile pyrogen-free physiological saline solution. Subjects which may be administered immunogenic amounts of the infectious, replication-defective virus particles of the present invention include but are not limited to human and animal (e.g., pig, cattle, dog, horse, donkey, mouse, hamster, monkeys) subjects.

Pharmaceutical formulations of the present invention include those suitable for parenteral (e.g., subcutaneous, intradermal, intramuscular, intravenous and intraarticular), oral or inhalation administration. Alternatively, pharmaceutical formulations of the present invention may be suitable for administration to the mucus membranes of a subject (e.g., intranasal administration). The formulations may be conveniently prepared in unit dosage form and may be prepared by any of the methods well known in the art. In some embodiments, formulation includes post-translational modifications of the engineered enveloped vector, for example, addition of polyethylene glycol (PEG) moieties to the engineered enveloped vector. In some embodiments, the PEG moieties are added to the purified engineered enveloped vector, prior to formulation in storage buffer, fill, and finish. In some embodiments, the formulation buffer for the engineered enveloped vector includes a stabilizer, for example, a formulation of 50 mM HEPES, 20 mM MgCl2, pH 7.5 with 10% sucrose. In some embodiments the formulation buffer is PBS or HEPES.

The engineered enveloped vectors, methods and pharmaceutical formulations of the present invention are additionally useful in a method of administering a protein or peptide to a subject in need of the desired protein or peptide, as a method of treatment or otherwise. In some embodiments of the invention, the heterologous gene comprising the engineered enveloped vector of the present invention encodes the desired protein or peptide, and packaging cells or pharmaceutical formulations containing the packaging cells of the present invention are administered to a subject in need of the desired protein or peptide. In this manner, the protein or peptide may thus be produced in vivo in the subject. The subject may be in need of the protein or peptide because the subject has a deficiency of the protein or peptide, or because the production of the protein or peptide in the subject may impart some therapeutic effect, as a method of treatment or otherwise, and as explained further below.

The gene transfer technology of the present invention has several research applications. In some embodiments, cloned DNA or genomic sequences for proteins can be introduced into multicellular organisms such as patients in vivo, in order to study cell-specific differences in processing and cellular fate. In some embodiments, by placing the coding sequences under the control of a strong promoter, a substantial amount of the desired protein can be made. In some embodiments, the specific residues involved in protein processing, intracellular sorting, or biological activity are determined by mutational change in discrete residues of the coding sequences.

Gene transfer technology of the present invention is also applied to provide a means to control expression of a protein and to assess its capacity to modulate cellular events. In some embodiments, some functions of proteins, such as their role in differentiation, are studied in tissue culture, whereas others will require reintroduction into in vivo systems at different times in development in order to monitor changes in relevant properties. In some embodiments, gene transfer provides a means to study the nucleic acid sequences and cellular factors which regulate expression of specific genes. In some embodiments, the regulatory elements to be studied are fused to reporter genes and subsequently the expression of the reporter gene is assayed.

Gene transfer also possesses substantial utility in providing therapy for disease states. In some embodiments, the retrovirus comprises a transgene. In some embodiments, the transgene is any nucleic acid of interest that is transcribed. In some embodiments, the transgene encodes a polypeptide. In some embodiments, the polypeptide has some therapeutic benefit. There are a number of inherited diseases in which defective genes are known and have been cloned, for example, sickle cell anemia, muscular dystrophy, cystic fibrosis, thalassemia, phenylketonuria, color blindness, skeletal dysplasia, haemophilia, immune deficiency, and thousands of other conditions. In general, the above disease states fall into two classes: deficiency states, usually of enzymes, which are generally inherited in a recessive manner, and unbalanced states, at least sometimes involving regulatory or structural proteins, which are inherited in a dominant manner. In some embodiments, for deficiency state diseases, gene transfer by the retrovirus of this invention is used to bring a normal gene into affected tissues for replacement therapy, as well as to create animal models for the disease using antisense mutations. In some embodiments, for unbalanced disease states, gene transfer by the engineered enveloped vector of this invention is used to create a disease state in a model system, which is then used in efforts to counteract the disease state. Thus in some embodiments, the compositions and methods of the present invention permit the treatment of genetic diseases. As used herein, in some embodiments, a disease state is treated by partially or wholly remedying the deficiency or imbalance which causes the disease or makes it more severe. In some embodiments, site-specific integration of nucleic sequences is used to cause mutations or to correct defects.

In some embodiments, haematopoietic stem cells (HSCs), lymphocytes, vascular endothelial cells, respiratory epithelial cells, keratinocytes, skeletal and muscle cardiac cells, satellite cells (e.g., resident muscle stem cells) neurons, and cancer cells are targets for therapeutic gene transfer, either ex vivo or in vivo. See, e.g., A. D. Miller, *Nature* 357, 455-460 (1992); R. C. Mulligan, *Science* 260, 926-932 (1993). These cells and others are suitable target cells for the engineered enveloped vectors and methods of the present invention. In some embodiments, the engineered enveloped vectors of the present invention are used to deliver chimeric antigen receptors (CARs) or T cell receptors (TCRs) to T cells in vivo or ex vivo. In some embodiments, the CARs or TCRs are directed against proteins or peptides or other molecular markers expressed preferentially on the surface, or expressed on the surface, of tumor cells. In some embodiments, the CARs or TCRs direct T cells, or specifically regulatory T cells, to reduce the pathologies of autoimmunity, graft versus host disease, or host versus graft disease. In some embodiments, the engineered enveloped vector of the current invention additionally encodes a promoter specific to a regulatory T cell, for example a FoxP3 promoter, thus specifically expressing the gene cargo in regulatory T cells. In some embodiments, the engineered enveloped vector delivers to a T cell DNA encoding the FoxP3 gene, which drives the phenotype of the T cell to a regulatory T cell phenotype. In some embodiments, the FoxP3 gene is delivered to CD4+ cells in vivo, whereby the CD4+ cells differentiate into regulatory T cells through expression of the FoxP3 protein. In some embodiments, the engineered enveloped vector of this invention is used to deliver a genetic payload directly to a tumor cell, which thereby kills the tumor cell, for example by expression of a protein which induces programmed cell death. In some embodiments, the engineered enveloped vector is specifically directed against skeletal muscle cells, muscle satellite cells, cardiac muscle cells, myocytes, pancreatic cells, liver cells, kidney cells, epithelial cells, stem cells, neurons, dendritic cells, macrophages, regulatory T cells, central memory T cells, CD4+ T cells, CD8+ T cells, memory B cells, plasmablasts, NK cells, osteoblasts, oseteochondrocytes, adipocytes, ova, spermatozoa, melanocytes, kerationcytes, Merkel cells, Langerhans cells, neutrophils, eosinophils, basophils, lung cells, stomach cells, large intestine cells, small intestine cells, brain cells, skin cells, hematopoietic stem cells, CD34+ cells, cancer cells, or any other cell type or subtype of clinical utility. In some embodiments, the target cell tropism molecule comprising the engineered enveloped vector directs cell type-specific gene delivery. In some embodiments, cell type-specific gene delivery is critical for clinical efficacy since delivering the gene to certain cells would be a safety risk, for example, risk of genotoxicity. In some embodiments, cell type-specific gene delivery is critical for efficacy because more specific on-target binding reduces required efficacious dose, and the dose of the engineered enveloped vector is limited by toxicities such as liver toxicity. In some embodiments, the cell type-specificity of gene delivery is further augmented by a retrovirus comprising a DNA gene payload which additionally comprises tissue or cell type specific regulatory elements such as enhancers or promoters. In some embodiments said regulatory elements are synthetic sequences, whereas in some embodiments said regulatory elements are endogenous, naturally occurring sequences.

In some embodiments it is desirable to modulate the expression of a gene-regulating molecule in a cell with the lentivirus of the present invention. In this context, the term "modulate" refers to the suppression of expression of a gene when it is over-expressed, or to augmentation of expression when it is under-expressed. In some embodiments, where a cell proliferative disorder is associated with the expression of a gene, nucleic acid sequences that interfere with the expression of a gene at the translational level are used. In some embodiments, the approach utilizes, for example, antisense nucleic acid, ribozymes or triplex agents to block transcription or translation of a specific mRNA, either by masking that mRNA with an antisense nucleic acid or triplex agent, or by cleaving same with a ribozyme.

Antisense nucleic acids are DNA or RNA molecules that are complementary to at least a portion of a specific mRNA molecule (Weintraub, 1990, Sci. Am. 262:40). In the cell, the antisense nucleic acids hybridize to the corresponding mRNA, forming a double-stranded molecule. The antisense nucleic acids interfere with the translation of the mRNA, as the cell will not translate a mRNA that is double-stranded. Antisense oligomers of about 15 nucleotides or more are preferred because such are synthesized easily and are less likely to cause problems than larger molecules when introduced into the target cell. The use of antisense methods to inhibit the in vitro translation of genes is well known in the art (Marcus-Sakura, 1988, Anal. Biochem. 172:289). In some embodiments of the current invention, a retrovirus delivers the antisense nucleic acid, blocking expression of a mutant protein or a dominantly active gene product, such as amyloid precursor protein that accumulates in Alzheimer's disease, or mutated dystrophin. In some embodiments, such compositions and methods are used for the treatment of Huntington's disease, hereditary Parkinsonism and other diseases. In some embodiments, retroviruses are used to deliver antisense nucleic acids for the inhibition of expression of proteins associated with toxicity.

Ribozymes are RNA molecules possessing the ability to specifically cleave other single-stranded RNA in a manner analogous to DNA restriction endonucleases. Through the modification of nucleotide sequences which encode those RNAs, it is possible to engineer molecules that recognize and cleave specific nucleotide sequences in an RNA molecule (Cech, 1988, J. A er. Med Assn. 260:3030). A major advantage of that approach is only mRNAs with particular sequences are inactivated. In some embodiments, the retroviruses of the present invention are used to deliver ribozymes to target cells for gene therapy in clinical applications.

In some embodiments, the lentivirus of the current invention is used in clinical gene therapy to transfer a nucleic acid encoding a biological response modifier. Included in that category are immune-potentiating agents including nucleic acids encoding a number of the cytokines classified as interleukins, for example, interleukins 1 through 12. Also included in that category, although not necessarily working via the same mechanism, are interferons, and in particular, gamma interferon ($\gamma$-IFN), tumor necrosis factor (TNF) and granulocyte-macrophage colony stimulating factor (GM-CSF). In some embodiments, it is desirable to deliver such nucleic acids to bone marrow cells or macrophages to treat inborn enzymatic deficiencies or immune defects. In some embodiments, nucleic acids encoding growth factors, toxic peptides, ligands, receptors or other physiologically important proteins are introduced into specific cells in vivo or ex vivo.

CRISPRs (Clustered Regularly Interspaced Short Palindromic Repeats) evolved in bacteria as an adaptive immune system to defend against viral attack. Upon exposure to a virus, short segments of viral DNA are integrated into the CRISPR locus. RNA is transcribed from a portion of the CRISPR locus that includes the viral sequence. That RNA, which contains sequence complimentary to the viral genome, mediates targeting of a Cas9 protein to a target sequence in the viral genome. The Cas9 protein cleaves and thereby silences the viral target. Recently, the CRISPR/Cas system has been adapted for genome editing in eukaryotic cells. The introduction of site-specific double strand breaks (DSBs) allows for target sequence alteration through one of two endogenous DNA repair mechanisms—either non-homologous end-joining (NHEJ) or homology-directed repair (HDR). The CRISPR/Cas system has also been used for gene regulation including transcription repression and activation without altering the target sequence. Targeted gene regulation based on the CRISPR/Cas system uses an enzymatically inactive Cas9 (also known as a catalytically dead Cas9). In addition to the canonical Cas9 nuclease, additional nucleic acid-guided nucleases have been discovered, including CasX, Cas12a (which includes MAD7), Cas12b, Cas12c, and Cas13. In some embodiments of the current invention, a retrovirus delivers Cas9, CasX, Cas12a (which includes MAD7), Cas12b, Cas12c, or Cas13 to any target cell of therapeutic utility or research method utility.

In preferred embodiments, a guide nucleic acid complexes with a compatible nucleic acid-guided nuclease. In some embodiments, a nucleic acid-guided nuclease is used together with a heterologous guide nucleic acid. In some embodiments, a guide nucleic acid and a heterologous guide nucleic acid originate from two different species. In some embodiments, a guide nucleic acid and a heterologous guide nucleic acid originate from the same species. In some embodiments, a guide nucleic acid and a heterologous guide nucleic acid originate from the same species but does not present in the same cell in nature.

Compatibility of nucleic acid-guided nucleases and guide nucleic acids can be determined by empirical testing. Heterologous guide nucleic acids can come from different bacterial species or be non-naturally occurring, being synthetic or engineered. In some embodiments, the guide nucleic acid is DNA. In some embodiments, the guide nucleic acid is RNA. In some embodiments, the guide nucleic acid comprises both DNA and RNA. In some embodiments, the guide nucleic acid comprises non-naturally occurring nucleotides. In cases where the guide nucleic acid comprises RNA, the RNA guide nucleic acid can be encoded by a DNA sequence.

In some embodiments, a guide nucleic acid comprises one or more polynucleotides. In some embodiments, a guide nucleic acid comprises a guide sequence capable of hybridizing to a target sequence, and a scaffold sequence capable of interacting with or complexing with a nucleic acid-guided nuclease. In some embodiments, a guide sequence and a scaffold sequence are in a single polynucleotide. In some embodiments, a guide sequence and a scaffold sequence are in two or more separate polynucleotides.

A guide nucleic acid can comprise a scaffold sequence. In general, a 'scaffold sequence' includes any sequence that has a sequence to promote formation of a ribonucleoprotein particle (RNP), wherein the RNP comprises a nucleic acid-guided nuclease and a guide nucleic acid. In some embodiments, a scaffold sequence promotes formation of the RNP by having complementarity along the length of two sequence regions within the scaffold sequence, such as one or two sequence regions involved in forming a secondary structure. In some cases, the one or two sequence regions are on the same polynucleotide. In some cases, the one or two sequence regions are on separate polynucleotides. Optimal alignment may be determined by any suitable alignment algorithm, and may further account for secondary structures, such as self-complementarity within either the one or two sequence regions. In some embodiments, the degree of complementarity between the one or two sequence regions along the length of the shorter of the two when optimally aligned is about or more than about 25%, 30%, 40%, 50%, 60%, 70%, 80%, 90%, 95%, 97.5%, 99%, or higher. In some embodiments, at least one of the two sequence regions is about or more than about 5, 6, 7, 8, 9, 10, 11, 12, 13, 14, 15, 16, 17, 18, 19, 20, 25, 30, 40, 50, or more nucleotides in length.

In some embodiments, a scaffold sequence of a guide nucleic acid comprises a secondary structure. A secondary structure can comprise a pseudoknot region. In some cases, binding kinetics of a guide nucleic acid to a nucleic acid-guided nuclease is determined in part by secondary structures within the scaffold sequence. In some cases, binding kinetics of a guide nucleic acid to a nucleic acid-guided nuclease is determined in part by nucleic acid sequence with the scaffold sequence.

In some embodiments, a guide nucleic acid comprises a guide sequence. A guide sequence is a polynucleotide sequence having sufficient complementarity with a target polynucleotide sequence to hybridize with the target sequence and direct sequence-specific binding of a complexed nucleic acid-guided nuclease to the target sequence. The degree of complementarity between a guide sequence and its corresponding target sequence, when optimally aligned using a suitable alignment algorithm, can be about or more than about 50%, 60%, 75%, 80%, 85%, 90%, 95%, 97.5%, 99%, or more. Optimal alignment can be determined with the use of any suitable algorithm for aligning sequences. In some embodiments, a guide sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide sequence is less than about 75, 50, 45, 40, 35, 30, 25, 20 nucleotides in length. In preferred embodiments, the guide sequence is 10-30 nucleotides long. The guide sequence can be 15-20 nucleotides in length. The guide sequence can be 15 nucleotides in length. The guide sequence can be 16 nucleotides in length. The guide sequence can be 17 nucleotides in length. The guide sequence can be 18 nucleotides in length. The guide sequence can be 19 nucleotides in length. The guide sequence can be 20 nucleotides in length.

A guide nucleic acid can be engineered to target a desired target sequence by altering the guide sequence such that the guide sequence is complementary to the target sequence, thereby allowing hybridization between the guide sequence and the target sequence. A guide nucleic acid with an engineered guide sequence can be referred to as an engineered guide nucleic acid. Engineered guide nucleic acids are often non-naturally occurring.

In one aspect, the present disclosure provides a method of modifying a target region of a eukaryotic or prokaryotic genome using a gene editing system provided herein. The method can comprise the steps of (1) contacting a sample comprising the target region with (i) a nucleic acid-guided nuclease and (ii) a guide nucleic acid complexed with the nucleic acid-guided nuclease and (2) allowing the nucleic acid-guided nuclease to modify the target region. In some embodiments, the sample is further contacted with (iii) a homology template configured to bind to the target region. In some embodiments, the sample comprises a eukaryotic cell, a bacterial cell, a plant cell, a mammalian cell or a human cell. In some embodiments, the sample comprises an immune cell. In some embodiments, the immune cell is a B cell or T cell. In some embodiments, one or more vectors encoding one or more components of a gene editing system are introduced into a host cell. In some embodiments, a nucleic acid-guided nuclease and a guide nucleic acid are operably linked to separate regulatory elements on separate vectors. In some embodiments, two or more of the elements expressed from the same or different regulatory elements combined in a single vector are introduced. When several elements are combined in a single vector, the coding sequence of one element may be located on the same or opposite strand of the coding sequence of a second element, and oriented in the same or opposite direction. In some embodiments, a single promoter drives expression of a transcript encoding a nucleic acid-guided nuclease and one or more guide nucleic acids. In some embodiments, a nucleic acid-guided nuclease and one or more guide nucleic acids are operably linked to and expressed from the same promoter. In other embodiments, one or more guide nucleic acids or polynucleotides encoding the one or more guide nucleic acids are introduced into a cell in the in vitro environment already comprising a nucleic acid-guided nuclease or polynucleotide sequence encoding the nucleic acid-guided nuclease.

In some embodiments, the engineered enveloped vector of the current invention is used to deliver gRNAs to a target cell. In some embodiments, the engineered enveloped vector of the current invention is used to deliver nucleic acids encoding both gRNA and Cas9, CasX, Cas12a (which includes MAD7), Cas12b, Cas12c, or Cas13, or any related nuclease, to target cells. In some embodiments, delivery of nucleic acids encoding gRNA and/or nucleases is used to modify target cell genomes for gene therapy using any of the therapeutic methods described herein. In some embodiments, the nuclease is affixed to the membrane of the lentivirus or retrovirus, in protein format, tethered using a chimeric transmembrane domain from another protein, and subsequently released in functional form into the cytoplasm of the target cell.

In some embodiments, the packaging cell line for engineered enveloped vectors is edited to remove expression of HLAs from the cell membrane. In some embodiments, when engineered enveloped vector is produced using such HLA-deficient cell lines, the engineered enveloped vector does not present any peptide:MHC and therefore is less immunogenic when administered in vivo. In some embodiments, the engineered enveloped vector of the current invention has additional proteins embedded in the membrane of the engineered enveloped vector which increase half-life in vivo, for example by reducing immunogenicity, or by "don't eat me" signal such as CD47.

6.10. Nucleic Acids

As used herein, the term "nucleic acids" generally refers to multiple linked nucleotides (i.e., molecules comprising a sugar (e.g., ribose or deoxyribose) linked to an exchangeable organic base, which is either a pyrimidine (e.g., cytosine (C), thymidine (T) or uracil (U)) or a purine (e.g., adenine (A) or guanine (G)). Nucleic acids include DNA such as D-form DNA and L-form DNA and RNA, as well as various modifications thereof. Modifications include base modifications, sugar modifications, and backbone modifications.

It is to be understood that the nucleic acids used in engineered enveloped vectors and methods of the invention may be homogeneous or heterogeneous in nature. As an example, they may be completely DNA in nature or they may be comprised of DNA and non-DNA (e.g., LNA) monomers or sequences. Thus, any combination of nucleic acid elements may be used. The modification may render the nucleic acid more stable and/or less susceptible to degradation under certain conditions. For example, in some instances, the nucleic acids are nuclease-resistant. Methods for synthesizing nucleic acids, including automated nucleic acid synthesis, are also known in the art.

The nucleic acids may comprise modifications in their bases. Modified bases include modified cytosines (such as 5-substituted cytosines (e.g., 5-methyl-cytosine, 5-fluoro-cytosine, 5-chloro-cytosine, 5-bromo-cytosine, 5-iodo-cytosine, 5-hydroxy-cytosine, 5-hydroxymethyl-cytosine, 5-difluoromethyl-cytosine, and unsubstituted or substituted 5-alkynyl-cytosine), 6-substituted cytosines, N4-substituted cytosines (e.g., N4-ethyl-cytosine), 5-aza-cytosine, 2-mercapto-cytosine, isocytosine, pseudo-isocytosine, cytosine analogs with condensed ring systems (e.g., N,N'-propylene cytosine or phenoxazine), and uracil and its derivatives (e.g., 5-fluoro-uracil, 5-bromo-uracil, 5-bromovinyl-uracil, 4-thio-uracil, 5-hydroxy-uracil, 5-propynyl-uracil), modified guanines such as 7 deazaguanine, 7 deaza 7 substituted guanine (such as 7 deaza 7 (C2 C6)alkynylguanine), 7 deaza 8 substituted guanine, hypoxanthine, N2-substituted guanines (e.g. N2-methyl-guanine), 5-amino-3-methyl-3H,6H-thiazolo[4,5-d]pyrimidine-2,7-dione, 2,6 diaminopurine, 2 aminopurine, purine, indole, adenine, substituted adenines (e.g. N6-methyl-adenine, 8-oxo-adenine) 8 substituted guanine (e.g. 8 hydroxyguanine and 8 bromoguanine), and 6 thioguanine. The nucleic acids may comprise universal bases (e.g. 3-nitropyrrole, P-base, 4-methyl-indole, 5-nitro-indole, and K-base) and/or aromatic ring systems (e.g. fluorobenzene, difluorobenzene, benzimidazole or dichloro-benzimidazole, 1-methyl-1H-[1,2,4]triazole-3-carboxylic acid amide). A particular base pair that may be incorporated into the oligonucleotides of the invention is a dZ and dP non-standard nucleobase pair reported by Yang et al. NAR, 2006, 34(21):6095-6101. dZ, the pyrimidine analog, is 6-amino-5-nitro-3-(1'-β-D-2'-deoxyribofuranosyl)-2(1H)-pyridone, and its Watson-Crick complement dP, the purine analog, is 2-amino-8-(1'-β-D-1'-deoxyribofuranosyl)-imidazo[1,2-a]-1,3,5-triazin-4(8H)-one.

6.11. Amino Acid Substitutions

In some embodiments, the amino acid residue variations are conservative amino acid residue substitutions. As used herein, a "conservative amino acid substitution" refers to an amino acid substitution that does not alter the relative charge or size characteristics of the protein in which the amino acid substitution is made. Variants can be prepared according to methods for altering polypeptide sequence known to one of ordinary skill in the art such as are found in references which compile such methods, e.g. Molecular Cloning: A Laboratory Manual, J. Sambrook, et al., eds., Second Edition, Cold Spring Harbor Laboratory Press, Cold Spring Harbor, N.Y., 1989, or Current Protocols in Molecular Biology, F. M. Ausubel, et al., eds., John Wiley & Sons, Inc., New York. Conservative substitutions of amino acids include substitutions made amongst amino acids within the following groups: (a) M, I, L, V; (b) F, Y, W; (c) K, R, H; (d) A, G; (e) S, T; (f) Q, N; and (g) E, D.

The "percent identity" of two amino acid sequences is determined using the algorithm of Karlin and Altschul Proc. Natl. Acad. Sci. USA 87:2264-68, 1990, modified as in Karlin and Altschul Proc. Natl. Acad. Sci. USA 90:5873-77, 1993. Such an algorithm is incorporated into the NBLAST and XBLAST programs (version 2.0) of Altschul, et al. J. Mol. Biol. 215:403-10, 1990. BLAST protein searches can be performed with the XBLAST program, score=50, wordlength=3 to obtain amino acid sequences homologous to the protein molecules of interest. Where gaps exist between two sequences, Gapped BLAST can be utilized as described in Altschul et al., Nucleic Acids Res. 25(17):3389-3402, 1997. When utilizing BLAST and Gapped BLAST programs, the default parameters of the respective programs (e.g., XBLAST and NBLAST) can be used.

6.12. Other Embodiments

All of the features disclosed in this specification may be combined in any combination. Each feature disclosed in this specification may be replaced by an alternative feature serving the same, equivalent, or similar purpose. Thus, unless expressly stated otherwise, each feature disclosed is only an example of a generic series of equivalent or similar features.

From the above description, one skilled in the art can easily ascertain the essential characteristics of the present invention, and without departing from the spirit and scope thereof, can make various changes and modifications of the invention to adapt it to various usages and conditions. Thus, other embodiments are also within the claims.

7. EXAMPLES

7.1. Example 1. Identification and Sequence Analysis of Novel Fusogen Proteins from Sequence Databases Public databases of raw (i.e., unassembled) reads now comprise tens of petabases (petabase=$10^{15}$ bases) and are growing exponentially. Conventional search tools such as BLAST are not practical for searching this data corpus due to the huge computational cost, which would probably exceed the cloud resources available to big pharmaceutical companies. Serratus (Edgar et al., 2022, doi: 10.1038/s41586-021-04332-2) is a biological search engine which is highly optimized for Amazon Web Services infrastructure, enabling alignment of a large set of query sequences (up to a few hundred Mb) against petabase-scale sequence databases in practical time-frames (a few days). See FIG. 4. Serratus was used to search the SRA for novel fusogen pseudotypes using SEQ ID NO: 1 as the query sequence. Serratus output SEQ ID NOs 2-167, which are putative fusogens used for generating engineering novel retroviruses disclosed herein.

Mutant fusogens were made by identifying functional or otherwise critical amino acids using various means, including sequence alignment. One such output is shown in FIG. 21.

This sequence alignment shows that certain amino acids are important by virtue of evolutionary conservation. For example, the transmembrane domain of VSVG has previously been annotated as IASFFFIIGLIIGLFLVLRVGIHLC (SEQ ID NO. 16558). In the sequence alignment, there is considerable divergence among the sequences listed, however, the underlined I and R amino acids are conserved across these widely divergent proteins: IASFFFI̲IG-LIIGLFLVLR̲VGIHLC. These amino acids are likely functional by virtue of sequence conservation. Other conserved or not conserved residues, using sequence alignments of any two or more sequences comprising SEQ ID NOs: 1-167, highlight the functionally important residues in fusogen molecules which widely diverse in sequence.

In another Serratus sequence search, the sequences comprising SEQ ID NOs: 15597-16497 were used in a bulk search query to identify SEQ ID NOs: 8154-15596 from the SRA and other sequence databases. The query sequences and search results are fusogens or envelope proteins for engineering novel retroviruses.

7.2. Example 2. Generating Engineered Enveloped Vectors

Four candidate fusogen pseudotypes (Candidate A: SEQ ID NO.: 84, Candidate B: SEQ ID NO.: 113, Candidate C: SEQ ID NO.: 121, and Candidate D: SEQ ID NO.: 2) were selected from the Serratus output and used for generating an engineered enveloped vector delivering mRuby reporter, with and without scFv directed against CD19, CD3, CD4, and CD8 for cell-type-specific tropism (non-viral membrane-bound protein).

Example plasmids comprising fusogens include: GM.PMD-6510 pTwist CMV BGlobin Chandipura VSV-G (SEQ ID NO.: 8125) which comprises SEQ ID NO.: 113, GM.PMD-6511 pTwist CMV-BGlobin Piry VSV-G (SEQ ID NO.: 8124) which comprises SEQ ID NO: 121, GM.PMD-6509 pTwist CMV-BGlobin ABVV-G (SEQ ID NO.: 8123) which comprises SEQ ID NO.: 84, and GM.PMD-6512 pTwist CMV-BGlobin Rhinolophus VSV-G (SEQ ID NO.: 8122) which comprises SEQ ID NO: 2. Similar constructs are made for any of SEQ ID NO.: 2-167.

Wild type and mutant (K47Q, R354A) VSV-G pseudotyped lentivirus is also made using similar nucleic acid construct designs. Third generation lentivirus is packaged using equimolar amounts of packaging plasmids: pRSV-Rev (Cell Biolabs), pCgpV (Cell Biolabs), pTwist-CMV-pseudotype (Twist Bio) and an mRuby lentiviral expression plasmid (in-house) in Lenti-Pac 293Ta cells (GeneCopoeia).

The anti-CD19, CD3, CD4, and CD8 scFvs are optionally additionally tethered to an extracellular Fc domain and a CD28 transmembrane domain (lacking the intracellular signaling domain). Example plasmids comprising cell tropism scFv include: PMD-6521 pTwist-CMV-aCD19-PDGFR (SEQ ID NO.: 8127) which comprises an anti-CD19 scFv tethered to a PDGFR stalk, PMD-6522 pTwist-CMV-aCD19-Fc-CD28TM (SEQ ID NO.: 8129) which comprises an anti-CD19 scFv tethered to an Fc and a CD28 domain, PMD-6540 pTwist-CMV-ammCD19-Fc-CD28TM (SEQ ID NO.: 8130) which comprises an anti-mouse CD19 scFv tethered to an Fc and CD28 transmembrane domain, PMD-6523 pTwist-CMV-aCD3-PDGFR (SEQ ID NO.: 8131) which comprises an anti-CD3 scFv tethered to a PDGFR domain, PMD-6524 pTwist-CMV-aCD3-Fc-CD28TM (SEQ ID NO.: 8132) which comprises an anti-CD3 scFv tethered to an Fc and CD28 transmembrane domain, PMD-6531 pTwist-CMV-ammCD3-Fc-CD28TM (SEQ ID NO.: 8133) which comprises an anti-mouse CD3 tethered to an Fc and CD28 transmembrane domain, PMD-6536 pTwist-CMV-ahCD4.1-Fc-CD28TM (SEQ ID NO.: 8134) which comprises an anti-CD4 scFv tethered to a CD28 transmembrane domain, PMD-6533 pTwist-CMV-amCD4.1-Fc-CD28TM (SEQ ID NO.: 8135) which comprises an anti-CD4 scFv tethered to an Fc and a CD28 transmembrane domain, PMD-6534 pTwist-CMV-amCD8.1-Fc-CD28TM (SEQ ID NO.: 8136) which comprises an anti-CD8 scFv tethered to an Fc and CD28 transmembrane domain, PMD-6538 pTwist-CMV-ahCD8.1-Fc-CD28TM (SEQ ID NO.: 8137) which comprises an anti-CD8 scFv tethered to an Fc and a CD28 transmembrane domain. Similar constructs are made for antibodies and scFv against any molecular target. Optionally, a functional modulator protein is additionally introduced into the producer cells on a plasmid. Example plasmids include PMD-6520 pTwist-CMV-hsCD80 (SEQ ID NO.: 8138) which comprises CD80, PMD-6024 PSF-CMV-atezoH_1D11ScFv (SEQ ID NO.: 8139) which comprises an scFv derived from the sequence for atezolizumab, PMD-3805 pReceiver EF1α-aA0201-PMEL.4 (SEQ ID NO.: 8140) which is an anti-PMEL TCR. Similar constructs are made for antibodies and scFv against any molecular target, or TCRs against any molecular target, or any protein comprising SEQ ID NOs: 168-8121. Plasmids are transfected into Lenti-Pac 293Ta cells using Lipofectamine 3000 (ThermoFisher) and lentiviral supernatant is harvested at 24 and 48 hours post transfection and pooled. Lentiviral supernatant is centrifuged at 2000×g for 10 minutes to remove cellular debris and filtered through a 45 µm filter. Lentivirus are concentrated using Lenti-X Concentrator (Takara) and pelleted viral particles are resuspended in cell culture media for about 20× concentration. Lentivirus titers are determined using viral RNA isolated with the NucleoSpin RNA Virus Kit (Macherey-Nagel) and the Lenti-X qRT-PCR Titration Kit (Takara).

7.3. Example 3. Testing Transduction Efficiency and Specificity of Engineered Enveloped Vectors It is tested whether mutant (K47Q, R354A) VSV-G completely abrogates gene delivery, as reported elsewhere (Dodson et al., 2022 doi: 10.1038/s41592-022-01436-z; Yu et al., 2021 doi: doi.org/10.1101/2021.12.13.472464). HEK-293 cells ae seeded at $2.5 \times 10^4$ cells/cm$^2$ and incubated with a 1:4 dilution of non-concentrated lentiviral particles for 3 days. Mutant (K47Q, R354A) VSV-G containing virus had about 5× lower transduction efficiency than wild type VSV-G virus (15-17% vs 76-78%, respectively) as measured by mRuby expression. Thus, a mutant VSV-G paired with cell-type tropic scFv would likely result in considerable gene delivery to undesired cell types.

Figure 11:
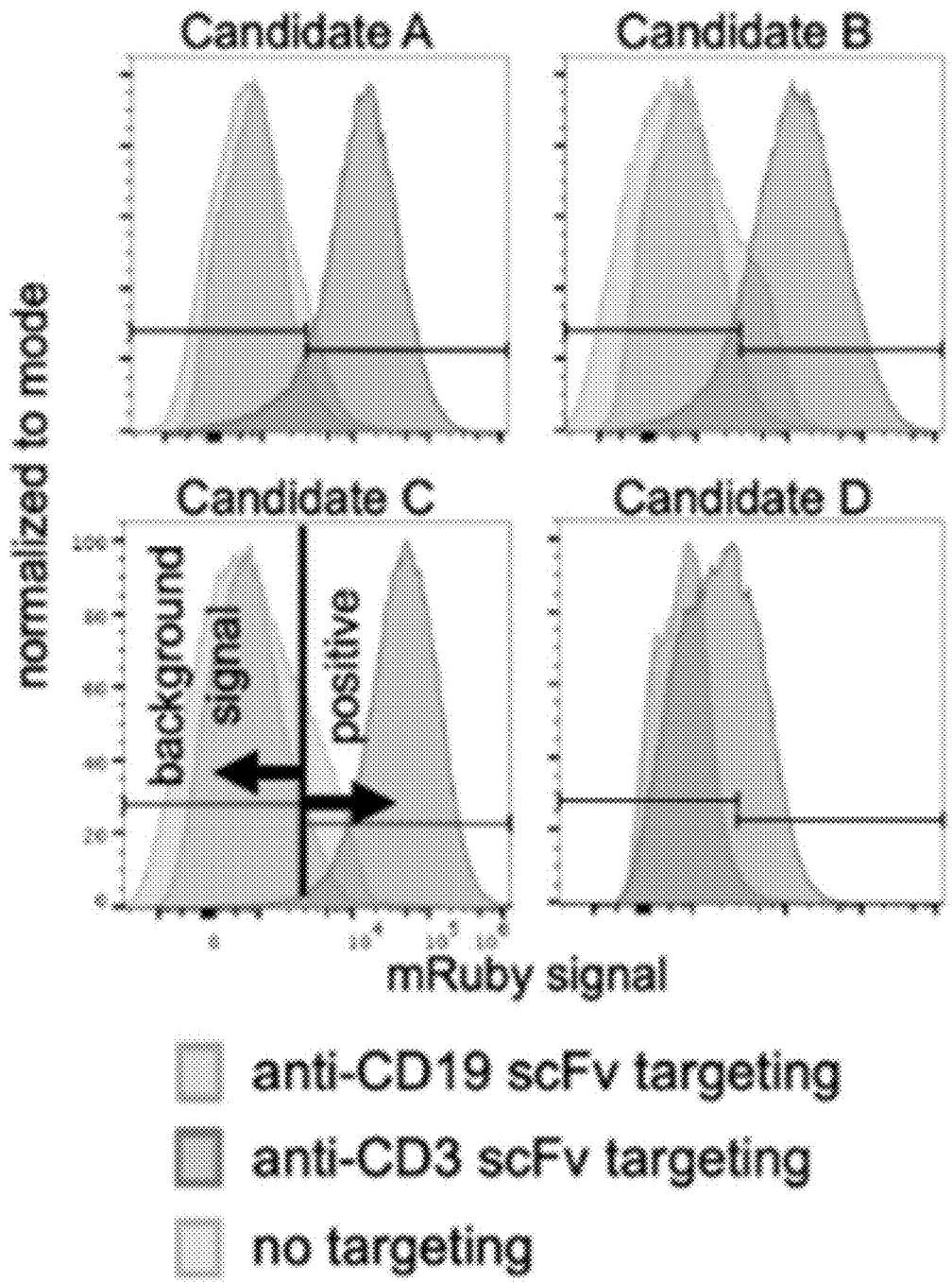

To assess the function of the fusogen pseudotype candidates, purified T cells were seeded for a final cell density of $1 \times 10^6$ cells/mL and incubated with 1 mL of ~20× concentrated anti-CD3 engineered enveloped vector (lentivirus of pseudotype Candidate A: SEQ ID NO: 84, Candidate B: SEQ ID NO: 113, Candidate C: SEQ ID NO.: 121, and Candidate D: SEQ ID NO: 2) for 2 days. Lentiviral transduction was measured by flow cytometry on a CytoFLEX LX (Beckman Coulter) for mRuby expression in live cells (FIG. 11). All four candidates efficiently delivered mRuby to target T cells, and Candidate C is particularly efficient, achieving >95% positivity for mRuby with minimal background signal in anti-CD19 and no targeting controls.

Figure 12:
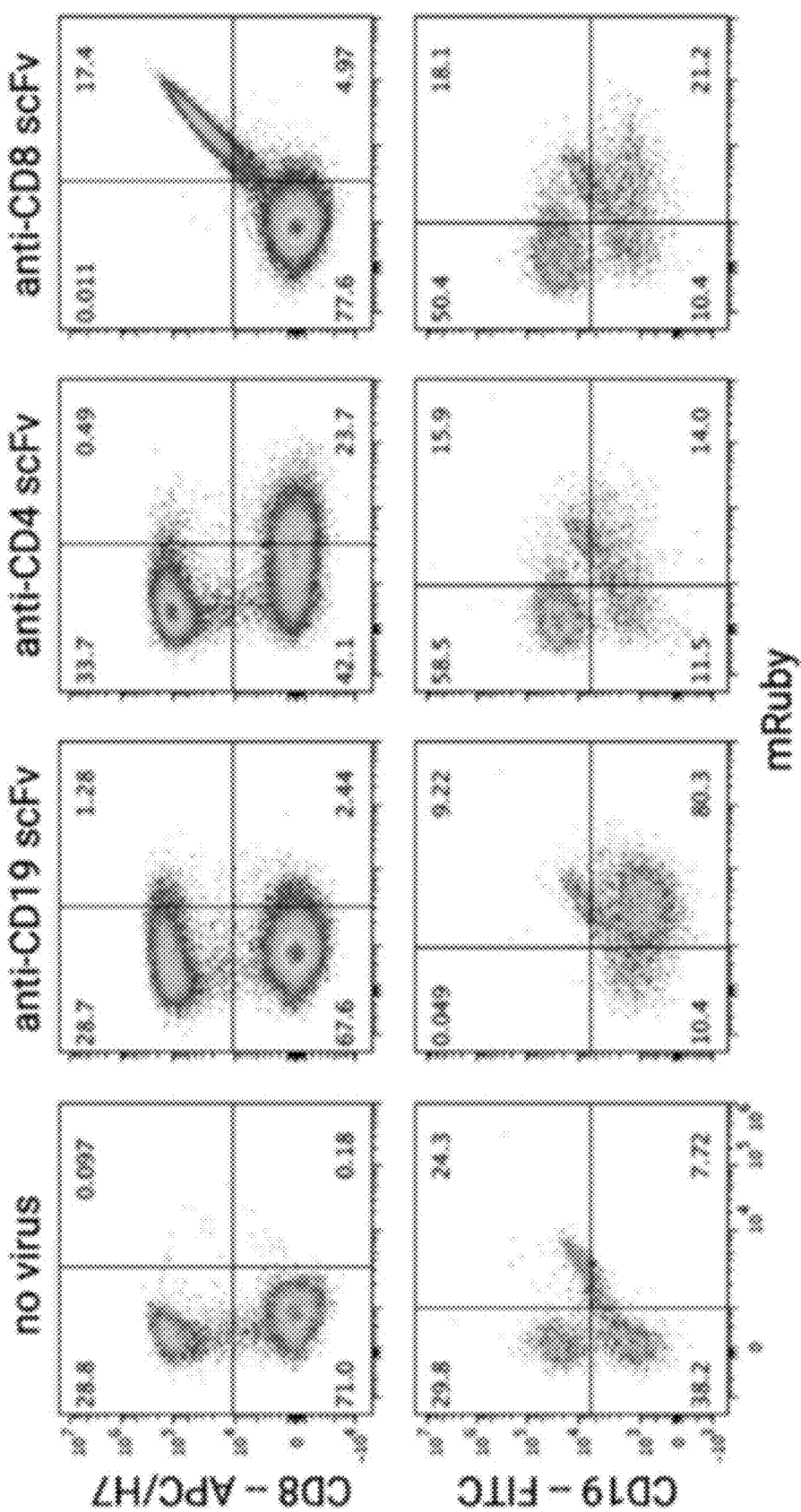

We also assessed the cell-specific tropism of Candidate C (SEQ ID NO.: 121), using lentivirus engineered with anti-human CD19 (SEQ ID NO.: 8130), anti-human CD4 (SEQ ID NO.: 8135), and anti-human CD8 scFv (SEQ ID NO.: 8137). Primary peripheral blood mononuclear cells (PBMCs; not just purified T cells) were seeded for a final cell density of $1 \times 10^6$ cells/mL and incubated with 1 mL of ~20× concentrated LV for 2 days. Lentiviral transduction was measured by flow cytometry on a CytoFLEX LX (Beckman Coulter) for mRuby expression in live cells. Also stained for were antibodies for CD19 and CD8 (FIG. 12). Cell-type tropism was highly specific, for example, nearly all CD19+ cells became mRuby+ in the anti-CD19 scFv lentivirus experiment, and nearly all CD8+ cells became mRuby+ in the anti-CD8 scFv LV experiment.

7.4. Example 4. DNA Payloads for Delivery by Engineered Enveloped Vectors

DNA payloads for retrovirus are formatted as plasmids, for example: PMD-6520 pTwist-CMV-hsCD80 (SEQ ID NO.: 8138) which comprises CD80, PMD-6024 PSF-CMV-atezoH_1D11ScFv (SEQ ID NO.: 8139) which comprises an scFv based on the antibody atezolizumab, PMD-3805 pReceiver_EF1a-aA0201-PMEL.4 (SEQ ID NO.: 8140) which comprises an anti-PMEL TCR, GM.PMD-6437_pET21b_GIG17-nuc-myc (SEQ ID NO.: 8150) which comprises a Cas12a-like nuclease, PMD-6541 pReceiver-EF1a-hsCD19-28z-CAR-GFP (SEQ ID NO: 8151) which comprises an anti-CD19 CAR and a GFP reporter, PMD-6529 pReceiver-EF1a-mmCD19-28z-CAR-GFP (SEQ ID NO.: 8152) which comprises an anti-CD19 CAR and a GFP reporter, PMD-6530 pReceiver-EF1a-mmCD19-28z-CAR-Foxp3 (SEQ ID NO.: 8153) which comprises an anti-CD19 CAR and a FoxP3 gene. Similar constructs are made for antibodies and scFv against any molecular target, or TCRs against any molecular target, or any protein comprising SEQ ID NOs: 168-8121, or any reporter or cell selection marker, or any nuclease for genome editing, or any gRNA for genome editing.

Figure 13:
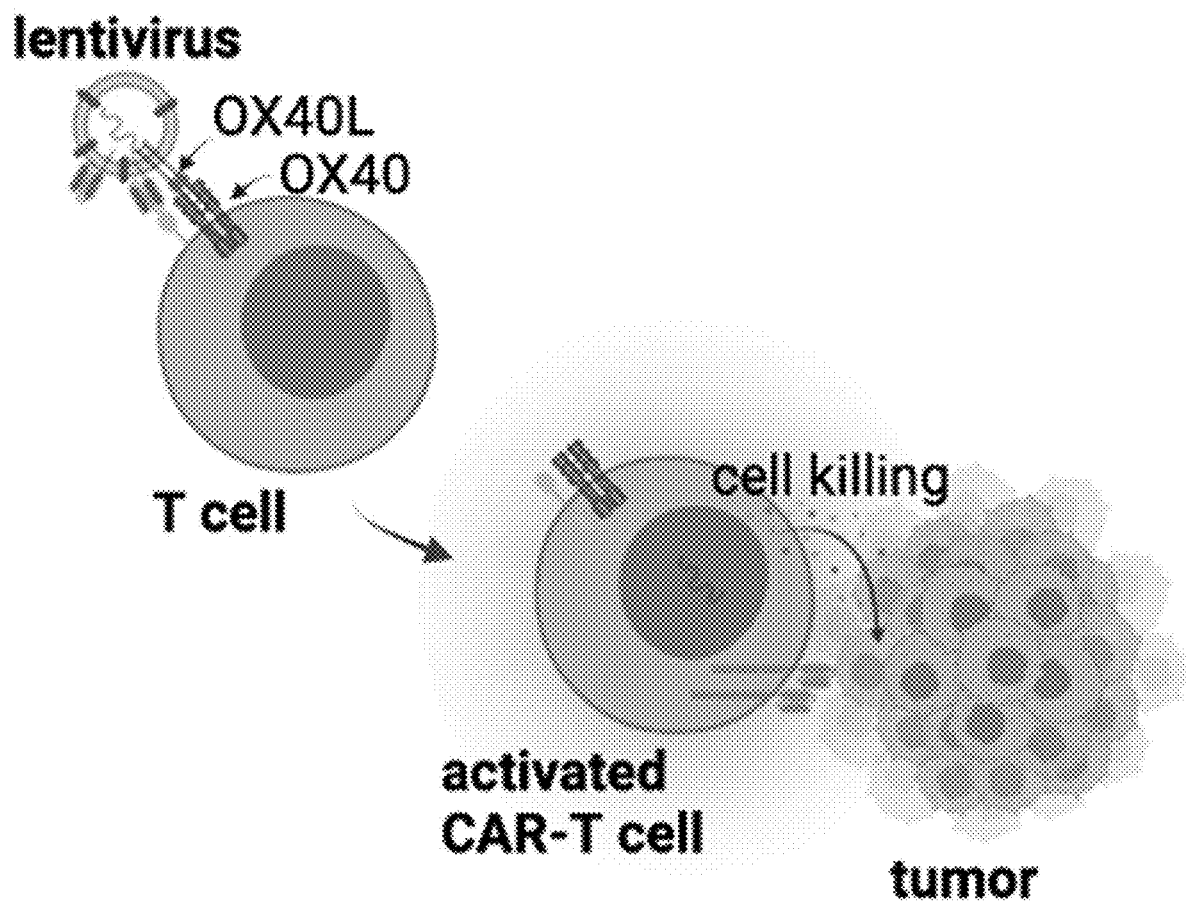
FIG. 13 depicts how a cell modulating signal embedded in the engineered enveloped vector can be used therapeutically to induce activation of a T cell, while simultaneously delivering a gene which drives expression of a CAR. The activated, CAR-expressing T cell is efficient at killing tumor cell.
Figure 14:
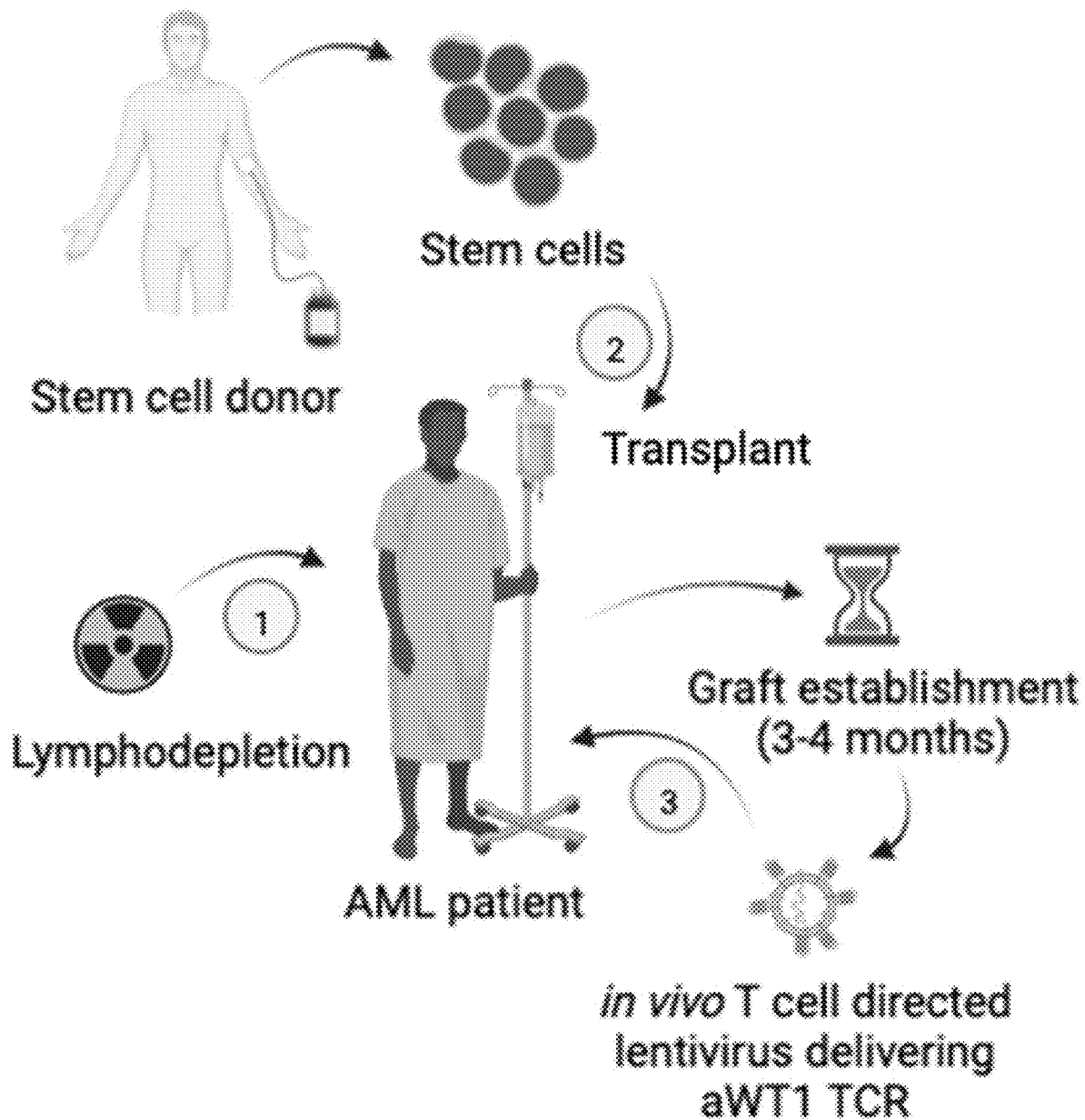
FIG. 14 depicts a patient treatment regimen for AML, using an engineered enveloped vector which delivers an anti-WT1 TCR to T cells in vivo.

In one example, a lentivirus is engineered to express lentivirus-embedded OX40L and deliver an anti-tumor CAR, or anti-tumor TCR, using the methods described above. The lentivirus is delivered in vivo or ex vivo to T cells. The T cell is activated by the OX40L via binding to OX40 on the T cell surface, and the activated T cell is more efficient at killing tumors via the CAR or TCR for having been activated (FIG. 13). In another example, similar methods are used for delivering anti-tumor TCRs (for example, anti-WT1 TCRs) to patients with AML (FIG. 14), with the benefit that there is no requirement for lymphodepletion prior to administering the lentivirus, which is usually required in cell therapy. In another example, similar methods are used for delivering CARs is directed against CD123 (SEQ ID NO.: 16504), CD19 (SEQ ID NO.: 16506), CD20 (SEQ ID NO.: 16505), or GPRC5D (SEQ ID NOs 16507, 16508, 16509), for the treatment of cancer.

Figure 15:
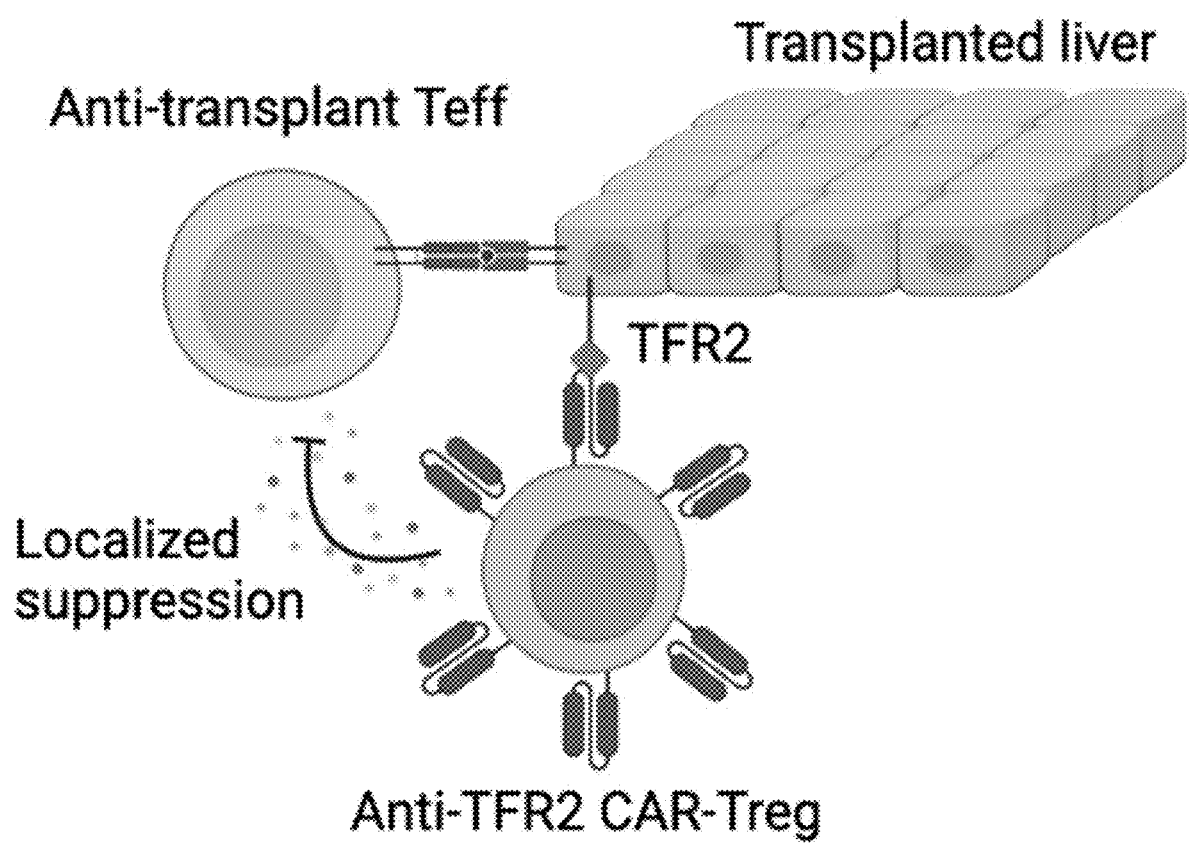
FIG. 15 depicts how an anti-TFR2 CAR can be introduced into a Treg, traffic toward a transplanted liver (because TFR2 is highly expressed on liver cells), and suppress host-versus-graft liver transplant killing by Teff (effector T cells).
Figure 16:
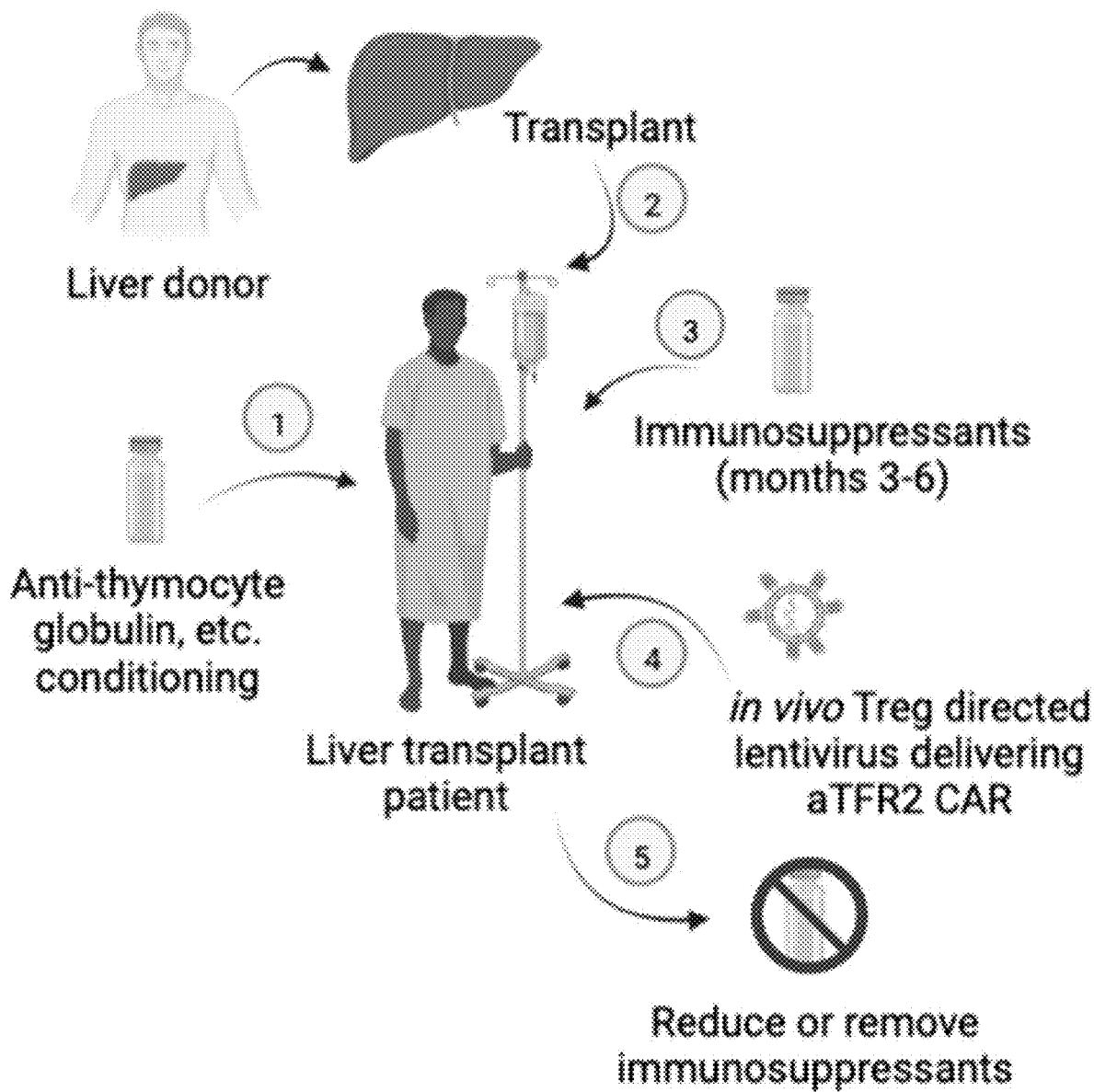
FIG. 16 depicts a patient treatment regimen for liver transplant, using a lentiviral or retroviral particle which delivers anti-TFR2 CAR to Tregs in vivo, thereby reducing or removing the need for the patient to remain on conventional immune suppression drugs.

In another example, a lentivirus is engineered using the methods above to deliver an anti-TFR2 CAR to Tregs, either through tropism directed against Tregs or delivery of the CAR under the control of a FoxP3 promoter or delivery of FoxP3 genes to the target cells (thereby inducing the Treg phenotype). The anti-TFR2 directs the Tregs toward the liver of a patient, for example, a liver transplant patient, and secretes signals such as cytokines to suppress anti-transplant effector T cells (Teff) (FIG. 15). This mechanism is used to reduce or remove immunosuppression after liver transplant, without the need for lymphodepletion or conventional cell therapy (FIG. 16).

7.5. Example 5. Delivery of Genome Engineering Enzymes and Associated Nucleic Acids for Gene Therapy β-hemoglobinopathies are the most common monogenic disorders worldwide. These genetic disorders affect the normal production of adult hemoglobin due to mutations in the (3-globin gene. The two most common diseases are: i) 0-thalassemia, which is characterized by low or absent (3-globin production, and ii) sickle cell disease (SCD), in which a mutant form of 0-globin is produced that results in red blood cells (RBCs) shaped like "sickles" rather than the normal disc shape.

Ex vivo gene therapies for 0-thalassemia and SCD remove hematopoietic stem cells (HSCs) from patients, edit the HSCs with CRISPR/Cas ribonucleoproteins (RNPs), and infuse the edited cells back into patients, with the goal of long-term production of healthy erythrocytes. Exa-cel from Vertex and CRISPR Therapeutics knocks out the B cell lymphoma protein 11A (BCL11A) gene, which normally suppresses production of fetal hemoglobin (HbF). Exa-cel has achieved functional cures in 31/31 of SCD patients for 12 consecutive months. Unfortunately, ex vivo cell therapy can be administered only at a handful of cell therapy centers, limiting access, and infertility is likely due to busulfan myeloablation.

In vivo gene therapies are more accessible because they can be administered at most hospitals, and they do not require myeloablation with busulfan. Adenovirus has been used in preclinical models for in vivo gene therapy of SCD to knock in β-globin (Li et al., 2021, doi.org/10.1016/j.omtm.2021.12.003), but such methods are complicated by widespread human seropositivity against adenovirus. Lipid nanoparticles (LNPs) and adeno-associated virus (AAV) could be used to deliver CRISPR/Cas machinery for knock-out of BCL11A, but are not cell-type specific and could not additionally knock in of β-globin due to payload limitations. Conventional lentivirus is generally not immunogenic on first dose, and delivers larger payloads than LNPs and AAVs. However, conventional lentivirus lacks cell type specificity, so investigators have attempted to engineer HSC-tropic lentivectors comprising membrane bound human stem cell factor (hSCF), which binds to CD117 on HSCs (Froelich et al., 2009, DOI: 10.3109/08923970903420582).

An in vivo delivery vector using an engineered lentivirus comprising CRISPR/Cas9 RNP, further comprising the guide RNA. SEQ ID NO: 16520 is generated in HEK293 lentiviral packaging cells. This gRNA has been shown to have the ability to knockout BCL11A by abrogating its enhancer element in vivo and in vitro. See US Patent Application Number 20190201553, incorporated herein by reference, related to a description of the gRNA. The lentiviral particle comprises protein derivates generated from the plasmid SEQ ID NO.: 16510, which contains HIV-1 gag fused to SpCas9 with a 3xNES and proteolytic cleavage site between them. The lentiviral vector additionally includes an envelope protein with specific and efficient delivery to HSCs, for example an envelope protein of any of SEQ ID NOs: 1-167 or SEQ ID NOs: 8154-16497. For additional HSC targeting, a plasmid expressing anti-CD117 antibody (SEQ ID NO: 16511) and/or a plasmid expressing hSCF is added to the packaging cells. See FIG. 17.

To test the HSC-tropic, BCL11A-editing lentiviral vectors, mobilized human peripheral blood CD34+ cells from human donors 1-3 are cultured in serum free StemSpan Medium with CD34+ expansion supplement for two days. 100,000 cells are washed and transduced using the engineered lentivector. Cells are allowed to recover for 2-3 days before being switched to an erythroid differentiation medium (IMDM+Glutamax supplemented with 5% human serum, 10 ug/ml insulin, 20 ng/ml SCF, 5 ng/ml IL-3, 3 U/ml EPO, 1 uM dexamethasone, 1 uM β-estradiol, 330 ug/ml holo-transferrin and 2 U/ml heparin). The percentage of insertions/deletions ("indels") is then determined for the transduced cells using high throughput sequencing (Illumina). After differentiating these cells for 12 days in erythroid differentiation medium, RNA is collected to assess hemoglobin levels by quantitative real-time-PCR.

Single erythroid progenitors are generated using flow cytometry one day later and cultured in the erythroid differentiation medium to expand and grow as colonies. Each colony is split and collected 12 days post-sorting for DNA and RNA analysis. The sister colonies are collected 15 days post-sorting for the analysis of hemoglobin proteins. Globin expression (ratio of γ/18sRNA or ratio of γ/α) is determined by quantitative real-time PCR and compared for each of the edited erythroid colonies.

Lentiviral vectors comprising CRISPR/Cas RNPs are also used for engineering muscle satellite cells to correct inherited genetic disorders such as DMD. An in vivo delivery vector using an engineered lentivirus comprising CRISPR/Cas9 RNP, further comprising dual guide RNAs designed to correct DMD (Xiang et al., 2021; doi.org/10.1016/j.omtn.2021.03.005; incorporated in its entirety by reference) is generated in HEK293 lentiviral packaging cells. The lentiviral particle comprises protein derivatives generated from the plasmid SEQ ID NO:16510, which contains HIV-1 gag fused to SpCas9 with a 3xNES and proteolytic cleavage site between them. The lentiviral vector additionally includes an envelope protein with specific and efficient delivery to satellite muscle cells, for example any of SEQ ID NOs: 1-167 or SEQ ID NOs: 8154-16497. For additional HSC targeting, a plasmid expressing anti-CD117 antibody (SEQ ID NO: 16511) is added to the packaging cells.

The one or more DNA endonucleases can be a Cas1, Cas1B, Cas2, Cas3, Cas4, Cas5, Cas6, Cas7, Cas8, Cas9 (also known as Csn1 and Csx12), Cas100, Csy1, Csy2, Csy3, Cse1, Cse2, Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, or Cpf1 endonuclease; a homolog thereof, a recombination of the naturally occurring molecule thereof, codon-optimized thereof, or modified versions thereof, and combinations thereof.

7.6. Example 6. Testing Transduction Efficiency and Specificity of Engineered Enveloped Vectors Nine candidate fusogen pseudotypes/envelope proteins were selected from the Serratus output. Clustalw was used to make a multiple sequence alignment of the nine proteins versus VSV-G. Pairwise sequence similarity was as low as 25% and as high as 85%, indicating a broad variety of envelope protein sequences (FIG. 18). This set of envelope proteins was formatted and synthesized into packaging plasmids (SEQ ID NOs: 16522-16530) and 3rd generation lentivirus was made, delivering GFP reporter transgene, with and without scFv directed against CD19, CD3, CD4, and CD8 for cell-type-specific tropism (non-viral membrane-bound protein). The scFvs comprised the following sequences: CD19 (SEQ ID NO.: 8130), anti-human CD4 (SEQ ID NO.: 8135), and anti-human CD8 scFv (SEQ ID NO.: 8137), and an anti-CD3 antibody (SEQ ID NO.: 8133). VSV-G (SEQ ID NO.: 16521) packaging plasmids were also used. In sum, 50 lentiviral vectors were generated (10 envelope proteins×five targeting modalities=50 lentiviral vectors). The vectors were used to transduce human PBMC samples, and after 72 hours GFP signal was measured on a flow cytometer for B cells (CD19+CD20+) and T cells (markers: CD3, CD4, CD8, TCR). For each lentivector, sensitivity was calculated using the equation Sensitivity=True Positive/(True Positive+False Negative) (FIG. 19). For each lentivector, specificity was calculated using the equation Specificity=True Negative/(True Negative+False Positive) (FIG. 20). The ideal lentivector will achieve high sensitivity and specificity. The data show that the various combinations of targeting scFv and viral envelope protein have a variety of sensitivities and specificities, with some sensitivities exceeding 80% and some specificities exceeding 99%.

8. EQUIVALENTS

While several inventive embodiments have been described and illustrated herein, those of ordinary skill in the art will readily envision a variety of other means and/or structures for performing the function and/or obtaining the results and/or one or more of the advantages described herein, and each of such variations and/or modifications is deemed to be within the scope of the inventive embodiments described herein. More generally, those skilled in the art will readily appreciate that all parameters, dimensions, materials, and configurations described herein are meant to be exemplary and that the actual parameters, dimensions, materials, and/or configurations will depend upon the specific application or applications for which the inventive teachings is/are used. Those skilled in the art will recognize, or be able to ascertain using no more than routine experimentation, many equivalents to the specific inventive embodiments described herein. It is, therefore, to be understood that the foregoing embodiments are presented by way of example only and that, within the scope of the appended claims and equivalents thereto, inventive embodiments may be practiced otherwise than as specifically described and claimed. Inventive embodiments of the present disclosure are directed to each individual feature, system, article, material, kit, and/or method described herein. In addition, any combination of two or more such features, systems, articles, materials, kits, and/or methods, if such features, systems, articles, materials, kits, and/or methods are not mutually inconsistent, is included within the inventive scope of the present disclosure.

All definitions, as defined and used herein, should be understood to control over dictionary definitions, definitions in documents incorporated by reference, and/or ordinary meanings of the defined terms.

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

The phrase "and/or," as used herein in the specification and in the claims, should be understood to mean "either or both" of the elements so conjoined, i.e., elements that are conjunctively present in some cases and disjunctively present in other cases. Multiple elements listed with "and/or" should be construed in the same fashion, i.e., "one or more" of the elements so conjoined. Other elements may optionally be present other than the elements specifically identified by the "and/or" clause, whether related or unrelated to those elements specifically identified. Thus, as a non-limiting example, a reference to "A and/or B", when used in conjunction with open-ended language such as "comprising" can refer, in one embodiment, to A only (optionally including elements other than B); in another embodiment, to B only (optionally including elements other than A); in yet another embodiment, to both A and B (optionally including other elements); etc.

As used herein in the specification and in the claims, "or" should be understood to have the same meaning as "and/or" as defined above. For example, when separating items in a list, "or" or "and/or" shall be interpreted as being inclusive, i.e., the inclusion of at least one, but also including more than one, of a number or list of elements, and, optionally, additional unlisted items. Only terms clearly indicated to the contrary, such as "only one of" or "exactly one of" or, when used in the claims, "consisting of" will refer to the inclusion of exactly one element of a number or list of elements. In general, the term "or" as used herein shall only be interpreted as indicating exclusive alternatives (i.e. "one or the other but not both") when preceded by terms of exclusivity, such as "either," "one of" "only one of," or "exactly one of" "Consisting essentially of," when used in the claims, shall have its ordinary meaning as used in the field of patent law.

As used herein in the specification and in the claims, the phrase "at least one," in reference to a list of one or more elements, should be understood to mean at least one element selected from any one or more of the elements in the list of elements, but not necessarily including at least one of each and every element specifically listed within the list of elements and not excluding any combinations of elements in the list of elements. This definition also allows that elements may optionally be present other than the elements specifically identified within the list of elements to which the phrase "at least one" refers, whether related or unrelated to those elements specifically identified. Thus, as a non-limiting example, "at least one of A and B" (or, equivalently, "at least one of A or B," or, equivalently "at least one of A and/or B") can refer, in one embodiment, to at least one, optionally including more than one, A, with no B present (and optionally including elements other than B); in another embodiment, to at least one, optionally including more than one, B, with no A present (and optionally including elements other than A); in yet another embodiment, to at least one, optionally including more than one, A, and at least one, optionally including more than one, B (and optionally including other elements); etc.

It should also be understood that, unless clearly indicated to the contrary, in any methods claimed herein that include more than one step or act, the order of the steps or acts of the method is not necessarily limited to the order in which the steps or acts of the method are recited.

SEQUENCE LISTING (16558 sequences)

SEQ ID NO: 1 - protein, 511 aa, unidentified
MKCLLYLAFLFIGVNCKFTIVFPHNQKGTWKNVPSNYHYCPSSSDLNWHNDLIGTALQVKMPKSHKAIQADGWMCHASKWVTTCDFRWYGPKYITHSIRSFTPSVEQCRESIEQTKQGTWLNPGFPPQSCGYATVTDAEAVIVQVTPHHVLVDEYTGEWVDSQFINGKCSNDICPTVHNSTTWHSDYKVKGLCDSNLISMDITFFSEDGELSSLGKEGTGFRSNHFAYETGDKACKMQYCKHWGVRLPSGVWFEMADKDLFAAARFPECPEGSSISAPSQTSVDVSLIQDVERILDYSLCQETWSKIGAGLPISPVDLSYLAPKNPGTGPAFTIINGTLKYFETRYIRVDIAAPILSKMVGMISGTTTERELWDDWAPYEDVEIGPNGVLRTSSGYKFPLYMIGHGMLDSDLHLSSKAQVFEHPHIQDAASQLPDDETLFFGDTGLSKNPIELVEGWFSGWKSSIASFFFIIGLIIGLFLVLRVGIYLCIKLKHTKKRQIYTDIEMNRLGK

SEQ ID NO: 2 - protein, 512 aa, unidentified
MWSAVISATIPLVLSVPVILPAGRDGKWNDVPNGFRYCPAVGDEYSYGRAQTTAITLLQPKSLEHEGAEGYLCHVAVYEATCDFRWYGVKYKTQKIRRQIPTDAECQAKQKALMAGRSDWVGFPSFSCNYASVTTEKHLEIVLVPHHVGVDDYLGLYVDPTLQDGSCVTPPCHTLYEDTLWLPKASPKPGGPCDLEFHEHRGIIRYPIPRAGMSMANFQISGPTIPTATLDGACHMGICGKWGIRLRSGVWVGVKERPMLQGMDLYETFMHPCAPNATISAGHFNPGALKMIWDAGRLLGYSLCQKTWDKLDRGDSITPLDLSYLNPVSPGPGLGFLSINGTLKMAKLRFSRVELPEGMIRNYDSNSLNPYQFQWQRWVPHGNVLVGPNGITLNGSTVKFPFFMVGVGRLDSDLTEAESIDLLTHHDIKHSHMLHPVDDRYDWSKSGESGDLIKHIESWFTIPDWIKYCVIIVVCVLLIIVLGCMTLVKLRKRPRPPGRRDPEIPLSSTSFL

SEQ ID NO: 3 - protein, 530 aa, unidentified
MLSQVTLQAFVVMCLIYRAYSSLSIAFPESTKLDWKPVTKNTRYCPMGGEWFLEPGLQEESFLSSTPIGATPSKSDGFLCHAAKWVTTCDFRWYGPKYITHSIHNIKPTRSDCDSALASYKSGTLINPGFPPDSCGYASVTDSEFLVIMITPHHVGVDDYRGHWVDPLFVGGECDQSYCDTIHNSSVWIPADTTKKNICGQSFTPLTVTVAYDKTKDISAGALVFKSKYHSHMEGARTCRLTYCGRTGIKFPNGEWVSLDIKTKIQDKQLLHLFKECPAGTEVRSTLQSDGAQVLTSEIQRLLDYSLCQNTWEKVDRKEPLSPLDLSYLASKSPGKGLAYTVINGTLSFAHTRYVRMWIDGPVLKELKGKRESASGIASDIWTQWFKYGDMEIGPNGLLKTKSGYKFPWHLIGMGIVDNELHELSEANPLDHPQLPHAQSIADDSEEIFFGDTGVSKNPVELVTGWFTSWKESLAAGVVLILTVVLIYGVLRCFPVLCMPCRKTKWKKEVERSDSFEMRIFKPNNMRARV

SEQ ID NO: 4 - protein, 507 aa, unidentified
MYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 5 - protein, 530 aa, unidentified
MLSQVTFQLLVVVCLIYRAYSSLSIAFPESTKLDWKPVTKNTRYCPMGGEWFLEPGLQEESFPSSTPIGATPSKSDGFLCHAAKWVTTCDFRWYGPKYITHSIHNIKPTRSDCDSALASYKSGTLINPGFPPDSCGYASVTDSEFLVIMITPHHVGVDDYRGHWVDPLFVGGECDQSYCDTIHNSSVWIPADTKKKNICGQSFTPLTVTVAYDKTKDISAGALVFKSKYHSHMEGARTCRLTYCGRTGIKFPNGEWVSLDVKTKIQEKQLLPLFKECPAGTEVRSTLQSDGAQVLTSEIQRLLDYSLCQNTWEKVDRKEPLSPLDLSYLASKSPGKGLAYTVINGTLSFAHTRYVRMWIDGPVLKELKGKRESASGIASDIWTQWFKYGDMEIGPNGLLKTKSGYKFPWHLIGMGIVDNELHELSEANPLDHPQLPHAQSIADDSEEIFFGDTGVSKNPVELVTGWFTSWKESLAAGVVLILTVVLIYGVLRCFPVLCIPCKKPKWKKGVERSDSFEMRIFKPNNMRARV

SEQ ID NO: 6 - protein, 530 aa, unidentified
MLSQVTLQAFVVMCLIYRAYSSLSIAFPESTKLDWKPVTKNTRYCPMGGEWFLEPGLQEESFLSSTPIGATPSKSDGFLCHAAKWVTTCDFRWYGPKYITHSIHNIKPTRSDCDSALASYKSGTLINPGFPPDSCGYASVTDSEFLVIMITPHHVGVDDYRGHWVDPLFVGGECDQSYCDTIHNSSVWIPADTTKKNICGQSFTPLTVTVAYDKTKDISAGALVFKSKYHSHMEGARTCRLTYCGRTGIKFPNGEWVSLDIKTKIQDKQLLPLFKECPAGTEVRSTLQSDGAQVLTSEIQRLLDYSLCQNTWEKVDRKEPLSPLDLSYLASKSPGKGLAYTVINGTLSFAHTRYVRMWIDGPVLKELKGKRESASGIASDIWTQWFKYGDMEIGPNGLLKTKSGYKFPWHLIGMGIVDNELHELSEANPLDHPQLPHAQSIADDSEEIFFGDTGVSKNPVELVTGWFTSWKESLAAGVVLILTVVLIYGVLRCFPVLCMPCRKTKWKKEVERSDSFEMRIFKPNNMRARV

SEQ ID NO: 7 - protein, 750 aa, unidentified
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGKMVSKGEELFTGVVPILVELDGDVNGHKFSVSGEGEGDATYGKLTLKFICTTGKLPVPWPTLVTTLTYGVQCFSRYPDHMKQHDFFKSAMPEGYVQERTIFFKDDGNYKTRAEVKFEGDTLVNRIELKGIDFKEDGNILGHKLEYNYNSHNVYIMADKQKNGIKVNFKIRHNIEDGSVQLADHYQQNTPIGDGPVLLPDNHYLSTQSALSKDPNEKRDHMVLLEFVTAAGITLGMDELYK

SEQ ID NO: 8 - protein, 521 aa, unidentified
MESLLKAICVLLLIHCSRCDLPIVFPDQKELLWNPVLKTNRYCPQTREIAPLDKPKTLKITTGVPVRSPKEKIEGYLCHSGKWVTTCDYRWYGAKYVTHSIHHLKPTDQMCRDAISQYNGGTLLNPGFPPEVCGYASVTDSELIITLITPHTVGVDDYRGLWIDPSFPNGECNSIVCETIHNSTKWVSKGEMPTDICQQTFTTIKMDVSYPSDTTSQGSLLSFHSPYHPHISGKDICKMSYCGSNGLRLPNGEWFSIINTSKIGNKNLIDFFSPCKAGVEVRSTLQSEGSQTIAWETQRMLDYALCQNTWDKFERGEPLSPLDLNYLAPRVPGKGMAYTIINNTLHSSHAVYRRVWIEGPIIGEMKGKIESATGVAKEIWAQWFEFGQNKIGPNGVIKTNDGIKFPLYAIGTGLIDQDIHELSEVSPMDHPHLVHAKKYVSEDDEIYFGDTGVSHNPVEIFSGWFTNWKEGLMKFSILVLSILIFYVVIRLVMCIPLKCKKERKPRLEFELQPREWEYSRA

SEQ ID NO: 9 - protein, 512 aa, unidentified
MNFLLLTFIVLPLCSHAKFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 10 - protein, 511 aa, unidentified
MKCLLYLAFLFIGVNCKFTIVFPHNRKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCNSNLISMDITFFSEDGELSSLGKEGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLFLVLRVGIYLCIKLKHTKKRQIYTDIEMNRLGK

SEQ ID NO: 11 - protein, 530 aa, unidentified
MTSSVTISVVLLISFITPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYVKTKEIAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 12 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKNPVELVEGWFSGWRSSIMGVVAVIIGFVILIFLIILIGVLSSLFRPKRRPIYNTDVQMAHFR

SEQ ID NO: 13 - protein, 530 aa, unidentified
MTSSVTISVILLISFITPSYSSLSIAFPENTKLDWKPVTRNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHEVSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 14 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYIGPKNPGVGPVFTVINGSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGVSKNPVELVEGWFSGWRSSIMGVVAVIIGFVILIFLIRLIGVLSSLFRPKRRPIYKSDVEMAHFR

SEQ ID NO: 15 - protein, 511 aa, unidentified
MKCLLYLAFLFIGVNCKFTIVFPYNQKGNWKNVPSNYHYCPSSSDLNWHNDLIGTALQVKMPKSHKAIQADGWMCHASKWVTTCDFRWYGPKYITHSIRSFTPSVEQCKESIEQTRQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGGKACKMQYCKRWGVRLPSGVWFQMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFFFIIGLIIGLFLVLRVGIYLCIKLKHTKKRQIYTDIEMNRLGK

SEQ ID NO: 16 - protein, 503 aa, unidentified
SIMTVLFVSFTLIAIVTGSDVLPIQLIGELGGINDHHISCDHTFFGDSIHDLRTYKFESIDPVPNHEGVEGYMCIKHKHVLRCKEGFLGGQTLTRHSEVVPISPSECYDAVDKWKIGQLPDEDVIDPDCGWWTTNDRVKMLIKVIPKNVQFDMYNARAVDKIFLNGICDNLVCETVYKGVLWMTPNEMKKNCPTTRKSVVEIKVGFPYSLDNLVIHSNYVPNVSFRGACRLFRFCDTVGYRLRTGHFVKWFSPMSHEMNVTLFSLPICDYPNTVITDTQDVKLNDVELDVTQILYRDRCLSTSYKIQDNQTVSRYDISYFQPQVPVTAPGLIPINGSLRAGLFKYAEVSDIRIKCLNCDSCEISGKTLDGPVVLPSDVMHCNCSNFVGCDLPNGLRVYNTSIFNPLRDITNLIQEEIVRARLNLNYFEHPILSEGSQVELVGSSTEINSHKGTFSFSFGGMVKRLYVVLIFGLAFGFTVLVVYICIACRRRSHKRMTIRQSEE

SEQ ID NO: 17 - protein, 485 aa, unidentified
VSEHDLNCVSPIPIMAGVAQTELMVTTGTPAVREVKESGYLCTKEVWTSICSKNFFGMEQLTFQINRVAISDSECTDVVDTFVHGKQSQPYKPDYDCYWMSEQSVSKTFSFATRHDVFMNHYHMTYQDSIFPSHECRTPICETAYENIKWMSESFKSPTCPKEYTIPTRIGINQRESQSNNRGLSGFVENEFIPPSSLSGVCRGLHYCGNDYLITKSGFAFRLTPGNSDPTLSGFFSDIPTCGDRTVIERTDDLNEETSLLQIEEDIRIERCLDVIDKIRSNSTITNRDLHKLTPTFPGVGTGFISESGKIFTQEVKYWAVKDCQAHCDFKSMMCQLKCSGITGNQILEEHPCPRSTVIKGMRYCVWYNGILMNKGSIIFPKVGIQDRELQEWYLTHSRIQMDQHIFLNSTGKEIIGKGFDNLMRLGKSEWKGLLSWGSDMWYYILLIVGVLVIIFIAIMCCPVHLLSCKRSSNEPSVFFSVKKQ

SEQ ID NO: 18 - protein, 511 aa, unidentified
MKCLLYLALLFIGVYCKFTTVFPHNKKGDWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSDDICPTVHNSTTWHSDYKVKGLCDSNLISMDITFFSEDGELSSLGKEGTGFRSNYFAYETGDKACKMQYCKHWGVRLPSGVWFEIADKNLFAAAKFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWEDWAPYEDVEIGPNGVLRTSSGYKFPLYMIGHGMLDSDLHLSSKAQVFEHPHIPDATSQLPDDETLFFGDTGLSKNPIELVEGWFSGWKSSIASFFFIIGLIIGLFFVLRIGVYLCIKLKHTNKRQIYTDIEMNRLGK

SEQ ID NO: 19 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRTPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKNPVELVEGWFSGWRSSIMGVVAVIIGFVILIFLIRLIGVLSSLFRPKRRPIYKSDVEMAHFR

SEQ ID NO: 20 - protein, 511 aa, unidentified
MKCLLYLALLFIGVNCKFTIVFPHNQKGNWKNVPSGYHYCPSSSDLNWHNGLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNDICPTVHNSTTWHSDYKVKGLCDANLISMDITFFSEDGELSSLGKEGTGFRSNYFAYETGDKACRMQYCKHWGIRLPSGVWFEMADNDLFAAAKFPECPEGSSISAPSQTSVDVSLIQDVERILDYSLCQETWSKIRTGIPISPVDLSYLAPKNPGTGPAFTIINGTLKYFETRYIRVDIAAPILPRMVGTISGTTTERELWDDWAPYEDVEIGPNGVLKTSSGYKFPLYMIGHGMLDSDLRISSKAQVFEHPHIQDAASQLPDDETLFFGDTGLSKNPIELVEGWFSGWKSSIASFFFIVGLIIGLFLVLRVGIYLCINLRHTKKRKIYTDIEMNRLGK

SEQ ID NO: 21 - protein, 511 aa, unidentified
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 22 - protein, 511 aa, unidentified
MKCLLYLAFLFIGVNCKFTIVFPHNRKGNWKNVPSNYHYCPSSSDLNWHNDLIGTALQVKMPKSHKAIQADGWMCHASKWVTTCDFRWYGPEYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPFEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLFLVLRVGIYLCIKLKHTKKRQIYTDIEMNRLGK

SEQ ID NO: 23 - protein, 511 aa, unidentified
MKCLLYLAFLFIGVNCKFTIVFPHNQKGNWKNVPSNYHYCPSSSDLNWHNDLLGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKKGTGFRSNYFAYETGDKACKMQYCKHWGVRLPSGVWFEMANKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTKERVLWDDWAPYEDVEIGPNGVLRTSSGYKFPLYMIGHGMLDSDLHLSSKAQVFEHPHIQDAASQLPDGETLFFGDTGLSKNPIEFVEGWFSSWKSSIASFFFTIGLIIGLFLVLRVGIYLCIKLKHTKKRQIYTDIEMNRLGK

SEQ ID NO: 24 - protein, 511 aa, unidentified
MKCLLYLAFLFIGVNCKFTIVFPHNRKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMRYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLFLVLRVGIYLCIKLKHTKKRQIYTDIEMNRLGK

SEQ ID NO: 25 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEKPTDYQCLEAIKAYKDGVSFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYLGPKNPGVGPVFTIINGSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGVSKNPVELVEGWFSGWRSSIMGVVAVIIGFVILIFLIRLIGVLSSLFRPKRRPIYKSDVEMAHFR

SEQ ID NO: 26 - protein, 511 aa, unidentified
MKCLLYLAFLFIGVNCKFTIVFPYNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAAAQLPDDETLFFGDTGLSKNPIEFVEGWFSSWKSSIASFFFIIGLIIGLFLVLRVGIYLCIKLKHTKKRQIYTDIEMNRLGK

SEQ ID NO: 27 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKNPVELVEGWFSGWRSSIMGVVAVIIGFVILIFLIRLIGVLSSLFRPKRRPIYKSAVEMAHFR

SEQ ID NO: 28 - protein, 511 aa, unidentified
MKCLLYLALLFIGVYCKFTTVFPHNKKGDWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSDDICPTVHNSTTWHSDYKVKGLCDSNLISMDITFFSEDGELSSLGKEGTGFRSNYFAYETGDKACKMQYCKHWGVRLPSGVWFEMADKNLFAAAKFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWEDWAPYEDVEIGPNGVLRTSSGYKFPLYMIGHGMLDSDLHLSSKAQVFEHPHIPDATSQLPDDETLFFGDTGLSKNPIELVEGWFSGWKSSIASFFFIIGLIIGLFFVLRIGVYLCIKLKHTNKRQIYTDIEMNRLGK

SEQ ID NO: 29 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYITTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKNPVELVEGWFSGWRSSIMGVVAVIIGFVILIFLIRLIGVLSSLFRPKRRPIYKSDVEMAHFR

SEQ ID NO: 30 - protein, 530 aa, unidentified
MTSSVTISVILLISFIAPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 31 - protein, 511 aa, unidentified
MNPAFVLCMLLAGSSWAKFTIVFPQSQKGEWRDVPSNYRYCPSSADQSWHGDLLGVNIRAKIPKAHKAIKADGWMCHAAKWITTCDYRWYGPQYITHSIHSFVPTQAQCEESIKQTKEGVWINPGFPPKNCGYASINDAESVIVQATAHTVMIDEYSGDWLDSQFPTGRCKGTICETIHNSTLWHADYKVTGLCDAALVSTEVTFYSEDGLVTSIGRQNTGYRSNYFPYEKGAGACRMKYCTHDGIRLPSGVWFEMVDKELLDSSQMPECPAGLTITAPTQTSVDVSLILDVERMLDYSLCQETWSKVHNGQPISPVDLGYIAPKNPGAGPAFTIINGTLKYCDTRYLRIDIDGPVLQKMTGKVSGTPTERELWTEWFPYEDVEIGPNGVLRTQEGYKFPLFMIGHGLLDADLQKTSRAEVFHHPQIAEAVKKLPDDETLFFGETGISKNPVELIEGWFSNWRSSVMAVVFAIVSLVLLGLIVRVIVAFRNSCCQRKRKIYNDLEMNQLRK

SEQ ID NO: 32 - protein, 511 aa, unidentified
MKCLLYLAFLFIGVNCKFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 33 - protein, 506 aa, unidentified
MTSLMILSSLFLRLATTSLMLPDMSPISWERTLPEDIHCPTIFKMSSITPDHTPFTGYTVGSPKIPTVPGYWCIQETWITECDFRWYGPKYINKFYFRSRPSSSLCSDFWQSFKQGLPVEKGFPPEECSWNNIFRTRISSTSVTPRDMTYDPYTQSVIDPSLKSGTCSGNICEGSSGLNIWIRLSISSPTCLTFDRISLLIQGFRGKDKTLLYGMDSEVVLPDGSVRIIKTGCNLNLCGSKGVLFPEGLWITVVEHKELRKTIDDLVTCDRGSNVVKSHTGIGHYLHEITWESSIILSMCEDKVETLMRTGKISPRDFSIFTPLHEGPGMLYRVNNQTLESTHVNYKLSELITNPGTSDLIYKQGNSTIHWMSWSETDVKGLQHGGNGIYMANKVWGLFDMQIQSSTLDEFKQIKLTAITLNHMQIEITQNILTQQSVPHWSSPDMEGIPDMREMFSHIKGYLVITSLIILIITISIISIKLLGCWRKGRSRRIKQTDSMAMYGFN

SEQ ID NO: 34 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYITTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKNPVELVEGWFSGWRSSIMGVVAVIIGFVILIFLIRLIGVLSSLFRPKRRPIYKSAVEMAHFR

SEQ ID NO: 35 - protein, 521 aa, unidentified
VLLISFITPLYSYLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEITAGGIVFKSKYHSHMEGARTCRLSYCGRNGIKFPNGEWVSLDVKTRIQEKHLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEPKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 36 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYITTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEPAQTYLKKDDTEEVIYYGDTGISKNPVELVEGWFSGWRSSIMGVVAVIIGFVILIFLIRLIGVLSSLFRPKRRPIYKSDVEMAHFR

SEQ ID NO: 37 - protein, 525 aa, unidentified
DVNTSISSILPNSIIFPQKITGHEEKLSFSNSQLCNYFLDSNLFSSFIKHTTGPQAIEGYSVYHNANQKVVGYFCTKIVKKTTCFKNFFGSETINQKIESRPASVNECFNALDNEENNLVISTEFPPKECSWMKTSTRVNEFVNVHEHAVTYNAYLDSYQDRNFISGICSINHCQTFHSDITWVTKTLPRSTCGSFKYEKFLITHDFTKPGFEINELSTFFSPSVRSTTLKGSCRLKYCGHEGIHTTSGEFVGFNISTLPEKFKKLGVISLPSCGEFHPNISTGGVEVMEENLIQVLNKDANFRACSETLYKIKSGEAITRHDLYKLNPLGPGPAPVFILRPPNTNSNKRELEIILGEYAVFTPFTIQKYFNNNNKKRIGHEKSNIIWNHWSLESEGVWNGPNGVLIINETLLISNYNNIDPILETFQNSKMEIVGAFNPTIDSRRQLIINHVSMNHDNYVNDAEVGDIFPKFKIWHKIILIVSLLIALCLCIWVAFKTSKYIQRRRIPNSRRVDYQVSYMNSSK

SEQ ID NO: 38 - protein, 519 aa, unidentified
MIHILTLHLLLISVSVYYIHGEEIVFPLHVLDNWSPVNVSSIQCPQVIQHLTTNHQSDKIPIEIRKPHSINTISVNGFLCHKVAKITTCDENWLFISSLNHESQPRPIDLNECISRIRQKSKGVFSDESYPLPGCAWNTKNSIENEIIVVTEHRVVYDQYTMSFIDGIFIGGSTKKEYSPTIYSSTMWIRSDHRDLTDCMELNSEAGFIYPHQDKWYIWGETIREQRFDTMCKLKYCNQIGVTSPNGEWITIQLSNPTPTYESIYQKLPYCNDSMLIKTDQSFDNTNTGLNTILGMMLKMRCDDIVNKLLISNRINNIDLSYLTQQIPGLGPVYRIDKGSLLTAPGIYTIIDITSLNTKSNLIGKTLTGHDVLFTEYSKDNNISYGLNGMMMVKSKIIIPLNMYYNHEVHSELIKELKLHTMNHPVFEYIRNQSSEARISYIHSINRTDLPSALIQLTETSAKKLGRWIERVFSSFNFLSIFLVLILTMIILILMFHLIKVIHQSGRKFAKDNHYGCSR

SEQ ID NO: 39 - protein, 531 aa, unidentified
NKYYWILFLCYFQLGSVSSMMAFPIESNNTLIPVLSDKLRCPVGHLHLAPTAEIQHKVILSIPNRPEISSVKGYLCHKYRLITECDYGCLSGKQLRFKTQNVKITEEECKSEISSYLLGNIALLEHPAPLCSWCGVQESVKDLIIVKPHYVKLDPYSSELIDLLFVGGKTLEPSSKTIYDAVYWIAENDHFLDLACPTFVNHTGIIYSIDSDTTANEYSDSHRLWSDRFREKSFKGACKKKFCGLVGVRFGDGEWLKIYYKKEEDFAKDQWYKNLPACSEDQTIRLANPYSTDQHAIDSVLALIFFGKCLDSISKLRNNGKLSPLDISYLAQVYPGYGPYYIMTDQGLMMGTATYQLIKPYNANKISNQIGTTLSNESVTFSDWHKVGNILHGPNRIIKVNGIIRFPDFMGMRSIMEEELTQEVDHAVIRKASAKSLSDTILQSNTEFRHPIDQVNIVNVTSEKLEEMMDGLAPNWHLWVSILLVIPVSLIIICILIKFFSYLKACFISKKERRPRIISQSPRVTEQIEMV

SEQ ID NO: 40 - protein, 491 aa, unidentified
LNLCNGIIIPTDLLSNLSDIHNHQLTCHRGYASLDQSSQTSFKTHSIKPTSIEDHIDGYLCLRKRYFLTCSENFFGVKTISSGFEIVEITPSECYDYVDIWKKDQLDTDNTLLQDCGWMSTNTVTKDLVSIKSKSLPFDSYSVSIRDAILLGGSCTAQNCKTVYNGMLWVTDRPLNFGCPKTEFTQMKVVIDKTRDSEKIILSSEYIPDVSLDGACKDFNYCGHMGFLLATGHFVLYTKDLPSSVLHYIDRSEKCDQSRSVVNNNFHSVVSNSILNVEKLFFLEKCEEVLDKITTNQEVSLFELGFLSPHIGGNGYGFQAINGKIYAGKYTYYNADSVLVSCHSCDRCDIKIIRDGSSFYVDKSVLYCDCRNFSGCNLPNGLKAYKNELYSPLLELNDIIYESYINEKLEAAYIPHVEKESSNSISIIGDHSHQSSHSSNMINIIQSGYEKFWVKLKLAIIYGILSSLLSLGLYIAYKIWKARRERATNSD

SEQ ID NO: 41 - protein, 464 aa, unidentified
HDWHHIDPKDLSCRFDFTDNHGECISTGPEDHFVLKAGFGGEISLEGYTCTGITLTTTTYTSFFGSVSVTFSQSYYSPSYQTCRERYQMKSERPSEYEATLLHPVHESSWMRTVDVSTNSYLIVTGSKAKFDPYTEHLLSSIFPKGECIANPTEGICSTTMEHTLWFSVTEQSTYCDIFEPAKLTRYGKDYKACGYQDSHGFYRSVQGACVENFCGKVGLRFLDGFVMFAGNIEQTLYCTPDLLISLHTTMLDAREEELRKYIKDWKDDCLDVIEDITYRGVTSIRKLGYFRDMVPGPGRAYRISPNGLEAADVVYIPVSNWSEILPNRTCLLINGQCMEPVNDQFFNGITLGPEGVIIIPERDLLSGIFDDYFQIVHQIDVRHPSVIAISDHIERLNTSSIKQTNSEHISPIDFGLGSWTNWALTLVIFVLASLLLMFVAKKLVVCLWKSGKRSGMSSDPERV

SEQ ID NO: 42 - protein, 511 aa, unidentified
MKCLLYLAFLFIGVNCKFTIVFPHNRKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGIISGTTTERELWDDWAPFEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLVLVLRVGIYLCIKLKHTKKRQIYTDIEMNRLGK

SEQ ID NO: 43 - protein, 511 aa, unidentified
MKCLLYLALLFIGVYCKFTTVFPHNKKGDWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSDDICPTVHNSTTWHSDYKVKGLCDSNLISMDITFFSEDGELSSLGKEGTGFRSNYFAYETGDKACKMQYCKHWGVRLPSGVWFEMADKNLFAAAKFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIPDATSQLPDDETLFFGDTGLSKNPIELVEGWFSGWKSSIASFFFIIGLIIGLFFVLRIGVYLCIKLKHTNKRQIYTDIEMNRLGN

SEQ ID NO: 44 - protein, 511 aa, unidentified
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFIDGKCSNDICPTVHNSTTWHSDYKVKGLCDSNLISMDITFFSEDGELSSLGKEGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVEIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIELVEGWFSGWKSSIASFFFIIGLIIGLFLVLRVSIYLCIKLKHTKKRQIYTDIEMNRLGK

SEQ ID NO: 45 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKYPVELVEGWFSGWRSSIMGVVAVIIGFVILIFLIRLIGVLSSLFRPKRRPIYKSDVEMAHFR

SEQ ID NO: 46 - protein, 511 aa, unidentified
MKCLLCLAFLFIGVNCKFTIVFPHNQKGNWKNVPSNYHYCPSSSDLNWHNDLIGTALQVKMPKSHKAIQADGWMCHASKWITTCDFRWYGPKYITHSIQSFTPSVEQCKESIEQTKQGTWLNPGFPPQSCGYATVTDAEAVIVQVTPHHVLVDEYTGEWVDSQFINGKCSNDICLTVHNSTTWHSDYKVKGLCDSNLISMDITFFSEDGELSSLGKAGTGFRSNYFAYETGDKACKMQYCKHWGVRLPSGVWFEMADKDLFAAAKFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTNTERELWEDWAPYEDVEIGPNGVLRTSSGYKFPLYMIGHGMLDSDLHLSSKVQVFEHPHIQDAASQLPDDETLFFGDTGLSKNPIELVEGWFSGWKSSIASFFFIIGLIIGLFLVLRVGIYLCIKLKHTRKRKIYADIEMNRLGK

SEQ ID NO: 47 - protein, 520 aa, unidentified
LLISFVTPSYSSLSIAFPESTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEVAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEPKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCKKPKWKKGVERSDSFEMRIFKPNNMRARV

SEQ ID NO: 48 - protein, 507 aa, unidentified
EMFLFSVTILVLFGHVSGIDILMPDGIPDKWDRALPEDINCPVIFPQADVKTHHLVLEGLTVGSPDIPTVPGYWCVEETWVTTCDFRWYGPRYITKSYYRTLPDTSSCRNSWLSYQIGVPSEKGYPPEECSWNNIIETSEVSISVTPREMQLDPYTQFVVDPSLKAGQCNAAACEGSSGSTIWIRSLTSPPICLTFDRVELSLMGFVRKDGALIFDQRTKIVLPDESVRNLETGCMLTLCETPGVLFPEGLWVTLVETERLTEISKSLKKCPMGNAVVKSHTGIGHTSHELDWESSIILSLCEDKLERLVMTGALHPRDFSMFTPLHEGTGRMYRVNNSTLESAQVTFRLSTLLTSPGSDILMYQIKNTTYTWNTWSETGVKNLLHGGNGIYKTSGVWGIFDMKIQTSVLDDFKMIHMTAKTLDHLIVSELPDLNLKKMKPHWSSPPPGGIGEIGFDLWVQTRVMWIGVGVLICILILGCVIRFAMHLNQSSLRGQNLPQEIPMYGF

SEQ ID NO: 49 - protein, 524 aa, unidentified
RLVIYFSLILLDKFNTIKSESFSYPTSRILNWNPVSYNYLTCPQHHTSYDSTIHKHLDEILVRKPIYNDNLFVDGYLCRKVAYITRCVTSWTFTSSINKLIHGLSVSRTECLEKIKQLEEDELIQERFKEPDCRWNKIYDVESINFEIINHKVKLDPYTNNLVDPIFPGGITHSSKSATIHNDVIWISKVNTTFTCNRHIEMKGIVYTKLGVSERNLSGEIAMLHIEGFKDKSFQGACLLMYCNEQGVRFSDGEWISISYDLNFNHSFTNLLSDLNPCSSTVSLSLSNNYQRNIITMELTLETIFRLRCEDTIAKLINHIPITPYDVSFLAQSYPGPGNVYQIRDNVLMQAQGLYELLLVNSSESNGDVIGYHVNGTAFIEDRWYTDNHKSIHGLNGIVKFGGRIRYPGDIFKRRRTHDSLLKAKPLLKVSHPTVLDLSKIINSTDIEYGYHPNSVLDNSILEDTISEIKYLWSHLFDFSVLGQILWVALVVIVLVIGLSSYKVWRRVRETQTLDDIESINRRQ

SEQ ID NO: 50 - protein, 512 aa, unidentified
SYLPQTLIFPQKLIGQEEKLSFSGSQLCNYFLDPKMFSSFIKHTTGPQSIDGFSVYHTASQKIVGFFCTKLSKKTTCSKSFFGSETIDQKIESKQASLSECFESLGDEEHNLVRNTDFPAKECSWLKTSTTVNEFINVHEHSVVYNAYLDAYQDRNFITGTCQSNYCHTYHSDITWITKSIPTSTCGSFKHEKFLISHDSSKIGFEINHHSTFFSPSIKSTTLNNSCKLKYCGYEGIHTSSGEFIGLNLSTLPKPYKDVATISLPSCGETHPNISYGGIEVIEENLIQVLNRDSNFRACSETLYKIRSGEKITRHDLYKLNPLTPGPGPVFILQPPTINSNKRELEIILGDYAVYTPSTIQKQFNNKKINSEKTSTIWNHWSLESKGVWNGPNGILMVNETLVIPTYSNIDPLFQTFQNYEMEIVGAFNPTIDSRKQLIVNHVSMNHNNFVNDSSIESFFSGFNLEYKIVIFVGVLLLLTLTVYAIFKVYKYIAKNKSSHINRDEYSVVFKN

SEQ ID NO: 51 - protein, 507 aa, unidentified
AEMRIIYLILLLSTVETESLVIPVGRLQNLTKITDHHLICHRGATADKSEYTEIHNVHTIHPSLEEKLIDGFLCVKKTYHLTCSENFFGVKTITSGHDIVKSTISECLESIDLWNKDLLDTDTAVVQNCGWMSTNTVFKSVIFIKRKSIPIDQYHMKLIDPILLKGYCTDVVCETVYPYVTWMTQSQLKASCPDVETNVIKFYIGVEKTAEDTFVTGDYIPDVNLVGVCRDFYYCGHPGFVLKTGHFVLNAKELPGSVKEIVLKSPKCPDNTTIVSNSVHNLVTGSIMGVEKLFFLEKCEEVLNKIRTNSTITMFDLAFLNPRVPGNAYGYQYDGQSVSIGKFTFLRAKKVVVDCYSCHHCEITLYRDIGIWNVSRDTMICSCIAFKGCHLPNGFLAINNTLINPLEELDSSWYLDYINKEIPMDYIPHIQMNRYKSSNLLGYHDYPVSDSHNLIKVLQSESEKIWTGLKLSLLYLIMPLIILSIIILVATKCCRTRHPINESSDQG

SEQ ID NO: 52 - protein, 519 aa, unidentified
MSNFRAFNLFLISIFISNSYSDIVYPTEITTNWLPANFSKIQCPNSIYHLTLEHQQDKIPIYIFKPNSIKKLIVKGLLCHKVKKITHCNENWLFISEITHEIFPSKISKGECEEAISDHLQGREIEDSYPLPSCAWNTINSVSRNVIYLTEHSVRYDQYSMSYVDGIFLNGRTKTSFSHTIYDSTMWKANPIEQSLYQCVELESEPGYLYQDNEQWFIWGDTLKEQLLSDMCELSYCGYHGLLSKTGEWIYIEQKSNKSLIRQLIRSRPYCKKDVDIREEYKSQQTNTGLMNTMGLMIQMRCNEILNKLLTTNSINNIDISYLVQQHQGVGPVYKLENNSLYVTTGVYKIVNTTFLNKKPLLLGTGLDNQQIYLTSFRRLTKNLSYGWNGIILYKNQIILPLNNYYSYEINQVLSDSYPLKVLTHPVFNISPLKIFESNATFSNSPNRTDLPNVLLKFSESVYQKLERWVNRVFSSFNGLSIIIYSIIILITISVILHVKPLYLKSKKGSSNFDRIRVK

SEQ ID NO: 53 - protein, 530 aa, unidentified
MLSQVTLQAFVIVCLIYRAYSSLSIAFPESTKLDWKPVTKNTRYCPMGGEWFLEPGLQEESFLSSTPIGATPSKSDGFLCHAAKWVTTCDFRWYGPKYITHSIHNIKPTRSDCDSALASYKSGTLINPGFPPDSCGYASVTDSEFLVIMITPHHVGVDDYRGHWVDPLFVGGECDQSYCDTIHNSSVWIPADTTKKNICGQSFTPLTVTVAYDKTKDISAGALVFKSKYHSHMEGARTCRLTYCGRTGIKFPNGEWVSLDIKTKIQEKQLLPLFKECPAGTEVRSTLQSDGAQVLTSEIQRLLDYSLCQNTWEKVDRKEPLSPLDLSYLASKSPGKGLAYTVINGTLSFAHTRYVRMWIDGPVLKELKGKRESASGIASDIWTQWFKYGDMEIGPNGLLKTKSGYKFPWHLIGMGIVDNELHELSEANPLDHPQLPHAQSIADDSEEIFFGDTGVSKNPVELVTGWFTSWKESLAAGVVLILTVVLIYGVLRCFPVLCMPCRKTKWKKGVERSDSFEMRIFKPNNMRARV

SEQ ID NO: 54 - protein, 530 aa, unidentified
MTSSVTISVILLISFITPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGALVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 55 - protein, 517 aa, unidentified
MLSYLILAIIVSPILGKIEIVFPQHTTGDWKRVPHEYNYCPTSADKNSHGTQTGIPVELTMPKGLTTHRVDGFMCHSALWMTTCDFRWYGPKYITHSIHNEEPTDYQCLEAIKAYKDGVSFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYLGPKNPGVGPVFTVINGSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGVSKNPVELVEGWFSGWRSSIMGVVAVIIGFVILIFLIRLIGVLSSLFRPKRRPIYKSDVEMAHFR

SEQ ID NO: 56 - protein, 453 aa, unidentified
VFLCRKLSLITRCETNWLMSSSVNNIIQGMKVTSSECVEAVKDYDKGIQNLEDFKTPVCVWSKVNDVINTVYKIIPHNVKIDPYNNQFLDPLFAGGKTDLLISSTIHDDMIWLSKDQNRSEGCTDHEEDEGFIYISNTKLPSQPGQPVVFLHVEGHKDKTMENACLYNYCGNQGVLFSDGEWMSVEFLSKQTQDQEHPFVDLKPCQGEKTVGLTSPHLNQLLNYDITMEAMYRLKCEDVLSKLINNIPISPYDISFLTQSHPGPGIVFQLRDKVLMQAQGYYSKINVPVQSLGENIVGILSNGTNFVETRWFLSKDNISHGLNGLIKINNTLIFPHEVFRRGHIHESLLSHQELIRVSHPTVMEFSGLINRTDLEYGYKSSNPDLAQLLRETSKRISTWWDRIFTLSIFIKLIIVFGLVILACFFLYKLLKSLRLGDKRRSIPKVESMSSLRS

SEQ ID NO: 57 - protein, 523 aa, unidentified
MTRLITFFTIAVTLIGRDSADVVTFFYPDVNEAKWTAVSPSQISCPSISSTFEPGADTVLGYLSLSVPNLGQPSDFTGYLCHKVSYTTTCYENFLGAKTVSHTVMGGQISVAECKDAVRAYISGELLSTGFPAPNCQWMEIIDSRSFDIKISDHKVKVDPYTNRLIDPIFVGGAGTRNAHETVHSDVMWIPSSDTPGLLCGDLPITTGVLYNKGLKTERDPAHLFGRISLSGGRDFDLKGSCRMKYCGDQGLRLASGEWFGVTVDPNRSSVQPTFMDNITVCPSGATVYQNLVPSLSDAEEEVTISLLYRLQCQRTIAKLISGDPISQYDVSFLVQNHAGVGPVYWLKGDRLLYTVSKYSKLAHNSDDDKVGLMGLRWSNAPFKELNQYQDPHNPDLVFLPNGYVLLNHTLIIPPGLLLQESVHAILTKAVKLHPISHPVMDIVSNHTDNLPLDVIVSHNVTDVPMVSWSFDTPFWLSWKFYTTIIVLPVIIFVLVKMFKCWRYLASQIKESKGSKELPEQRW

SEQ ID NO: 58 - protein, 511 aa, unidentified
MTPAFILCMLLAGSSWAKFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 59 - protein, 512 aa, unidentified
MKFLLLFLITIPAYSYAKFSIVFPQSQKGNWKNVPATYHYCPSSSDQNWHNDLIGIPMKVKMPKTHKAIQADGWMCHAAKWITTCDFRWYGPKYITHSIHSIQPTSEQCKESIKQTKQGTWINPGFPPQNCGYASVSDSVAVIVQATPHHVLVDEYTGEWIDSQFPDGKCKSEECETTHNSTVWFSDYKVTGLCDATFVDTDITFFSEDGKKESLGKPNTGYRSNYFAYEKGEKVCKMNYCKHAGVRLPSGVWFEFADQDAYTAAKFPECPVGATISAPTQTSVDVSLILDVERILDYSLCQETWSKIRSKQPVSPVDLSYLAPKNPGTGPAFTVINGTLKYFETRYIRIDIDNPIIPKMVGKVGGSQTERELWTEWYPYEDVEIGPNGILKTPTGYKFPLFMIGHGMLDSDLHKTSQAEVFEHPHLAEAPKQLPEGETLFFGDTGISRNPVELIEGWFSSWKSTVVTFFFAIGVFILFCVVTRIVIAMRYRYQGASNKRIYNDIEMSRFRK

SEQ ID NO: 60 - protein, 525 aa, unidentified
MSSKIVLAAICLCSVQYVACSFQIVFPEFNNAAWLPYLKTSRYCPQSAEMEFERRVSTTLLSADVPIGVTPTKSDGYLCHAAKWVTTCDFRWYGPKYVTHSIHDLTPAQVDCHEALARYKAGTLFNPGFPPASCGYATITDSEQKVVMITPHHVGIDDYRGKWIDPIFPGGECTTNYCETLHNSSVWLPADEKIVDICAQTFRKIKVTATYPSEGAVTKETISLHSAYHPHVPGTGICRMTYCSKEGLRLPNGEWLGIFYDNRIKTTDVRTVFPACPDGLEVKSTLNSDGANTIAWETQRMLDYALCQSTWDKVQNKEPLSAVDLSYLSARSPGKGLAYTVINGTLHFAHVRYVRTWIDGPVLKDLKGSRFDPTAAQKTLWDQWFPFGSNEIGPNGLLKTPKDFKFPLYIIGTGLVDEDLQELSEAGPIDHPQIPDASGILPNSEQVYYGDTGVSKNPIELIEGWFANWKETVMSIVGLVLLITIVFTVLKCIGTCRSLRRKRKIEKDIELQEIGPYQPTTYRPR

SEQ ID NO: 61 - protein, 530 aa, unidentified
MTSSVTISVILLISFITPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIIDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 62 - protein, 511 aa, unidentified
MKCLLYLAFLFIGVNCKFTIVLPHNRKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMRYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLFLVLRVGIYLCIKLKHTKKRQIYTDIEMNRLGK

SEQ ID NO: 63 - protein, 506 aa, unidentified
MINVIQFLELILCAQAAKIILPVHLESEWVPVHFGERICQSNREKIPNGIYSSLKIEGKVPVRQRSEGADGYYCHKTVYSVLCDFKWYGVKKLRHSVKRDVPSYGDCLKAIDDMETGLNEYIGFPPPSCNYLVETRSQNTEVILSKHQVKIDDYKQSWMDSTFVDGGCRKAPCLTTIPGTLWIPSSNLTAACDISFKTQEFTVYYPKIKPQTLSSDHIFITSPYHPVSSLSKSCEINLCNKKGIRLPGGSWTEMGSHTSFHGIKVDTLLPKCQSSVEIYATPPDLKNLRMIWDLEKVIENTLCQATWDKIETRQKITPLDLNYLSPSEPGPGWGFLPRNGSMYKAQILYIRAEVEGDTVALHQRYNKEKEDFYFEWNDWEMLNGIRIGPNGIITNGTHVKVPYYSVGIGKLDEEMMIPQQIEIIHHIDHLKQRIPAQSNLDRTWIHEGENGDIITSVSHWWHDILMHSWELFAALGGLCVLFCMCSCCLNRRGGRKTRHQETMSFV

SEQ ID NO: 64 - protein, 511 aa, unidentified
MKCLLYLALLFIGVNCKFTIVFPHNQKGNWKNVPSGYHYCPSSSDLNWHNGLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNDICPTVHNSTTWHSDYKVKGLCDANLISMDITFFSEDGELSSLGKEGTGFRSNYFAYETGDKACRMQYCKHWGVRLPSGVWFEMADNDLFAAAKFPECPEGSSISAPSQTSVDVSLIQDVERILDYSLCQETWSKIRTGIPISPVDLSYLAPKNPGTGPAFTIINGTLKYFETRYIRVDIAAPILPRMVGTISGTTTERELWDDWAPYEDVEIGPNGVLKTSSGYKFPLYMIGHGMLDSDLRISSKAQVFEHPHIQDAASQLPDDETLFFGDTGLSKNPIELVEGWFSGWKSSIASFFFIVGLIIGLFLVLRVGIYLCINLRHTKKRKIYTDIEMNRLGK

SEQ ID NO: 65 - protein, 516 aa, unidentified
KPLIRIHILLTMCMIQSTLTEIAYPSQLLTNWVPANYSSIKCPTTIYHLNLEHQQDKIPVEILKPTSIKKLRIDGFLCHKVVKTTHCNENWLFISEISHELKTAKILKSECSDAIINYNNNLNVDDDYPLPSCAWNMFNSVSRTIIHVIEHSVRYDQYSMSYIDNIFLNGHSVDSFSNTIYDSTIWKAKEENDIDKCVELSPEPGFIYQLDNNWFIWGETIKEQSLSEMCELTYCGYHGMMSKKGEWIYINSTSNLIKTKDILNPKLSCKNRVNIRKEYKSQQTNTGIMNTMGLIMKMKCQDIINKLLISNQISNNDLSYLVQQYQGIGPVYRLENKTLNVATGIYKIVRTDEMNNRSRLLGSDLSGNNIYLRDWVKVKDNLYYGINGIMLYNDRIILPLNMYYSYDINRELRHEHKLRTLPHPVITIVQNKTLESNPIFYHQPNRTDIVVTLYHISENLSSKISRYVGRIFSSFNFVSVLIYTFFLLTVMLIIIKIHHLIVKPSFDQHQRSNFVY

SEQ ID NO: 66 - protein, 511 aa, unidentified
MKCLLYLALLFIGVHCKFTTVFPHNKKGDWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSDDICPTVHNSTTWHSDYKVKGLCDSNLISMDITFFSEDGELSSLGKEGTGFRSNYFAYETGDKACKMQYCKHWGVRLPSGVWFEMADKNLFAAAKFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWEDWAPYEDVEIGPNGVLRTSSGYKFPLYMIGHGMLDSDLHLSSKAQVFEHPHIPDATSQLPDDETLFFGDTGLSKNPIELVEGWFSGWKSSIASFFFIIGLIIGLFFVLRIGVYLCIKLKHTNKRQIYTDIEMNRLGK

SEQ ID NO: 67 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQRYKFPLHIIGTGEVDSDIRMERIVKHWEHPHIEAAQTYLKKDDTEEVIYYGDTGISKNPVELVEGWFSGWRSSIMGVVAVIIGFVILIFLIRLIGVLSSLFRPKRRPIYKSDVEMAHFR

SEQ ID NO: 68 - protein, 517 aa, unidentified
MLSYLILAIIVSPILGKIEIVFPQHTTGDWKRVPHEYNYCPTSADKNSHGTQTGIPVELTMPKGLTTHQVDGFMCHSTLWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKNPVELVEGWFSGWRSSIMGVVAVIIGFVILIFLIRLIGVLSSLFRPKRRPIYKSAVEMAHFR

SEQ ID NO: 69 - protein, 530 aa, unidentified
MKSSVTIGVMLIISFINPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADSTKKNICGQSFTPLTVTVAYDKTKEIAAGGIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLAFAHTRYVRMWIDGPVLKELKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 70 - protein, 513 aa, unidentified
MLVLYLLLSLLALGAQCKFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 71 - protein, 530 aa, unidentified
MTSSVTISVILLISFITPLYSYLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGGIVFKSKYHSHMEGARTCRLSYCGRNGIKFPNGEWVSLDVKTKIQEKSLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEPKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 72 - protein, 517 aa, unidentified
MLSYLILSIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLDAIKAYKDGVSFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYLGPKNPGVGPVFTVINGSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGVSKNPVELVEGWFSGWRSSIMGVVAVIIGFVILIFLIRLIGVLSSLFRPKRRPIYKSDVEMAHFR

SEQ ID NO: 73 - protein, 530 aa, unidentified
MLSQVTLQAFVVMCLIYRAYSSLSIAFPESTKLDWKPVTKNTRYCPMGGEWFLEPGLQEESFLSSTPIGATPSKSDGFLCHAAKWVTTCDFRWYGPKYITHSIHNIKPTRSDCDSALASYKSGTLINPGFPPDSCGYASVTDSEFLVVMITPHHVGVDDYRGHWVDPLFVGGECDQSYCDTIHNSSVWIPADTTKKNICGQSFTPLTVTVAYDKTKDISAGALVFKSKYHSHMEGARTCRLTYCGRTGIKFPNGEWVSLDTKTKIQEKQLLPLFKECPAGTEVRSTLQSDGAQVLTSEIQRLLDYSLCQNTWEKVDRKEPLSPLDLSYLASKSPGKGLAYTVINGTLSFAHTRYVRMWIDGPVLKELKGKRESASGIASDIWTQWFKYGDMEIGPNGLLKTKSGYKFPWHLIGMGIVDNELHELSEANPLDHPQLPHAQSIADDSEEIFFGDTGVSKNPVELVTGWFTSWKESLAAGVVLILTVVLIYGVLRCFPVLCMPCRKTKWKKGVERSDSFEMRIFKPNNMRARV

SEQ ID NO: 74 - protein, 511 aa, unidentified
MKCLLYLAFLFIGVNCKFTIVFPHNRKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKKGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLFLVLRVGIYLCIKLKHTKKRQIYTDIEMNRLGK

SEQ ID NO: 75 - protein, 511 aa, unidentified
MKCLLYLAFLFIGVNCKFTIVFPHNRKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKHWGVRLPSGVWFEMADKDLFAAARFPKCPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLFLVLRVGIYLCIKLKHTKKRQIYTDIEMNRLGK

SEQ ID NO: 76 - protein, 523 aa, unidentified
MKMKMVIAGLILCIGILPAIGKITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 77 - protein, 530 aa, unidentified
MLSQVALQTFVIMCLIYRAYSSLSIAFPESTKLDWKPVTKNTRYCPMGGEWFLEPGLQEESFLSSTPIGATPSKSDGFLCHAAKWVTTCDFRWYGPKYITHSIHNIKPTRSDCDSALASYKSGTLINPGFPPDSCGYASVTDSEFLVVMITPHHVGVDDYRGHWVDPLFVGGECDQSYCDTIHNSSVWIPADTTKKNICGQSFTPLTVTVAYDKTKDISAGALVFKSKYHSHMEGARTCRLTYCGRTGIKFPNGEWVSLDTKTKIQEKQLLPLFKECPAGTEVRSTLQSDGAQVLTSEIQRLLDYSLCQNTWEKVDRKEPLSPLDLSYLASKSPGKGLAYTVINGTLSFAHTRYVRMWIDGPVLKELKGKRESASGIASDIWTQWFKYGDMEIGPNGLLKTKSGYKFPWHLIGMGIVDNELHELSEANPLDHPQLPHAQSIADDSEEIFFGDTGVSKNPVELVTGWFTSWKESLAAGVVLILTVVLIYGVLRCFPVLCMPCRKTKWKKGVERSDSFEMRIFKPNNMRARV

SEQ ID NO: 78 - protein, 507 aa, unidentified
MYLAFLFIGVNCKFTIVFPHNQKGNWKNVPSNYHYCPSSSDLNWHNDLIGTALQAKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVEGLCDSNLISMDITFFSEDGELSSLGKEGTGFRSNYFAYETGDKACKMQYCKHWGVRLPSGVWFKMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGRISGTTTERELWDDWAPYEGVEIGPNGVLRTSSGYKFPLYMIGHGMLDSDLHLSSKAQVFEHPHIQDAASQLPDDETLFFGDTGLSKNPIELVEGWFSSWKNSIASFFFIIGLIIGLFLVLRVGICLCIKLKHTKKRQIYTDIEMNRLGK

SEQ ID NO: 79 - protein, 511 aa, unidentified
MKCLLYLAFLFIGVNCKFTIVFPHNQKGNWKNVPSNYHYCPSSSDLNWHNDLVGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKKGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERVLWDDWAPYEDVEIGPNGVLRTSSGYKFPLYMIGHGMLDSDLHLSSKAQVFEHPHIQDAASQLPDGETLFFGDTGLSKNPIEFVEGWFSSWKSSIASFFFTIGLIIGLFLVLRVGIYLCIKLKHTKKRQIYTDIEMNRLGK

SEQ ID NO: 80 - protein, 517 aa, unidentified
MLSNLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKNPVELVEGWFSGWRSSIMGVVAVIIGFVILIFLIRLIGVLSSLFRPKRRPIYKSAVEMAHFR

SEQ ID NO: 81 - protein, 512 aa, unidentified
MNFILLILAVLPISNYAKFSIVFPQSQKGNWKNVPASYHYCPSSSDQNWHNDLIGITMKVKMPKTHKAIQADGWMCHAAKWITTCDFRWYGPKYITHSIHSIQPTSEQCKESIKQTKQGTWISPGFPPQNCGYATVTDSVAVIVQATPHHVLVDEYTGEWIDSQFPNGKCEAEECETIHNSTVWFSDYKVTGLCDATLVDTDITFFSEDGKKESLGKPNTGYRSNYFAYEKGEKVCKMNYCKHSGVRLPSGVWFEFADQDAYTAAKFPECPVGATISAPTQTSVDVSLILDVERILDYSLCQETWSKIRSKQPVSPVDLSYLAPKNPGTGPAFTIINGTLKYFETRYIRIDIDNPIIPKMVGKIGGSQTERELWTEWYPYEDVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVIARIVITVRSRYQGASNKRIYNDIEMSRFRK

SEQ ID NO: 82 - protein, 511 aa, unidentified
MKCLLYLAFLFIGVNCKFTIVFPHNRKGNWKNVPSNYHYCPSSSDLNWHNDLIGTALQVKMPKSHKAIQADGWMCHASKWVTTCDFRWYGPEYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLFLVLRVGIYLCIKLKHTKKRQIYTDIEMNRLGK

SEQ ID NO: 83 - protein, 530 aa, unidentified
MTSSVTISVILLISFITPLYSYLSIAFPENTKLDWKPVTKSTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGGIVFKSKYHSHMEGARTCRLSYCGRNGIKFPNGEWVSLDVKTKIQEKPLLPLFKECPAGTEVRSTLQSDGAQVLTPEIQRILDYSLCQNTWDKVERKEPLSPLDLSYLASKSPGKGLAYTVINGTLSFAHTRYVRMWIDGPVLKEPKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 84 - protein, 506 aa, unidentified
  VARIANT 396: note = Any amino acid
MVRIICWLGLVLSVQAAKVILPVKLESDWVPVYSGERICQSHREKIPPGIYESLKVEGQVPVRQQSQGADGYYCHKTIYSVLCDFKWYGVKRVRHSVKRDTPSYSECLKAVDDEISGMSEYVGFPPPSCNYLVETRSQNIEIILSKHSVKIDDYKQSWMDSTFLDGGCSHAPCLTTVPGTLWIPTDNLTSACDITFRKQEFTIYYPKQKPAHLSSDQIFITSPYHPVSSLSKSCLITLCGKTGIRLPGGSWSSLDNHKSFHDIKIETLLSNCKSSTEIYSSPPDLRNIRMVWDLERVIENSLCQGTWDKIETRQKITPLDLNYLSPSEPGPGWGFIPKNGSIHKAQILYIRADVDDDTIALGQKYNKGKDEFYFNWNDWELLNGIKIGPNGIITNXTHVRIPYYSVGIGKLDEDMITPDEVGVIHHIDHLKQRVLVQTNLDRVWIHEGENGDLITSVSHWWHDVIKHSWEIFALIGGLFSLSCICSLCSCRKKRRESRHQETMSFV

SEQ ID NO: 85 - protein, 511 aa, unidentified
MNLAVVLCMLLAGSSWAKFTIVFPQSQKGEWRDVPSNYRYCPSSADQSWHGDLLGVNIRAKIPKAHKAIKADGWMCHAAKWITTCDYRWYGPQYITHSIHSFVPTQAQCEESIKQTKEGVWINPGFPPKNCGYASINDAESVIVQATAHTVMIDEYSGDWLDSQFPTGRCKGTICETIHNSTLWHADYKVTGLCDAALVSTEVTFYSEDGLVTSIGRQNTGYRSNYFPYEKGAGACRMKYCTHDGIRLPSGVWFEMVDKELLNSSQMPECPAGLTITAPTQTSVDVSLILDVERMLDYSLCQETWSKVHNGQPISPVDLGYIAPKNPGAGPAFTIINGTLKYCDTRYLRIDIDGPVLQKMTGKVSGTPTERELWTEWFPYEDVEIGPNGVLRTQEGYKFPLFMIGHGLLDADLQKTSRAEVFHHPQIAEAVKKLPDDETLFFGETGISKNPVELIEGWFSNWRSSVMAVIFAIVSLVLLGLIVRVIVAFRNSCCQRKRKVYNDLEMNRLRN

SEQ ID NO: 86 - protein, 530 aa, unidentified
MTSSVTISVILLISFITPLYSYLSIAFPENTKLDWKPVTKSTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGGIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEPKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 87 - protein, 559 aa, unidentified
MISSTLILVIISAHAFCDMIIPFPDVTTTSWKPVLRGEHHCPASNDLDMAGGLSTLKMNVKIPSGVVGSKSDGYLCHGAKWVTTCDYRWYGAKYITHSLHPLRPSTSQCFDAIKAYREGTLLSPGFPPESCGWNSVTDSELLSIQITPHHSGVDDYRGVWIDSMFPKGECDQRICDTVQEHSIWIAANNVSSACSIAFKQLEGYFYYRNSGIQPNKDGTFFHSSHHPNSPMSSCCRIKYCNQEGLRLHTGEWIGVAWNTKIRDVTLDSYTDTCPGGTEVKSTIGSSPTRVVAWEMERIMDFALCQNVWDKVNRGEQLSPLDLSYLSSRAPGKGLAYTIINETLHVAHVRYIRTWIKGPVLKEIKGRRGSSSAAEDTLWIQWFPFGDNQIGPNGLLKSNGTFKFPFYLVGVGALDEDLIEMANADPVDHLQRVDAETHMRGDEELFFGDTGVSKNPIESVEGWFSNWISGLFNISIIVLCVLSVLIVFKSVITLIRVVRRRRRPRAEEDVELNNMNPRPQTRQPVGAPNIIPGAWGIQPSHGRGVRQSQFVKRSALNIVT

SEQ ID NO: 88 - protein, 511 aa, unidentified
MKCLLYLAFLFIGVNCKFTIVFPHNQKGNWKNVPSNYHYCPSSSDLNWHNDLVGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKKGTGFRSNYFAYETGDKACKMQYCKHWGVRLPSGVWFEMANKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTKERVLWDDWAPYEDVEIGPNGVLRTSSGYKFPLYMIGHGMLDSDLHLSSKAQVFEHPHIQDAASQLPDGETLFFGDTGLSKNPIEFVEGWFSSWKSSIASFFFTIGLIIGLFLVLRVGIYLCIKLKHTKKRQIYTDIEMNRLGK

SEQ ID NO: 89 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPDTGIRSNYFPYITTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKNPVELVEGWFSGWRSSIMGVVAVIIGFVILIFLIRLIGVLSSLFRPKRRPIYKSAVEMAHFR

SEQ ID NO: 90 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGVPETGIRSNYFPYISTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVESDIKMERIVKHWEHPHIEAAQTYLKKDDTEEVIYYGDTGISKNPVELVEGWFSGWRSSIMGVVAVIIGFVILIFLIRLIGVLSSLFRPKRRPIYKSDVEMAHFR

SEQ ID NO: 91 - protein, 521 aa, unidentified
VLLISFITPSYSSLSIAFPENTKLDWKPVTRNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHEVSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 92 - protein, 511 aa, unidentified
MKCLLYLAFLFIGVNCKFTIVFPYNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAAAQLPDDETLFFGDTGLSKNPIEFVEGWFSSWKSSIASFFFIIGLIIGLFLVLRVGIHLCIKLKHTKKRQIYTDIEMNRLGK

SEQ ID NO: 93 - protein, 511 aa, unidentified
MKCLLYLAFLFIGVNCKFTIVFPYNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKRWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFFFIIGLIIGLFLVLRVGIYLCIKLKHTKKRQIYTDIEMNRLGK

SEQ ID NO: 94 - protein, 511 aa, unidentified
HSLLVIAGLIGLSSAFDPDFRFLPVDVQKTWKAYTPDAIKCESETLNLSHDLESVLDVTLLEPSVDSELLTPGLMCEKTIWTTVCEYTWYFQTTVSHMIRKVKPSFGECENQRIQPEQEIGLRMFPEPDCWYSSKTEAHLEYVVLKSEPLPVDPYTGNVISNHLINGRCNDTVCNSADSLELWLRTGTVSELCKKRLHHPAELVRDPSNETTIWNPLWGVLSVDNLCRMDLCGEKGIRTQFGMWFTMVASDGLTPLEITEFEQGLSACPPDTTVQTLESFWNSPSFDDAESLLLYDRCVDAKAQLFEDPTKTNLHLMSRLVGNRPGYGPVLRWCHGRPEMSYANYIYGRATNQSVTNSIGTEWRSGKDIPWVDWCKTIINNRTIYEGPNGIRKVNGFLIYPYHETTSEGRHLMELHHHQLEEKKEDHQVMTNHSLLTKVNLGGKKLNLIKGLADGVEWVGEEVSSFGSGLLHFLTGGALLAILTLFVCLFMRCCQSRPRPINAPMMMEERP

SEQ ID NO: 95 - protein, 506 aa, unidentified
MNSLMITLHLFLSMSMASLILPNVSPISWERTLPEDIHCPTIFRMSSITPNHTPFTGYTVGSPVIPTVPGYWCIKETWVTECDFRWYGPRYIKRSYFRSLPYSSLCSDSWQTFKQGIPVEKGFPPEECSWNNIIETSISSISVTARDMAYDPYTQSVVDPSLENGFCTGTICEGSSGLNLWIRLSISSPMCLTFDKISLLVQGFKGKDGILEYGTNSEVVLPDGSVRVIKTGCKLNLCGSIGVLFPEGLWITVSEHRKLKVIIDLLRTCVEGSNVVKSHTGIGHYLHEITWESAIILSMCEDKVETLIRTGELSPRDFSIFTPLHEGPGMLYRVNNGTLESTHVNYKLSELITNPGTNNLIYKQGNTTINWMSWSDTDIKGLKHGGNGIYMANKVWGLFDMQIQSSTLDDFKQIKLSAFTLDHLQIEKTPHTPTPQTIPHWSSPASGSISGLDETVSHIIRYLSITFIILLIIFLSILLKKLLGCLNGVKSRNRTQIDNIGMYGFN

SEQ ID NO: 96 - protein, 511 aa, unidentified
MKCLLYLALLFIGVNCKFTIVFPHNQKGNWKNVPSSYHYCPSSSDLNWHNGLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNDICPTVHNSTTWHSDYKVKGLCDSNLISMDITFFSEDGELSSLGKEGTGFRSNYFAYETGDKACRMQYCKHWGVRLPSGVWFEMADKDLFAAAKFPECPEGSSISAPSQTSVDVSLIQDVERILDYSLCQETWSKIKAGLPISPVDLSYLAPKNPGTGPAFTIINGTLKYFETRYIRVDIAAPILPRMVGTISGTTTERELWEDWAPYEDVEIGPNGVLKTSSGYKFPLYMIGHGMLDSDLHLSSKAQVFEHPHIQDAASQLPDDETLFFGDTGLSKNPIELVEGWFSGWKSSIASFFFIIGLIIGLFLVLRVGIYLCIKLKQTKKRKIYTDIEMNRLGK

SEQ ID NO: 97 - protein, 511 aa, unidentified
MKCLLYLAFLFIGVNCKFTIVFPHNQKGNWKNVPSNYHYCPSSSDLNWHNDLVGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKKGTGFRSNYFAYETGDKACKMQYCKHWGVRLPSGVWFEMADKALFAAARFPECPEGSSISAPSQTSVDVSLIQDIERILDYSLCQETWSKIRAGLPISPVDLSYLAPKNPGTGPVFTIINGTLKYFETRYIRVDIAAPILSRMVGMISGTTTERVLWDDWAPYEDVEIGPNGVLRTSSGYKFPLYMIGHGMLDSDLHLSSKAQVFEHPHIQDAASQLPDGETLFFGDTGLSKNPIEFVEGWFSSWKSSIASFFFTIGLIIGLFLVLRVGIYLCIKLKHTKKRQIYTDIEMNRLGK

SEQ ID NO: 98 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYITTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKNPVELVDGWFSGWRSSIMGVVAVIIGFVILIFLIRLIGVLSSLFRPKRRPIYKSDVEMAHFR

SEQ ID NO: 99 - protein, 530 aa, unidentified
MLSRVTFQLLVIGCLICQAYSSLSIAFPESTKLDWKPVTKNTRYCPMGGEWFLEPGLQEESFPSSTPIGATPSKSDGFLCHAAKWVTTCDFRWYGPKYITHSIHNIKPTRSDCDSALASYKSGTLINPGFPPDSCGYASVTDSEFLVIMITPHHVGVDDYRGHWVDPLFVGGECDQSYCDTIHNSSVWIPADTKKKNICGQSFTPLTVTVAYDKTKDITAGALVFKSKYHSHMEGARTCRLTYCGRTGIKFPNGEWVSLDVKTKIQEKQLLPLFKECPAGTEVRSTLQSDGAQVLTSEIQRLLDYSLCQNTWEKVDRKEPLSPLDLSYLASKSPGKGLAYTVINGTLSFAHTRYVRMWIDGPVLKELKGKRESASGIASDIWTQWFKYGDMEIGPNGLLKTKSGYKFPWHLIGMGIVDNELHEWSEANPLDHPQLPHAHSIADDSEEIFFGDTGVSKNPVELVTGWFTSWKESLAAGVVLILTVVLIYGVLRCFPVLCMPCKKPKWKKGVERSDSFEMRIFKPNNMRARV

SEQ ID NO: 100 - protein, 511 aa, unidentified
MKCLLYLAFLFIGVNCKFTIVFPYNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKKGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFFFIIGLIIGLFLVLRVGIYLCIKLKHTKKRQIYTDIEMNRLGK

SEQ ID NO: 101 - protein, 506 aa, unidentified
MINVIQFLELILCAQAAKIILPVHLESEWVPVHFGERICQSNREKIPDGIYSSLRIEGKVPVRQRSEGADGYYCHKTVYSVLCDFKWYGVKKLRHSVKRDVPSYGDCLKAIDDMETGLNEYIGFPPPSCNYLVETRSQNTEVILSKHQVKIDDYKQSWMDSTFVDGGCRKAPCLTTIPGTLWIPSSNLTAACDISFKTQEFTVYYPKIKPQTLSSDHIFITSPYHPVSSLSKSCEITLCNKKGIRLPGGSWTEMGSHTSFHGIKVDTLLPKCQSSVEIYATPPDLKNLRMIWDLEKVIENTLCQATWDKIETRQKITPLDLNYLSPSEPGPGWGFLPRNGSMYKAQILYIRAEVEGDTVALHQRYNKEKEDFYFEWNDWEMLDGIRIGPNGIITNGTHVKVPYYSVGIGKLDEEMMIPQQIEIIHHIDHLKQRIPAQSNLDRTWIHEGENGDIITSVSHWWHDILMHSWELFASLGGLCVLFCMCSCCLNRRRGRKTRHQEAMSFV

SEQ ID NO: 102 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYLGPKNPGVGPVFTVINGSLHYFTSKYLRVELESPVIPRMEGRVAGTRIVRQLWDQWFPFGEAEIGPNGVLKTKQGYKFPLHIIGTGEVDSDIKMERIVKHWEHPHIETAQTYLKKDDTEEVIYYGDTGVSKNPVELVEGWFSGWRSSIMGVVAVIIGFVILIFLIRLIGVLSSLFRPKRRPIYKSDVEMAHFR

SEQ ID NO: 103 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIITVTPHSVKVDEYTGEWIDPYFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYLGPKNPGVGPVFTVINGSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGVSKNPVELVEGWFSGWRSSIMGVVAVIIGFVILIFLIRLIGVLSSLFRPKRRPIYKSDVEMAHFR

SEQ ID NO: 104 - protein, 517 aa, unidentified
MLSYLILAIVVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYLGPKNPGVGPVFTIINGSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGVSKNPVELVEGWFSGWRSSIMGVVAVIIGFVILIFLIRLIGVLSSLFRPKRRPIYKSDVEMAHFR

SEQ ID NO: 105 - protein, 511 aa, unidentified
MKCLLYLAFLFIGVNCKFTIVFPHNRKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMKYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLFLVLRVGIYLCIKLKHTKKRQIYTDIEMNRLGK

SEQ ID NO: 106 - protein, 530 aa, unidentified
MTSSVTISVILLISFITPLYSYLSIAFPENTKLDWKPVTKSTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGGIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSHLASKSPGKGLAYTVINGTLSFAHTRYVRMWIDGPVLKEPKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 107 - protein, 520 aa, unidentified
MCTLQIITVIIVSYVTAVPVILPAGRDGKWNDVPNGFRYCPAVGDEYSYGRALSLQVNLLQPKSKEHEGAEGYLCHVAVYEATCDFRWYGVKYQTQKIRRVAPAEQDCIQRVKNTVTGRNDWVGFPAFSCNYASVTTEKHSEVVLVPHHVGVDDYQGMFVDPTLRDGSCVQPPCQTLYEDTLWLPITDLSRTVPCDLEFHQSRGVINFPAPRAGMSLANIQVSGPTLPTTSLDGSCHMGICGKWGIRLRSGVWIGFRERPILQGMDLYDTFMHGCRANTTISAGHFNPGALKMIWDAGRLLGYSLCQKTWDKLDRGDSITPLDLSYLNPVSPGPGLGFMSINGTLKMAKLRFARQELPDGLINNYNKDEPNPSLFQWQRWVPHGNVLVGPNGITLNGSTVKFPFFMVGVGKLDSDLTEAESIELLHHHEIAKGQMLHPIDDRYDWSHGGQSGDLIKKVESWFSIPDWVKNIGYGLITLCLLILMCSIFSRLCLLKVRQNRRPNNDHGPNRSDIPMSASFL

SEQ ID NO: 108 - protein, 511 aa, unidentified
MKCLLYLAFLSIGVNCKFTIVFPHNQKGTWKNVPSNYHYCPSSSDLNWHNDLIGTALQVKMPKSHKAIQADGWMCHASKWVTTCDFRWYGPKYITHSIRSFTPSVEQCRESIEQTKQGTWLNPGFPPQSCGYATVTDAEAVIVQVTPHHVLVDEYTGEWVDSQFINGKCSNDICPTVHNSTTWHSDYKVKGLCDSNLISMDITFFSEDGELSSLGKEGTGFRSNHFAYETGDKACKMQYCKHWGVRLPSGVWFEMADQDLFAAARFPECPEGSSISAPSQTSVDVSLIQDVERILDYSLCQETWSKIGAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIELVEGWFSGWKSSIASFFFIIGLIIGLFLVLRVGIYLCIKLKHTKKRQIYTDIEMNRLGK

SEQ ID NO: 109 - protein, 530 aa, unidentified
MTSSVTISVILLISFITPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGSIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 110 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGVSKNPVELVEGWFSGWRSSIMGVVAVIIGFVILIFLIRLIGVLSNLFRPKRRPIYKSDVEMAHFR

SEQ ID NO: 111 - protein, 511 aa, unidentified
MKCLLYLALLFIGVNCKFTIVFPHNQKGNWKNVPSSYHYCPSSSDLNWHNGLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNDICPTVHNSTTWHSDYKVKGLCDSNLISMDITFFSEDGELSSLGKEGTGFRSNYFAYETGDKACRMQYCKHWGVRLPSGVWFEMADKDLFAAAKFPECPEGSSISAPSQTSVDVSLIQDVERILDYSLCQETWSKIKAGLPISPVDLSYLAPKNPGTGPAFTIINGTLKYFETRYIRVDIAAPILPRMVGTISGTTTERELWDDWAPYEDVEIGPNGVLKTSSGYKFPLYMIGHGMLDSDLHLSSKAQVFEHPHIQDAASQLPDDETLFFGDTGLSKNPIELVEGWFSGWKSSIASFFFIIGLIIGLFLVLRVGIYLCIKLKHTKKRKIYTDIEMNRLGK

SEQ ID NO: 112 - protein, 530 aa, unidentified
MTSSVIISVILLISFITPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRRPKWKKGVERSDSFEMRIFKPNNMRARV

SEQ ID NO: 113 - protein, 530 aa, unidentified
MLSQVTFQLLVVGCLICQAYSSLSIAFPESTKLDWKPVTKNTRYCPMGGEWFLDPGLQEESFPSSTPIGATPSKSDGFLCHAAKWVTTCDFRWYGPKYITHSIHNIKPTRSDCDSALASYKSGTLINPGFPPDSCGYASVTDSEFLVIMITPHHVGVDDYRGHWVDPLFVGGECDQSYCDTIHNSSVWIPADTKKKNICGQSFTPLTVTVAYDKTKDITAGALVFKSKYHSHMEGARTCRLTYCGRTGIKFPNGEWVSLDVKTKIQEKQLLPLFKECPAGTEVRSTLQSDGAQVLTSEIQRLLDYSLCQNTWEKVDRKEPLSPLDLSYLASKSPGKGLAYTVINGTLSFAHTRYVRMWIDGPVLKELKGKRESASGIASDIWTQWFKYGDMEIGPNGLLKTKSGYKFPWHLIGMGIVDNELHELSEANPLDHPQLPHAQSIADDSEEIFFGDTGVSKNPVELVTGWFTSWKESLAAGVVLILTVVLIYGVLRCFPVLCMPCKKPKWKKGVERSDSFEMRIFKPNNMRARV

SEQ ID NO: 114 - protein, 511 aa, unidentified
MKCLLYLAFLFIGVNCKFTIVFPYNQKGNWKNVPSNYHYCPSSSDLNWHNDLIGTALQVKMPKSHKAIQADGWMCHASKWVTTCDFRWYGPKYITHSIRSFTPSVEQCKESIEQTRQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKRWGVRLPSGVWFQMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFFFIIGLIIGLFLVLRVGIYLCIKLKHTKKRQIYTDIEMNRLGK

SEQ ID NO: 115 - protein, 511 aa, unidentified
MKCLLYLALLFIGVNCKFTIVFPHNQKGNWKNVPSGYHYCPSSSDLNWHNGLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNDICPTVHNSTTWHSDYKVKGLCDANLISMDITFFSEEGELSSLGKEGTGFRSNYFAYETGDKACRMQYCKHWGVRLPSGVWFEMADNDLFAAAKFPECPEGSGISAPSQTSVDVSLIQDVERILDYSLCQETWSKIRAGIPISPVDLSYLAPKNPGTGPAFTIINGTLKYFETRYIRVDIAAPILPRMVGTISGTTTERELWDDWAPYEDVEIGPNGVLKTSSGYKFPLYMIGHGMLDSDLRLSSKAQVFEHPHIQDAASQLPDDETLFFGDTGLSKNPIELVEGWFSGWKSSIASFFFIVGLIIGLFLVLRVGIYLCINLRHTKKRKIYTDIEMNRLGK

SEQ ID NO: 116 - protein, 511 aa, unidentified
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFIDGKCSNDICPTVHNSTTWHSDYKVKGLCDSNLISMDITFFSEDGELSSLGKEGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVEIAAPILSRMVGMISGTTTERELWDDWAPYEDVEIGPNGVLRTSSGYKFPLYMIGHGMLDSDLRLSSKAQVFEHPHIQDAASQLPDDETLFFGDTGLSKNPIELVEGWFSGWKSSIASFFFIIGLIIGLFLVLRVSIYLCIKLKHTKKRQIYTDIEMNRLGK

SEQ ID NO: 117 - protein, 511 aa, unidentified
MKCLLYLAFLFIGVNCKFTIVFPHNQKGNWKNVPSNYHYCPSSSDLNWHNDLVGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKKGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERVLWDDWAPYEDVGIGPNGVLRTSSGYKFPLYMIGHGMLDSDLHLSSKAQVFEHPHIQDAASQLPDGETLFFGDTGLSKNPIEFVEGWFSSWKSSIASFFFTIGLIIGLFLVLRVGIYLCIKLKHTKKRQIYTDIEMNRLGT

SEQ ID NO: 118 - protein, 511 aa, unidentified
  VARIANT 3: note = Any amino acid
MKXILYFAFLLVGVNCKFTIVFPHNQKGNWKNVPSSYHYCPSSSDLNWHNGLIGTALQVKMPKSHKAIQADGWMCHASKWVTTCDFRWYGPKYITHSIRSFTPSVEQCRESIEQTKQGIWINPGFPPQSCGYATVTDAEAVIVQVTPHHVLVDEYTGEWVDSQFLNGKGKDDICPTVHNSTTWHSDYKVKGLCDANLISMDITFFSEDGELSSLGKDGTGFRSNYFAYENGDKACRMQYCKHWGVRLPSGVWFEMADKDLFAGAKFPECPDGTSISAPSQTSVDVSLIQDVERILDYSLCQETWSKIKAGLPISPVDLSYLAPKNPGTGPAFTIINGTLKYFETRYIRVDIAAPIIPRMVGTISGTSTERELWDDWYSYEDVEIGPNGVLKTTSGYKFPLYMIGHGMLDSDLHLTSKAQVFEHPHIQDAASQLPDGETLFFGDTGLSKNPIELVEGWFSGWKSSIASFFFVIGLIIGLYLVLRVGIYLCLKLKHTKKRKIYTDIEMNRLGK

SEQ ID NO: 119 - protein, 511 aa, unidentified
MKCLLYLALLFIGVYCKFTTVFPHNKKGDWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSDDICPTVHNSTTWHSDYKVKGLCDSNLISMDITFFSEDGELSSLGKEGTGFRSNYFAYETGDKACKMQYCKHWGVRLPSGVWFEMADKNLFAAAKFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIPDATSQLPDDETLFFGDTGLSKNPIELVEGWFSGWKSSIASFFFIIGLIIGLFFVLRIGVYLCIKLKHTNKRQIYADIEMNRLGK

SEQ ID NO: 120 - protein, 518 aa, unidentified
MAKNSDTMKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 121 - protein, 529 aa, unidentified
MDLFPILVVVLMTDTVLGKFQIVFPDQNELEWRPVVGDSRHCPQSSEMQFDGSRSQTILTGKAPVGITPSKSDGFICHAAKWVTTCDFRWYGPKYITHSIHHLRPTTSDCETALQRYKDGSLINLGFPPESCGYATVTDSEAMLVQVTPHHVGVDDYRGHWIDPLFPGGECSTNFCDTVHNSSVWIPKSQKTDICAQSFKNIKMTASYPSEGALVSDRFAFHSAYHPNMPGSTVCIMDFCEQKGLRFTNGEWMGLNVEQSIREKKISAIFPNCVAGTEIRATLESEGARTLTWETQRMLDYSLCQNTWDKVSRKEPLSPLDLSYLSPRAPGKGMAYTVINGTLHSAHAKYIRTWIDYGEMKEIKGGRGEYSKAPELLWSQWFDFGPFKIGPNGLLHTGKTFKFPLYLIGAGIIDEDLHELDEAAPIDHPQMPDAKSVLPEDEEIFFGDTGVSKNPIELIQGWFSNWRESVMAIVGIVLLIVVTFLAIKTVRVLNCLWRPRKKRIVRQEVDVESRLNHFEMRGFPEYVKR

SEQ ID NO: 122 - protein, 509 aa, unidentified
WGIVGLNAGEVWDPPLFVVPAEGNYSWQPVPLSQLRCPPRYLPFRHEKDAYMSVQTVRFDYDFHSDSGIRGFLCHKVQWSVLCSTNFLNQHSFQYALTPLKVSELECKEALGSYQSIGAVTPHFPSPDCGWMRDSWTEKDFVEITPHSVHYDPYSGMLIDPQFVGGKCRGSPCLCIHNGTIWMGNHEEPQMCRRQLEGLGTLVYDPKGKTKDMMLYGVDIRPISLSGSCRLNFCEREGLRLKTGEFIQIKISNSPMMMDRINVYSQRCAPEVTVGLHTSNSFAQTTDLALLDEEDRLNCIQTSQVIMVSQRASPTQLSYFSPRYPGNGMAYRINMGLLECALVRYVGVYSLPQTKSPPDLLGYSHNKSGLYWKDWVFPNRSTLFKVGPNGLLKKPDGKILIPHIEALFQYYDLAITSFHDIHAIEHPSLKIISNFSDELPVIMRPGGQDESIGGVIGDFFAGLGGKISSFLIGLALLIGLICLAKCLCRCRPGTRKTARVSPGRKSLAR

SEQ ID NO: 123 - protein, 508 aa, unidentified
EMLLFSVTILVLLRHVSGIDILMPDGIPDKWDRALPEDINCPVIFPQADVKTHHLVLEGLTVGSPDIPTVPGYWCVEETWVTTCDFRWYGPRYITKSYYRTLPDTLSCRNSWMSYKIGVPSEKGYPPEECSWNNIIETSEVSISVTPREMQLDPYTQFVVDPSLKAGQCNAVACEGSSGSTIWIRSLTSPPICLTFDRVELSLMGSVRKDGALIFDQKTKIVLPDDSVRKLETGCTLTLCETPGVLFPEGLWVTLVETERLTEISKSLKKCAMGNSIVKSHTGIGHTSHELDWESSIILSLCEDKLERLVLTGALHPRDFSMFTPLHEGPGRMYRVNNSTLEAAQVTFRLSTLLTSPGSEILMYQIKNTTYTWNTWSETGVKNLLHGGNGIYKTSGVWGIFDMKIQTSVLDDFKMIHMMAKTLDHLIVSESPDLNLKKMKPHWSSPPPGGIGEIGFDLWAQTRVMWIGVGVLICALSLGCLIRFAMRLNQSSLRRQNLTQDIPMYGFH

SEQ ID NO: 124 - skipped

SEQ ID NO: 125 - protein, 508 aa, unidentified
GIVGLNAGEVWDPPLFVVPAEGNYSWQPVPLSQLRCPPRYLPFRHEKDAYMSVQTVRFDYDFHSDSGIRGFLCHKVQWSVLCSTNFLNQHSFQYALTPLKVSELECKEALGSYQSIGAVTPHFPSPDCGWMRDSWTEKDFVEITPHSVHYDPYSGMLIDPQFVGGKCRGSPCLCIHNGTIWMGNHEEPQMCRRQLEGLGTLVYDPKGKTKDMMLYGVDIRPISLSGSCRLNFCEREGLRLKTGEFIQIKISNSPMMMDRINVYSQRCAPEVTVGLHTSNSFAQTTDLALLDEEDRLNCIQTSQVIMVSQRASPTQLSYFSPRYPGNGMAYRINMGLLECALVRYVGVYSLPQTKSPPDLLGYSHNKSGLYWKDWVFPNRSTLFKVGPNGLLKKPDGKILIPHIEALFQYYDLAITSFHDIHAIEHPSLKIISNFSDELPVIMRPGGQDESIGGVIGDFFAGLGGKISSFLIGLALLIGLICLAKCLCRCKPGTRKTARVSPGRKSLAR

SEQ ID NO: 126 - protein, 530 aa, unidentified
MTSSVTISVVLLISFITPLYSYLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSLGFPPESCGYASVTDSEFLVIMITPHHVGVDDYRGHWVDPLFVGGECDQSYCDTIHNSSVWIPADQTKKNICGQSFTPLTVTVAYDKTKEIAAGGIVFKSKYHSHMEGARTCRLSYCGRNGIKFPNGEWVSLDVKTRIQEKHLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEPKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 127 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVGFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWGKIEAGEPITPVDLSYLGPKNPGVGPVFTIINSSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGISKNPVELVEGWFSGWRSSIMGVVAVIIGFVILIFLIRLIGVLSSLFRPKRRPIYKSDVEMAHFR

SEQ ID NO: 128 - protein, 511 aa, unidentified
MKCLLYLAFLFIGVNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISTDITFFSEDGELSSLGKEGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSLGYKFPLYMIGHGMLDSDLHLSSKAQVFEHPHIQDAASQLPDDETLFFGDTGLSKNPIEFVEGWFSSWKSSIASFFFIIGLIIGLFLVLRVGIYLCIKLKHTKKRQIYTDIEMNRLGK

SEQ ID NO: 129 - protein, 520 aa, unidentified
LLISFITPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 130 - protein, 512 aa, unidentified
MNFLLLFLVTIPAYSYAKFSIVFPQSQKGSWKNVPATYHYCPSSSDQNWHNDLIGIPMKVKMPKTHKAIQADGWMCHAAKWITTCDFRWYGPKYITHSIHSIQPTSEQCKESIKQTKQGTWINPGFPPQNCGYASVSDSVAVIVQATPHHVLVDEYTGEWIDSQFPNGKCKAEECETIHNSTVWFSDYKVTGLCDATLVDTDITFFSEDGKKESLGKPNTGYRSNYFAYEKGEKVCKMNYCKHAGVRLPSGVWFEFADQDAYTAAKFPECPVGATISAPTQTSVDVSLILDVERILDYSLCQETWSKIRSKQPVSPVDLSYLAPKNPGTGPAFTVINGTLKYFETRYIRIDIDNPIIPKMVGKVGGSHTERELWTEWYPYEDVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILFCVVARIVIAVRYRYQGASNKRIYNDVEMSRFRK

SEQ ID NO: 131 - protein, 511 aa, unidentified
  VARIANT 259: note = Any amino acid
MKCLLYLAFLFIGVNCKFTIVFPHNQKGNWKNVPSNYHYCPSSSDLNWHNDLVGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKKGTGFRSNYFAYETGDKACKMQYCKHWGVRLPSGVWFEMADKXLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERVLWDDWAPYEDVEIGPNGVLRTSSGYKFPLYMIGHGMLDSDLHLSSKAQVFEHPHIQDAASQLPDGETLFFGDTGLSKNPIEFVEGWFSSWKSSIASFFFTIGLIIGLFLVLRVGIYLCIKLKHTKKRQIYTDIEMNRLGK

SEQ ID NO: 132 - protein, 457 aa, unidentified
NTGGYQDVGKHGLRIKSYAPLLRENYTSEGYLCIKTIFITECTENFFGGQTIRYSTESSHISSLECSDAIISWLHGDYQSSEHPAASCSWMRTSAESSVHVDIRFHPVLFDPYEGTKISELFIHGNKAHCLTVKEGMIWMSLDNHLPQCLKETLSPIYVFAREGDKGHYSFWSPDYPLQSAKRICVKEFCGMTGFTFDDGTWIGILKEEIPQNDKLGEYLYKVERCNNQSKISVQPEEILIHSVEHTVFSLFLKKECEKTKERLLNGEALSRIELQTLAPRSPGRYPVYRLLNGSLLQSISDYQWVTVSKSPHRPYISFKTEDNKKIEWLYWSHNSLLNLTDGPNGLYIRGDNLVFPGKTISDYEHMLQNSIKQRMEISHANIMRMPYNQRYHIHLFPHFNDTSLTEVISNTFSFKFWTGHLSLIGFGLLIIFILYKLVVMRIKYRQESIVRYDPAN

SEQ ID NO: 133 - protein, 530 aa, unidentified
MLSQVTLQAFVVMCLIYRAYSSLSIAFPESTKLDWKPVTKNTRYCPMGGEWFLEPGLQEESFLSSTPIGATPSKSDGFLCHAAKWVTTCDFRWYGPKYITHSIHNIKPTRSDCDSALASYKSGTLINPGFPPDSCGYASVTDSEFLVIMITPHHVGVDDYRGHWVDPLFVGGECDQSYCDTIHNSSVWIPADTTKKNICGQSFTPLTVTVAYNRTKDISAGALVFKSKYHSHMEGARTCRLTYCGRTGIKFPNGEWVSLDTKTKIQEKQLLPLFKECPAGTEVRSTLQSDGAQVLTSEIQRLLDYSLCQNTWEKVDRKEPLSPLDLSYLASKSPGKSLAYTVINGTLSFAHTRYVRMWIDGPVLKELKGKRESASGIASDIWTQWFKYGDMEIGPNGLLKTKSGYKFPWHLIGMGIVDNELHELSEANPLDHPQLPHAQSIADDSEEIFFGDTGVSKNPVELVTGWFTSWKESLAAGVVLILTVVLIYGVLRCFPVLCMPCRKTKWKKGVERSDSFEMRIFKPNNMRARV

SEQ ID NO: 134 - protein, 492 aa, unidentified
MMFTCLFVLLMSLIGLEQVAESVLMPEIIPDKWDKTLPEDIHCPTVFPQLDVSQGLLKVEGLTVGSPDIPTVTGYWCIEEVWVTSCDFRWYGPRYINKEYYRNTPSVSECKASWDSHSMGVPTDKGYPPEVCSWNNIVETTQTSITVTPREMHLDPYTQYVVDPALKSGKCNELICPGSTGANIWIRSVRAQPICLKFDKIDLYLKNSVRSDGALVIGSGTSVILQDGSVRKLETGCIMSLCGSKGLLFPEGLWITIIETERLHEAAKDLTFCEEVKSVVKSHTGIGHYSHEIEWESSILMSICEDKLERLKTKGIIHPRDFSLFTPLHEGPGRMYRVNMGTLESTQVNYKMAELMSEPGSSDLKYSIGNSSHNWNSWTRTGIPGLLHGGNGIYKSRTGWGIYDLNIQSSVIEDFKMLEMSAKTLPHINVTTKPVIGLRGLKPHWSSPPAGGIGEMGLDLALSIKLFVTLLGVVLLLILIVVIFKVVMSTRT

SEQ ID NO: 135 - protein, 519 aa, unidentified
EPLLIQLLLLLGHSGAQLLFPLPVGDSPFKIIPEMMSCDIPFPVEENKHLIKVSISSRVPRLAKSSQSGFLCTTESWVSKCEEGFFGSDSKTFNIYSIPMDSSACRDAIRKYREGTYRQPLKPNFDCSWMATNSNPIRQVIVKEHSVKFDHYDFSYKDPLFLHGSCKKSECSTRFDNILWVSDDKLPPTCPESVLEEITLYYDSSNDTSSNVHIGGEFTTFETLEGACQGLKYCGESYIVTKQRQGFQINGSLEDQVKSILNKLPLCSSLNLAPLDTVSEEKHQEIDLSQTLKLERCLDVVERFKNHPKNVQFSRRDLGFLAPLYPGPGIAYLIDNGTVKGINVVYEQLKNIDVECDAIQKTCNIMGMSPESNDLKVEIKCLNDFIDQRNEFLCDWVNGLILTRGGFLDPTHGLVDKVIRDTFLMEHEVSLDRHILLDDNEESHISEYWDLPTQKSPDFTLGIPELWTWIRWASGTIAVCLILYIAIRLIFALRKQARKHKEGRKLNRSYIRSLDEMEV

SEQ ID NO: 136 - protein, 496 aa, unidentified
VLKMLRWLMAFHATSLACCLLLPADLSHASWKIIESSNLDCSKSLSLDFHPDCDQMEATYETIPYDTPTEVVAHGFLCHKFTLETICSENFFGQQSIQRKTYPTKIGVGECFDKLSEFRRGDSINDSPLEHPLPDCNWMKVSSTFSKRIKMEPHKVTYNVYDRSYISEIFLRGVCKHPLCKTISDSSTWIHSPEETVCKPLVQYKGTFWVHRNKGRICGYENEAGLRIGFDNYCEVSYCGHKGIMNEQGIFLKIDIANLYHRPHCDTARVLRHVDSRLAIQEVQLSEKVQLAIRSCQLARQVISDKKSLNSEMLGYFHPITPGVFPMYKYENETLYETVVPYLEELSILTMDSPVSEGEKAKRPKNRTARIWNQAFQQSPCRQDIYLNGIRMDSLCNPVIPFSITGLNYEQEEGLIMRNLIDIARPEEVILKRQMNISKTSTGWHSSKFDLENYSWGWKNWKNILGMTVGAILILSCCCCCLLRRKGKRATSGPVE

SEQ ID NO: 137 - protein, 501 aa, unidentified
IMFHIFLSLVITLKVLASVFGLDVLFPTSPILKWSMANLSNINCNTGGYQDVGKHGLRIKSYAPLLRENYTSEGYLCIKTIFITECTENFFGGQTIRYSTESSHISSLECSDAIISWLHGDYQSSEHPAASCSWMRTSAESSVHVDIRFHPVLFDPYEGTKISELFIHGNKAHCLTVKEGMIWMSLDNHLPQCLKETLSPIYVFAREGDKGHYSFWSPDYPLQSAKRICVKEFCGMTGFTFDDGTWIGILKEEIPQNDKLGEYLYKVERCNNQSKISVQPEEILIHSVEHTVFSLFLKKECEKTKERLLNGEALSRIELQTLAPRSPGRYPVYRLLNGSLLQSISDYQWVTVSKSPHRPYISFKTEDNKKIEWLYWSHNSLLNLTDGPNGLYIRGDNLVFPGKTISDYEHMLQNSIKQRMEISHANIMRMPYNQRYHIHLFPHFNDTSLTEVISNTFSFKFWTGHLSLIGFGLLIIFILYKLVVMRIKYRQESIVRYDPAN

SEQ ID NO: 138 - protein, 497 aa, unidentified
MSAQIGTSFINMKDTTTDLFYGPTSTIIHWAPLYPPVIPCNKRPIPEQDRLLPKKMTGTKLAHITNSTAHGYLCTKAIWTVTCAEGFFGGRTLTHKIHPTLPSLSECQDTVRLYKTNHHTGFGFPVERCGWMGTNTESAVNIQISESFIHVDPYSQKYIDARFIGGSCGEPPCKLNTLDTLWMNTSTVPKMCLQRTKIDIFIKNMNTTEFYSNDLVATTLDGACHLKVCGERGIRLVTGEWMNIMAKTTIEADWFKTLENCPTLSEIQDVSLKGIMNHMEGQLLMDDSYRLCIEAKEKFMTGEVTTRFDIARIAPAVPIGGPVYRKNGDRVEVGYSEYSLLRSPDNALVGSNPDVIGYDTVSHKPVIWRYWTQTNNTIREGPNGITSVGRYLINPLVSLTTPGLYRQILEQDFDPPIHHPNIYEGPLGHTLDIEFDPKNSPKELTKIIHHWWETWSFTRWFWILLGCVVSISVLSFLVKCSIARRRRAEQIPVIYQA

SEQ ID NO: 139 - protein, 479 aa, unidentified
RPLFLVPTSLHTNWTPIMPSSLICPPFSENEPRDVIYSVPVAYQVAEDHPELKPVKGFLCSAVDYIVHCSEGFFGTKTITKRISHQPAEQGPCMEAREKHNVGTDNSPYFPAPSCSWMSEQESKLSFMLTTSHDLLYDAYNGRWVDGIFPQDGCSTSVCATTHAGTLWIVEEGREFYCPHLGVHTGIHYMREDRTVTHIRLMDRTFSTSGACTMTYCGRTGTRFSNGLFYHPSVPITSTPCRPDQTISFLPQSITSQQLEVDLEDVRDRSECLNAHTQIMLTNKTTFNLLSKFNPHYTGTNWAYRMSEGVLQRALASWTAVVSFNTSGLSTIGMSPKKQPVTWKVWVPSGVTGMLSGFNGVHYVEASRRVVIPDMEKFKSNYADSLNAVHEILPIPHPAAKHYKNYNMSEDDKVLIESNSVDISGWIGNALDTLEGKIVGGIIGIIILIISVKVLLVCIPKCRRRRERDQEALPLQVRP

SEQ ID NO: 140 - protein, 524 aa, unidentified
MTSSVTISVVLLISFITPLYSYLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSLGFPPESCGYASVTDSEFLVIMITPHHVGVDDYRGHWVDPLFVGGECDQSYCDTIHNSSVWIPADQTKKNICGQSFTPLTVTVAYDKTKEIAAGGIVFKSKYHSHMEGARTCRLSYCGRNGIKFPNGEWVSLMLKLRSKRNLYFPCLKMCPTGIRGEIYPSIRWAQVLTSEIQRILDYSLCQNTWDKVERKEPLSPLDLSYLASKSPGKGLAYTVINGTLSFAHTRYVRMWIDGPVLKEPKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGSCPDLRCPPLFPGIVYYLQKAQMEERGERSDSFEMRIFKPNNMRARV

SEQ ID NO: 141 - protein, 514 aa, unidentified
NKYYWILFLCYFQLGSVSSMMAFPIESNNTLIPVLSDKLRCPVGHLHLAPTAEIQHKVILSIPNRPEISSVKGYLCHKYRLITECDYGCLSGKQLRFKTQNVKITEEECKSEISSYLLGNIALLEHPAPLCSWCGVQESVKDLIIVKPHYVKLDPYSSELIDLLFVGGKTLEPSSKTIYDAVYWIAENDHFLDLACPTFVNHTGIIYSIDSDTTANEYSDSHRLWSDRFREKSFKGACKKKFCGLVGVRFGDGEWLKIYYKKEEDFAKDQWYKNLPACSEDQTIRLANPYSTDQHAIDSVLALIFFGKCLDSISKLRNNGKLSPLDISYLAQVYPGYGPYYIMTDQGLMMGTATYQLIKPYNANKISNQIGTTLSNESVTFSDWHKVGNILHGPNRIIKVNGIIRFPDFMGMRSIMEEELTQEVDHAVIRKASAKSLSDTILQSNTEFRHPIDQVNIVNVTSEKLEEMMDGLAPNWHLWVSILLACFISKKERRPRIISQSPRVTEQIEMVDWF

SEQ ID NO: 142 - protein, 524 aa, unidentified
MESLPFSALLAVLSITLCDSAIPIFFPSEPQLEWKPVLPGSRYCPQSNEMSLDPDLKKSTISVKVPIGVTPSKSDGYLCHGAKWVSTCDFRWYGPKYITHSIHNLRPTTNDCEDAIKKYEAGTLINPGFPPDSCAYATVTDSEHLVILITPHHVGVDDYRGAWVDDSFPSGVCETNQCDTTHNSSIWIPKTKTRHNICSQTFANLSVTISYREGGAMKGADMVFHSKYHPHMVGGHICKMNFCNKQGLRLQNEEWIEIPSGTKVGNQDLMNLFSDCKSGLEVRSTLRSEGANTLTWETQRLLDYALCQNTWDKFDNQGAVSALDLSYLAARAPGKGVAYTMINGTLHSAPTRYVRMWIESPSMEELKAKKESSSGVETSIWNQWFPFKGGEIGPNGLIKAGNKYKFPLYLVGMGMLDDEINALELGGPIDHPQRAHAQAVLGDEETLFFGDTGVGKNPVELITGWFSGWKETIMAVVAIFLLVIVLYGVLRCCPTICVLCKRKSRHRTKDMEMQYIPNNQRHWR

SEQ ID NO: 143 - protein, 511 aa, unidentified
MKCLLYLAFLFIGVNCKFTIVFPHNRKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLFLVLRVGIYLCIKLKHTKKRQIYTDIEMNRLGK

SEQ ID NO: 144 - protein, 498 aa, unidentified
MNCKFTIVFPHNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 145 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYLGPKNPGVGPVFTVINGSLHYFTSKYLRVELESPVIPRMEGRVAGTRIVRQLWDQWFPFGKAEIGPNGVLKTKQGYKFPLHIIGTGEVDSDIKMERIVKHWEHPHIEAAQTYLKKDDTEEVIYYGDTGVSKNPVELVEGWFSGWRSSIMGVVAVIIGFVILIFLIRLIGVLSSLFRPKRRPIYKSDVEMAHFR

SEQ ID NO: 146 - protein, 506 aa, unidentified
MINVVQFLELILCAQAAKIILPVHLESEWVPVHFGERICQSNREKIPNGIYSSLKIEGKVPVRQRSEGADGYYCHKTVYSVLCDFKWYGVKKLRHSVKRDMPSYGDCLKAIDDMETGLNEYIGFPPPSCNYLVETRSQNTEVILSKHQVKIDDYKQSWMDSTFVDGGCRKAPCLTTIPGTLWIPSSNLTAACDISFKTQEFTVYYPKIKPQTLSSDHIFITSPYHPVSSLSKSCEITLCNKKGIRLPGGSWTEMGSHTSFHGIKVDTLLPKCQSSVEIYATPPDLKNLRMIWDLEKVIENTLCQATWDKIETRQKITPLDLNYLSPSEPGPGWGFLPRNGSMYKAQILYIRAEVEGDTVALHQRYNKEKEDFYFEWNDWEMLDGIRIGPNGIITNGTHVKVPYYSVGIGKLDEEMMIPQQIEIIHHIDHLKQRIPAQSNLDRTWIHEGENGDIITSVSHWWHDILMHSWELFASLGGLCVLFCMCSCCLNRRRGRKTRHQEAMSFV

SEQ ID NO: 147 - protein, 511 aa, unidentified
MKCLLYLAFLFIGVNCKFTIVFPHNQKGTWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNDICPTVHNSTTWHSDYKVKGLCDSNLISTDITFFSEDGELSSLGKGGTGFRSNHFAYETGDKACKMQYCRHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIELVEGWFSGWKSSIASFFFIIGLIIGLFLVLRVGIYLCIKLKHTKKRQIYTDIEMNRLGK

SEQ ID NO: 148 - protein, 505 aa, unidentified
TLTHIIIQSHKSYGFFLVNETSNFIIAPIHQKSEYQKIDKFHIQCPLDYQDVPVPLGHIKRMIKISTPYAAEPKLELGQLCSKQSWVSTCSESFFGLQTIKFSIETKPITVSECQTAINQLRDNTLISPYRPVPDCAWMKDNVENRKDFIVVKDYSVNHDSYKNNFVNPLFQSGHCESSICPSINPSEIWISKSGTLPTCKSIRDSYATLSMPQDKNDKTASYLSSHYFPTVSLRDLCFIEYCGHIMFMTTTGVIFRYSNEDRIPLFSVGKCDSTRKVEVPRAGSQSLVGEIKVEHLMRWERCINVKERILNAQPVSNYDLSAFTPLLPGSYPGYKIEKGIIYQASFDYSLISVPRESRENVYGLFSNLNTVKMFDSKCVNSTNCTLINGIEKVNGKYKFPYITILENQLDQSLLKEKEIYEEVPHMIAHAITSSGDKLLTDFHFTQGKTVGNVLTDFGQSIGEKLIKGGIYLLSFFVILLIIYVIFRRCCLRSGNLKAASPFEN

SEQ ID NO: 149 - protein, 506 aa, unidentified
EMFLFSVTILVLFGHVSGIDILMPDGIPDKWDRALPEDINCPVIFPQADVKTHHLVLEGLTVGSPDIPTVPGYWCVEETWVTTCDFRWYGPRYITKSYYRTLPDTSSCRNSWLSYQIGVPSEKGYPPEECSWNNIIETSEVSISVTPREMQLDPYTQFVVDPSLKAGQCNAAACEGSSGSTIWIRSLTSPPICLTFDRVELSLMGFVRKDGALIFDQRTKIVLPDESVRNLETGCMLTLCETPGVLFPEGLWVTLVETERLTEISKSLKKCPMGNAVVKSHTGIGHTSHELDWESSIILSLCEDKLERLVMTGALHPRDFSMFTPLHEGTGRMYRVNNSTLESAQVTFRLSTLLTSPGSDILMYQIKNTTYTWNTWSETGVKNLLHGGNGIYKTSGVWGIFDMKIQTSVLDDFKMIHMTAKTLDHLIVSELPDLNLKKMKPHWSSPPPGGIGEIGFDLWVQTRVMWIGVGVLICILILGCVIRFAMHLNQSSLRGQNLPQEIPMYG

SEQ ID NO: 150 - protein, 523 aa, unidentified
MLYETIFVDPVIPRDMNIVIPILNLTTWSLINPGNLSCPQLIDHSYNEKSIVVPIKIKYPQFQNNDEKVPGYLCSCYDLITSCTETWLWSTSITYKSVTNQCTINECLEQVNRHKKGQISSETYPREECVYAKTNDCTNQVIHVTEHTSLLDPYTGQVHDEIFFTGRTTEKSTQTIYDGTLWIREPDFNPITLCQHWNEMDGNLILPHNWDERENIIEVGKIWSDEMKAYSLNTGCSIKYCGAPGIMFPDNFWVNLNITDDQHVNKLIKMYPERVCPRDSTIALPNRNHDLLYSELSTMGKIYLMKCHETISKIRMNVSITPYEISFLSQTTPGIGRMYRLGNHGIYQSIGKYISINPLYRDGSKNILGRTYKGSNVSFENWWIVGGISHGLGGTIRTTNNEIIYPSDLILRTKVSSELLHSRYLHILNHPLDHVIMSKLNLSLPLQLTHDGSVNDFQEIDSLLRKQGNTLLSKLKFYWGKVNATVYFLFFCVSSMLIIKVFKIYSERKKDVPLQNVEIPLQS

SEQ ID NO: 151 - protein, 511 aa, unidentified
MKCLLYLALLFIGVNCKFTIVFPHNQKGNWKNVPSGYHYCPSSSDLNWHNGLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNDICPTVHNSTTWHSDYKVKGLCDANLISMDITFFSEEGELSSLGKEGTGFRSNYFAYETGDKACRMQYCKHWGVRLPSGVWFEMADNDLFAAAKFPECPEGSSISAPSQTSVDVSLIQDVERILDYSLCQETWSKIRAGIPISPVDLSYLAPKNPGTGPAFTIINGTLKYFETRYIRVDIAAPILPRMVGTISGTTTERELWDDWAPYEDVEIGPNGVLKTSSGYKFPLYMIGHGMLDSDLRLSSKAQVFEHPHIQDAASQLPDDETLFFGDTGLSKNPIELVEGWFSGWKSSIASFFFIVGLIIGLFLVLRVGIYLCINLRHTKKRKIYTDIEMNRLGK

SEQ ID NO: 152 - protein, 530 aa, unidentified
MNWIYIYSTCLIMWLKEGIIKSESFYYPTTKSMSWSPVAYNRLICPQMATEYTPGLHTILDYVRVSRPIYHDHKTLPGFLCRKLSLITRCETNWLMSSSVNNIIQGMKVTSSECVEAVKDYDKGIQNLEDFKTPVCVWSKVNDVINTVYKIIPHNVKIDPYNNQFLDPLFAGGKTDLLISSTIHDDMIWLSKDQNRSEGCTDHEEDEGFIYISNTKLPSQPGQPVVFLHVEGHKDKTMENACLYNYCGNQGVLFSDGEWMSVEFLSKQTQDQEHPFVDLKPCQGEKTVGLTSPHLNQLLNYDITMEAMYRLKCEDVLSKLINNIPISPYDISFLTQSHPGPGIVFQLRDKVLMQAQGYYSKINVPVQSLGENIVGILSNGTNFVETRWFLSKDNISHGLNGLIKINNTLIFPHEVFRRGHIHESLLSHQELIRVSHPTVMEFSGLINRTDLEYGYKSSNPDLAQLLRETSKRISTWWDRIFTLSIFIKLIIVFGLVILACFFLYKLLKSLRLGDKRRSIPKVESMSSLRS

SEQ ID NO: 153 - protein, 512 aa, unidentified
MNFLLLFLVTIPAYSYAKFSIVFPQSQKGNWKNVPATYHYCPSSSDQNWHNDLIGIPMKVKMPKTHKAIQADGWMCHAAKWITTCDFRWYGPKYITHSIHSIQPTSEQCKESIKQTKQGTWINPGFPPQNCGYASVSDSVAVIVQATPHHVLVDEYTGEWIDSQFPNGKCKAEECETIHNSTVWFSDYKVTGLCDATLVDTDITFFSEDGKKESLGKPNTGYRSNYFAYEKGEKVCKMNYCKHAGVRLPSGVWFEFADQDAYTAAKFPECPVGATISAPTQTSVDVSLILDVERILDYSLCQETWSKIRSKQPVSPVDLSYLAPKNPGTGPAFTVINGTLKYFETRYIRIDIDNPIIPKMVGKVGGSHTERELWTEWYPYEDVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILFCVVARIVIAVRYRYQGASKKRIYNDVEMSRFRK

SEQ ID NO: 154 - protein, 512 aa, unidentified
MLRLFLFCFLALGAHSKFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNYFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 155 - protein, 523 aa, unidentified
MTSVLFMVGVLLGAFGSTHCSIQIVFPSETKLVWKPVLKGTRYCPQSAELNLEPDLKTMAFDSKVPIGITPSNSDGYLCHAAKWVTTCDFRWYGPKYITHSVHSLRPTVSDCKAAVEAYNAGTLMYPGFPPESCGYASITDSEFYVMLVTPHPVGVDDYRGHWVDPLFPTSECNSNFCETVHNATMWIPKDLKTHDVCSQDFQTIRVSVMYPQTKPTKGADLTLKSKFHAHMKGDRVCKMKFCNKNGLRLGNGEWIEVGDEVMLDNSKLLSLFPDCLVGSVVKSTLLSEGVQTALWETDRLLDYSLCQNTWEKIDRKEPLSAVDLSYLAPRSPGKGMAYIVANGSLMSAPARYIRVWIDSPILKEIKGKKESASGIDTVLWEQWLPFNGMELGPNGLIKTKSGYKFPLYLLGMGIVDQDLQELSSVNPVDHPHVPIAQAFVSEGEEVFFGDTGVSKNPIELISGWFSDWKETAAALGFAAISVILIIGLMRLLPLLCRRRKQKKVIYKDVELNSFDPRQAFHR

SEQ ID NO: 156 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIITVTPHSVKVDEYTGEWIDPHFIGGRCKGKICETVHNSTKWFTSSDGESVCSQLFTLVGGTFFSDSEEITSMGLPETGIRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYLGPKNPGVGPVFTVINGSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGVSKNPVELVEGWFSGWRSSIMGVVAVIIGFVILIFLIRLIGVLSSLFRPKRRPIYKSDVEMAHFR

SEQ ID NO: 157 - protein, 506 aa, unidentified
MINVIQFLELILCAQAAKIILPVHLESEWVPVHFGERICQSNREKIPNGIYSSLKIEGKVPVRQRSEEADGYYCHKTVYSVLCDFKWYGVKKLRHSVKRDVPSYGDCLKAIDDMETGLNEYIGFPPPSCNYLVETRSQNTEVILSKHQVKIDDYKQSWMDSTFVDGGCRKAPCLTTIPGTLWIPSSNLTAACDISFKTQEFTVYYPKIKPQTLSSDHIFITSPYHPVSSLSKSCEITLCNKKGIRLPGGSWTEMGSHTSFHGIKVDTLLPKCQSSVEIYATPPDLKNLRMIWDLEKVIENTLCQATWDKIETRQKITPLDLNYLSPSEPGPGWGFLPRNGSMYKAQILYIRAEVEGDTVALHQRYNKEKEDFYFEWNDWEMLDGIRIGPNGIITNGTHVKVPYYSVGIGKLDEEMMIPQQIEIIHHIDHLKQRIPAQSNLDRTWIHEGENGDIITSVSHWWHDILMHSWELFASLGGLCVLFCMCSCCLNRRRGRKTRHQEAMSFV

SEQ ID NO: 158 - protein, 511 aa, unidentified
MKCLLYLAFLFIGVNCKFTIVFPHNRKGNWKNVPSNYHYCPSSSDLNWHNDLIGTALQVKMPKSHKAIQADGWMCHASKWVTTCDFRWYGPEYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKHWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPFEDVEIGPNGVLRTSSGYKFPLYMIGHGMLDSDLHLSSKAQVFEHPHIQDAASQLPDDETLFFGDTGLSKNPIEFVEGWFSSWKSSIASFCFIIGLIIGLVLVLRVGIYLCIKLKHTKKRQIYTDIEMNRLGK

SEQ ID NO: 159 - protein, 512 aa, unidentified
MLRLFLFCFLALGAHSKFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 160 - protein, 511 aa, unidentified
MKCLLYLAFLFIGVNCKFTIVFPYNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKRWGVRLPSGVWFEMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 161 - protein, 556 aa, unidentified
MISITFVYLIIILSLSWGEMMIPFPDVTTTTWKPVLKGEHHCPSSSDVDILSRMSTLKLQVRIPTGSVASKSDGLLCHGAKWVTTCDFRWYGSKYITHSLHSIRPTLSQCTEAAKAYKEGRLMAPGFPPESCGWNSVTDSELLSILVTPHHTGVDDYRGIWIDSMFPGGECKEMVCDTVQGHTIWMSTSNLTTACGVAFKQIQGQFYYLNSGHQPNKEGTFFHSPNHPNSPLSTACRKKYCNQEGIVIHTGEWIGVPWNTRIRDVQLDSYTDLCAESTEIKSTIGSAPIRVIAWEMERVMDFALCQTVWDKVNRGDPLSPLDLSYLSSRAPGKGLAYTIINETLHVAHVRYIRTYIKAPIMEEIKGSRGDRSAAESVLWTQWFPYGDGEIGPNGLLKTNGSFKFPFYLVGMGAIDDDLIELSNADPIDHPQKAIASVHLNTDEELFFGNTGSDSNPVEAVEGWFASWKSAGINMALIVLCVLLVLIFLRSLPALIKLIHRYRVSRSRQTDVELNSINETARTGSVGPDIIPGAWRVHDSGVRQSQFFRNNPRRLGP

SEQ ID NO: 162 - protein, 517 aa, unidentified
MLSYLILAIIVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGKICETVHNSTKWFTSSDGESVCSQLFTLVGGTFFSDSEEITSMGLPETGMRSNYFPYISTEGICKMPFCRKPGYKLKNDLWFQITDPDLDKTVRDLPHIKDCDLSSSIITPGEHATDISLISDVERILDYALCQNTWSKIEAGEPITPVDLSYLGPKNPGVGPVFTVINGSLHYFTSKYLRVELESPVIPRMEGRVAGTRIVRQLWDQWFPFGEAEIGPNGVLKTKQGYKFPLHIIGTGEVDSDIKMERIVKHWEHPHIEAAQTYLKKDDTEEVIYYGDTGVSKNPVELVEGWFSGWRSSIMGVVAVIIGFVILIFLIRLIGVLSSLFRPKRRPIYKSDVEMAHFR

SEQ ID NO: 163 - protein, 530 aa, unidentified
MTSSVIISVILLISFITPSYSSLSIAFPENTKLDWKPVTKNTRYCPMGGEWFLEPGLQEESFLSSTPIGATPSKSDGFLCHAAKWVTTCDFRWYGPKYITHSIHNIKPTRSDCDTALASYKSGTLVSPGFPPESCGYASVTDSEFLVIMITPHHVGVDDYRGHWVDPLFVGGECDQSYCDTIHNSSVWIPADQTKKNICGQSFTPLTVTVAYDKTKEIAAGAIVFKSKYHSHMEGARTCRLSYCGRNGIKFPNGEWVSLDVKTKIQEKPLLPLFKECPAGTEVRSTLQSDGAQVLTSEIQRILDYSLCQNTWDKVERKEPLSPLDLSYLASKSPGKGLAYTVINGTLSFAHTRYVRMWIDGPVLKEMKGKRESPSGISSDIWTQWFKYGDMEIGPNGLLKTAGGYKFPWHLIGMGIVDNELHELSEANPLDHPQLPHAQSIADDSEEIFFGDTGVSKNPVELVTGWFTSWKESLAAGVVLILVVVLIYGVLRCFPVLCTTCRKPKWKKGVERSDSFEMRIFKPNNMRARV

SEQ ID NO: 164 - protein, 511 aa, unidentified
MKCLLYLALLFIGVNCKFTIVFPHNQKGNWKNVPSGYHYCPSSSDLNWHNGLIGTALQVKMPKSHKAIQADGWMCHASKWVTTCDFRWYGPKYITHSIRSFTPSVEQCKESIEQTKQGTWLNPGFPPQSCGYATVTDAEAVIVQVTPHHVLVDEYTGEWVDSQFINGKCSNDICPTVHNSTTWHSDYKVKGLCDANLISMDITFFSEDGELSSLGKEGTGFRSNYFAYETGDKACRMQYCKHWGVRLPSGVWFEMADKDLFAAAKFPECPEGSSISAPSQTSVDVSLIQDVERILDYSLCQETWSKIGAGLPISPVDLSYLAPKNPGTGPAFTIINGTLKYFETRYIRVDIAAPILPRMVGTISGTTTERELWDDWAPYEDVEIGPNGVLKTSSGYKFPLYMIGHGMLDSDLHLSSKAQVFEHPHIQDAASQLPDDETLFFGDTGLSKNPIELVEGWFSGWKSSIASFFFIVGLIIGLFLVLRVGIYLCINLRHTKKRKIYTDIEMNRLGK

SEQ ID NO: 165 - protein, 511 aa, unidentified
MKCLLYLAFLFIGVNCKFTIVFPYNQKGNWKNVPSNYHYCPSSSDLNWHNDLIGTALQVKMPKSHKAIQADGWMCHASKWVTTCDFRWYGPKYITHSIRSFTPSVEQCKESIEQTKQGTWLNPGFPPQSCGYATVTDAEAAIVQVTPHHVLVDEYTGEWVDSQFINGKCSNDICPTVHNSTTWHSDYKVKGLCDSNLISMDITFFSEDGELSSLGKEGTGFRSNYFAYETGDKACKMQYCKRWGVRLPSGVWFGMADKDLFAAARFPECPEGSSISAPSQTSVDVSLIQDVERILDYSLCQETWSKIRAGLPISPVDLSYLAPKNPGTGPVFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDETLFFGDTGLSKNPIEFVEGWFSSWKSSIASFFFIIGLIIGLFLVLRVGIYLCIKLKHTKKRQIYTDIEMNRLGK

SEQ ID NO: 166 - protein, 511 aa, unidentified
MNPAFVLCMLLAGSSWAKFAIVFPQSQKGEWKDVPPNYRYCPSSADQNWHGDLLGVNIRAKIPKAHKAIKADGWMCHAAKWITTCDYRWYGPQYITHSIHSFVPTQAQCEESIKQTKEGVWINPGFPPKNCGYASISDAESVIVQATAHTVMIDEYSGDWLDSQFPTGRCKETICETIHNSTLWYADYKVTGLCDSALVSTEVTFYSEDGLVTSIGRQNTGYRSNYFPYEKGAAACRMKYCTYDGIRLPSGVWFEMVDKELLDSAQMPECQAGLTISAPTQTSVDVSLILDVERMLDYSLCQETWSKVHNGQPISPVDLGYIAPKNPGAGPAFTIINGTLKYFDTRYLRIDIDGPVLKKMAGKISGTLTERELWTEWFPYEDVEIGPNGVLKTPEGYKFPLYMIGHGLLDADLQKTSQAEVFHHPQIAEAIKKLPDDETLFFGETGISKNPVELIEGWFSNWRSSVMAVVFAIALLVVLVLIVRIIVAFRHSCCRRQRKIYDDLEMNQLRK

SEQ ID NO: 167 - protein, 512 aa, unidentified
MNFLLLFLVTIPAYSYAKFSIVFPQSQKGNWKNVPATYHYCPSSSDQNWHNDLIGIPMKVKMPKTHKAIQADGWMCHAAKWITTCDFRWYGPKYITHSIHSIQPTSEQCKESIKQTKQGTWINPGFPPQNCGYASVSDSVAVIVQATPHHVLVDEYTGEWIDSQFPNGKCKAEECETIHNSTVWFSDYKVTGLCDATLVDTDITFFSEDGKKESLGKPNTGYRSNYFAYEKGEKVCKMNYCKHAGVRLPSGVWFEFADQDAYTAAKFPECPVGATISAPTQTSVDVSLILDVERILDYSLCQETWSKIRSKQPVSPVDLTYLAPKNPGTGPAFTVINGTLKYFETRYIRIDIDNPIIPKMVGKVGGSHTERELWTEWYPYEDVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILFCVVARIVIAVRYRYQGASKKRIYNDVEMSRFRK

SEQ ID NO: 168 - protein, 341 aa, unidentified
  VARIANT 178: note = Any amino acid
MALKEGLRAWKRIFWRQILLTLGLLGLFLYGLPKFRHLEALIPMGVCPSATMSQLRDNFTGALRPWARPEVLTCTPWGAPIIWDGSFDPDVAKQEARQQNLTIGLTIFAVGRYLEKYLERFLETAEQHFMAGQSVMYYVFTELPGAVPRVALGPGRRLPVERVARERRWQDVSMARMXRTLHAALGGLPGREAHFMFCMDVDQHFSGTFGPEALAESVAQLHSWHYHWPSWLLPFERDAHSAAAMAWGQGDFYNHAAVFGGSVAALRGLTAHCAGGLDWDRARGLEARWHDESHLNKFFWLHKPAKVLSPEFCWSPDIGPRAEIRRPRLLWAPKGYRLLRN

SEQ ID NO: 169 - protein, 353 aa, unidentified
MSKPPDLLLRLLRGAPRQRVCTLFIIGFKFTFFVSIMIYWHVVGEPKEKGQLYNLPAEIPCPTLTPPTPPSHGPTPGNIFFLETSDRTNPNFLFMCSVESAARTHPESHVLVLMKGLPGGNASLPRHLGISLLSCFPNVQMLPLDLRELFRDTPLADWYAAVQGRWEPYLLPVLSDASRIALMWKFGGIYLDTDFIVLKNLRNLTNVLGTQSRYVLNGAFLAFERRHEFMALCMRDFVDHYNGWIWGHQGPQLLTRVFKKWCSIRSLAESRACRGVTTLPPEAFYPIPWQDWKKYFEDINPEELPRLLSATYAVHVWNKKSQGTRFEATSRALLAQLHARYCPTTHEAMKMYL

SEQ ID NO: 170 - protein, 672 aa, unidentified
MSKEERPGREEILECQVMWEPDSKKNTQMDRFRAAVGAACGLALESYDDLYHWSVESYSDFWAEFWKFSGIVFSRVYDEVVDTSKGIADVPEWFKGSRLNYAENLLRHKENDRVALYIAREGKEEIVKVTFEELRQEVALFAAAMRKMGVKKGDRVVGYLPNSEHAVEAMLAAASIGAIWSSTSPDFGVNGVLDRFSQIQPKLIFSVEAVVYNGKEHNHMEKLQQVVKGLPDLKKVVVIPYVSSRENIDLSKIPNSVFLDDFLATGTSEQAPQLEFEQLPFSHPLFIMFSSGTTGAPKCMVHSAGGTLIQHLKEHLLHGNMTSSDILLCYTTVGWMMWNWMVSLLATGAAMVLYDGSPLVPTPNVLWDLVDRIGITVLVTGAKWLSVLEEKAMKPVETHSLQMLHTILSTGSPLKAQSYEYVYRCIKSSILLGSISGGTDIISCFMGHNFSLPVYKGEIQARNLGMAVEAWNEEGKAVWGESGELVCTKPIPCQPTHFWNDENGNKYRKAYFSKFPGIWAHGDYCRINPKTGGIVMLGRSDGTLNPNGVRFGSSEIYNIVESFEEVEDSLCVPQYNKYREERVILFLKMASGHAFQPDLVKRIRDAIRMGLSARHVPSLILETKGIPYTLNGKKVEVAVKQIIAGKAVEQGGAFSNPETLDLYRDIPELQGF

SEQ ID NO: 171 - protein, 407 aa, unidentified
MWDLALIFLAAACVFSLGVTLWVICSHFFTVHIPAAVGHPVKLRVLHCIFQLLLTWGMIFEKLRICSMPQFFCFMQDLPPLKYDPDVVVTDFRFGTIPVKLYQPKASTCTLKPGIVYYHGGGGVMGSLKTHHGICSRLCKESDSVVLAVGYRKLPKHKFPVPVRDCLVATIHFLKSLDAYGVDPARVVVCGDSFGGAIAAVVCQQLVDRPDLPRIRAQILIYAILQALDLQTPSFQQRKNIPLLTWSFICYFFFQNLDFSSSWQEVIMKGAHLPAEVWEKYRKWLGPENIPERFKERGYQLKPHEPMNEAAYLEVSVVLDVMCSPLIAEDDIVSQLPETCIVSCEYDALRDNSLLYKKRLEDLGVPVTWHHMEDGFHGVLRTIDMSFLHFPCSMRILSALVQFVKGL

SEQ ID NO: 172 - protein, 407 aa, unidentified
MAVPWLVLLLALPIFFLGVFVWAVFEHFLTTDIPATLQHPAKLRFLHCIFLYLVTLGNIFEKLGICSMPKFIRFLHDSVRIKKDPELVVTDLRFGTIPVRLFQPKAASSRPRRGIIFYHGGATVFGSLDCYHGLCNYLARETESVLLMIGYRKLPDHHSPALFQDCMNASIHFLKALETYGVDPSRVVVCGESVGGAAVAAITQALVGRSDLPRIRAQVLIYPVVQAFCLQLPSFQQNQNVPLLSRKFMVTSLCNYLAIDLSWRDAILNGTCVPPDVWRKYEKWLSPDNIPKKFKNRGYQPWSPGPFNEAAYLEAKHMLDVENSPLIADDEVIAQLPEAFLVSCENDILRDDSLLYKKRLEDQGVRVTWYHLYDGFHGSIIFFDKKALSFPCSLKIVNAVVSYIKGI

SEQ ID NO: 173 - protein, 1098 aa, unidentified
MTLQELVHKAASCYMDRVAVCFDECNNQLPVYYTYKTVVNAASELSNFLLLHCDFQGIREIGLYCQPGIDLPSWILGILQVPAAYVPIEPDSPPSLSTHFMKKCNLKYILVEKKQINKFKSFHETLLNYDTFTVEHNDLVLFRLHWKNTEVNLMLNDGKEKYEKEKIKSISSEHVNEEKAEEHMDLRLKHCLAYVLHTSGTTGIPKIVRVPHKCIVPNIQHFRVLFDITQEDVLFLASPLTFDPSVVEIFLALSSGASLLIVPTSVKLLPSKLASVLFSHHRVTVLQATPTLLRRFGSQLIKSTVLSATTSLRVLALGGEAFPSLTVLRSWRGEGNKTQIFNVYGITEVSSWATIYRIPEKTLNSTLKCELPVQLGFPLLGTVVEVRDTNGFTIQEGSGQVFLGGRNRVCFLDDEVTVPLGTMRATGDFVTVKDGEIFFLGRKDSQIKRHGKRLNIELVQQVAEELQQVESCAVTWYNQEKLILFMVSKDASVKEYIFKELQKYLPSHAVPDELVLIDSLPFTSHGKIDVSELNKIYLNYINLKSENKLSGKEDLWEKLQYLWKSTLNLPEDLLRVPDESLFLNSGGDSLKSIRLLSEIEKLVGTSVPGLLEIILSSSILEIYNHILQTVVPDEDVTFRKSCATKRKLSDINQEEASGTSLHQKAIMTFTCHNEINAFVVLSRGSQILSLNSTRFLTKLGHCSSACPSDSVSQTNIQNLKGLNSPVLIGKSKDPSCVAKVSEEGKPAIGTQKMELHVRWRSDTGKCVDASPLVVIPTFDKSSTTVYIGSHSHRMKAVDFYSGKVKWEQILGDRIESSACVSKCGNFIVVGCYNGLVYVLKSNSGEKYWMFTTEDAVKSSATMDPTTGLIYIGSHDQHAYALDIYRKKCVWKSKCGGTVFSSPCLNLIPHHLYFATLGGLLLAVNPATGNVIWKHSCGKPLFSSPQCCSQYICIGCVDGNLLCFTHFGEQVWQFSTSGPIFSSPCTSPSEQKIFFGSHDCFIYCCNMKGHLQWKFETTSRVYATPFAFHNYNGSNEMLLAAASTDGKVWILESQSGQLQSVYELPGEVFSSPVVLESMLIIGCRDNYVYCLDLLGGNQK

SEQ ID NO: 174 - protein, 1374 aa, unidentified
MSSSFFNPSFAFSSHFDPDGAPLSELSWPSSLAVVAVSFSGLFAVIVLMLACLCCKKGGIGFKEFENAEGDEYAADLAQGSPATAAQNGPDVYVLPLTEVSLPMAKQPGRSVQLLKSTDVGRHSLLYLKEIGRGWFGKVFLGEVNSGISSAQVVVKELQASASVQEQMQFLEEVQPYRALKHSNLLQCLAQCAEVTPYLLVMEFCPLGDLKGYLRSCRVAESMAPDPRTLQRMACEVACGVLHLHRNNFVHSDLALRNCLLTADLTVKIGDYGLAHCKYREDYFVTADQLWVPLRWIAPELVDEVHSNLLVVDQTKSGNVWSLGVTIWELFELGTQPYPQHSDQQVLAYTVREQQLKLPKPQLQLTLSDRWYEVMQFCWLQPEQRPTAEEVHLLLSYLCAKGATEAEEEFERRWRSLRPGGGGVGPGPGAAGPMLGGVVELAAASSFPLLEQFAGDGFHADGDDVLTVTETSRGLNFEYKWEAGRGAEAFPATLSPGRTARLQELCAPDGAPPGVVPVLSAHSPSLGSEYFIRLEEAAPAAGHDPDCAGCAPSPPATADQDDDSDGSTAASLAMEPLLGHGPPVDVPWGRGDHYPRRSLARDPLCPSRSPSPSAGPLSLAEGGAEDADWGVAAFCPAFFEDPLGTSPLGSSGAPPLPLTGEDELEEVGARRAAQRGHWRSNVSANNNSGSRCPESWDPVSAGGHAEGCPSPKQTPRASPEPGYPGEPLLGLQAASAQEPGCCPGLPHLCSAQGLAPAPCLVTPSWTETASSGGDHPQAEPKLATEAEGTTGPRLPLPSVPSPSQEGAPLPSEEASAPDAPDALPDSPTPATGGEVSAIKLASALNGSSSSPEVEAPSSEDEDTAEATSGIFTDTSSDGLQARRPDVVPAFRSLQKQVGTPDSLDSLDIPSSASDGGYEVFSPSATGPSGGQPRALDSGYDTENYESPEFVLKEAQEGCEPQAFAELASEGEGPGPETRLSTSLSGLNEKNPYRDSAYFSDLEAEAEATSGPEKKCGGDRAPGPELGLPSTGQPSEQVCLRPGVSGEAQGSGPGEVLPPLLQLEGSSPEPSTCPSGLVPEPPEPQGPAKVRPGPSPSCSQFFLLTPVPLRSEGNSSEFQGPPGLLSGPAPQKRMGGPGTPRAPLRLALPGLPAALEGRPEEEEEDSEDSDESDEELRCYSVQEPSEDSEEEAPAVPVVVAESQSARNLRSLLKMPSLLSETFCEDLERKKKAVSFFDDVTVYLFDQESPTRELGEPFPGAKESPPTFLRGSPGSPSAPNRPQQADGSPNGSTAEEGGGFAWDDDFPLMTAKAAFAMALDPAAPAPAAPTPTPAPFSRFTVSPAPTSRFSITHVSDSDAESKRGPEAGAGGESKEA

SEQ ID NO: 175 - protein, 2261 aa, unidentified
MACWPQLRLLLWKNLTFRRRQTCQLLLEVAWPLFIFLILISVRLSYPPYEQHECHFPNKAMPSAGTLPWVQGIICNANNPCFRYPTPGEAPGVVGNFNKSIVARLFSDARRLLLYSQKDTSMKDMRKVLRTLQQIKKSSSNLKLQDFLVDNETFSGFLYHNLSLPKSTVDKMLRADVILHKVFLQGYQLHLTSLCNGSKSEEMIQLGDQEVSELCGLPREKLAAAERVLRSNMDILKPILRTLNSTSPFPSKELAEATKTLLHSLGTLAQELFSMRSWSDMRQEVMFLTNVNSSSSSTQIYQAVSRIVCGHPEGGGLKIKSLNWYEDNNYKALFGGNGTEEDAETFYDNSTTPYCNDLMKNLESSPLSRIIWKALKPLLVGKILYTPDTPATRQVMAEVNKTFQELAVFHDLEGMWEELSPKIWTFMENSQEMDLVRMLLDSRDNDHFWEQQLDGLDWTAQDIVAFLAKHPEDVQSSNGSVYTWREAFNETNQAIRTISRFMECVNLNKLEPIATEVWLINKSMELLDERKFWAGIVFTGITPGSIELPHHVKYKIRMDIDNVERTNKIKDGYWDPGPRADPFEDMRYVWGGFAYLQDVVEQAIIRVLTGTEKKTGVYMQQMPYPCYVDDIFLRVMSRSMPLFMTLAWIYSVAVIIKGIVYEKEARLKETMRIMGLDNSILWFSWFISSLIPLLVSAGLLVVILKLGNLLPYSDPSVVFVFLSVFAVVTILQCFLISTLFSRANLAAACGGIIYFTLYLPYVLCVAWQDYVGFTLKIFASLLSPVAFGFGCEYFALFEEQGIGVQWDNLFESPVEEDGFNLTTSVSMMLFDTFLYGVMTWYIEAVFPGQYGIPRPWYFPCTKSYWFGEESDEKSHPGSNQKRISEICMEEEPTHLKLGVSIQNLVKVYRDGMKVAVDGLALNFYEGQITSFLGHNGAGKTTTMSILTGLFPPTSGTAYILGKDIRSEMSTIRQNLGVCPQHNVLFDMLTVEEHIWFYARLKGLSEKHVKAEMEQMALDVGLPSSKLKSKTSQLSGGMQRKLSVALAFVGGSKVVILDEPTAGVDPYSRRGIWELLLKYRQGRTIILSTHHMDEADVLGDRIAIISHGKLCCVGSSLFLKNQLGTGYYLTLVKKDVESSLSSCRNSSSTVSYLKKEDSVSQSSSDAGLGSDHESDTLTIDVSAISNLIRKHVSEARLVEDIGHELTYVLPYEAAKEGAFVELFHEIDDRLSDLGISSYGISETTLEEIFLKVAEESGVDAETSDGTLPARRNRRAFGDKQSCLRPFTEDDAADPNDSDIDPESRETDLLSGMDGKGSYQVKGWKLTQQQFVALLWKRLLIARRSRKGFFAQIVLPAVFVCIALVFSLIVPPFGKYPSLELQPWMYNEQYTFVSNDAPEDTGTLELLNALTKDPGFGTRCMEGNPIPDTPCQAGEEEWTTAPVPQTIMDLFQNGNWTMQNPSPACQCSSDKIKKMLPVCPPGAGGLPPPQRKQNTADILQDLTGRNISDYLVKTYVQIIAKSLKNKIWVNEFRYGGFSLGVSNTQALPPSQEVNDAIKQMKKHLKLAKDSSADRFLNSLGRFMTGLDTKNNVKVWFNNKGWHAISSFLNVINNAILRANLQKGENPSHYGITAFNHPLNLTKQQLSEVALMTTSVDVLVSICVIFAMSFVPASFVVFLIQERVSKAKHLQFISGVKPVIYWLSNFVWDMCNYVVPATLVIIIFICFQQKSYVSSTNLPVLALLLLLYGWSITPLMYPASFVFKIPSTAYVVLTSVNLFIGINGSVATFVLELFTDNKLNNINDILKSVFLIFPHFCLGRGLIDMVKNQAMADALERFGENRFVSPLSWDLVGRNLFAMAVEGVVFFLITVLIQYRFFIRPRPVNAKLSPLNDEDEDVRRERQRILDGGGQNDILEIKELTKIYRRKRKPAVDRICVGIPPGECFGLLGVNGAGKSSTFKMLTGDTTVTRGDAFLNKNSILSNIHEVHQNMGYCPQFDAITELLTGREHVEFFALLRGVPEKEVGKVGEWAIRKLGLVKYGEKYAGNYSGGNKRKLSTAMALIGGPPVVFLDEPTTGMDPKARRFLWNCALSVVKEGRSVVLTSHSMEECEALCTRMAIMVNGRFRCLGSVQHLKNRFGDGYTIVVRIAGSNPDLKPVQDFFGLAFPGSVLKEKHRNMLQYQLPSSLSSLARIFSILSQSKKRLHIEDYSVSQTTLDQVFVNFAKDQSDDDHLKDLSLHKNQTVVDVAVLTSFLQDEKVKESYV

SEQ ID NO: 176 - protein, 1543 aa, unidentified
MNKMALASFMKGRTVIGTPDEETMDIELPKKYHEMVGVIFSDTFSYRLKFNWGYRIPVIKEHSEYTEHCWAMHGEIFCYLAKYWLKGFVAFQAAINAAIIEVTTNHSVMEELTSVIGINMKIPPFISKGEIMNEWFHFTCLVSFSSFIYFASLNVARERGKFKKLMTVMGLRESAFWLSWGLTYICFIFIMSIFMALVITSIPIVFHTGFMVIFTLYSLYGLSLIALAFLMSVLIRKPMLAGLAGFLFTVFWGCLGFTVLYRQLPLSLGWVLSLLSPFAFTAGMAQITHLDNYLSGVIFPDPSGDSYKMIATFFILAFDTLFYLIFTLYFERVLPDKDGHGDSPLFFLKSSFWSKHQNTHHEIFENEINPEHSSDDSFEPVSPEFHGKEAIRIRNVIKEYNGKTGKVEALQGIFFDIYEGQITAILGHNGAGKSTLLNILSGLSVSTEGSATIYNTQLSEITDMEEIRKNIGFCPQFNFQFDFLTVRENLRVFAKIKGIQPKEVEQEVKRIIMELDMQSIQDIIAKKLSGGQKRKLTLGIAILGDPQVLLLDEPTAGLDPFSRHRVWSLLKEHKVDRLILFSTQFMDEADILADRKVFLSNGKLKCAGSSLFLKRKWGIGYHLSLHRNEMCDTEKITSLIKQHIPDAKLTTESEEKLVYSLPLEKTNKFPDLYSDLDKCSDQGIRNYAVSVTSLNEVFLNLEGKSAIDEPDFDIGKQEKIHVTRNTGDESEMEQVLCSLPETRKAVSSAALWRRQIYAVATLRFLKLRRERRALLCLLLVLGIAFIPIILEKIMYKVTRETHCWEFSPSMYFLSLEQIPKTPLTSLLIVNNTGSNIEDLVHSLKCQDIVLEIDDFRNRNGSDDPSYNGAIIVSGDQKDYRFSVACNTKKLNCFPVLMGIVSNALMGIFNFTELIQMESTSFSRDDIVLDLGFIDGSIFLLLITNCVSPFIGMSSISDYKKNVQSQLWISGLWPSAYWCGQALVDIPLYFLILFSIHLIYYFIFLGFQLSWELMFVLVVCIIGCAVSLIFLTYVLSFIFRKWRKNNGFWSFGFFIILICVSTIMVSTQYEKLNLILCMIFIPSFTLLGYVMLLIQLDFMRNLDSLDNRINEVNKTILLTTLIPYLQSVIFLFVIRCLEMKYGNEIMNKDPVFRISPRSRETHPNPEEPEEEDEDVQAERVQAANALTAPNLEEEPVITASCLHKEYYETKKSCFSTRKKKIAIRNVSFCVKKGEVLGLLGHNGAGKSTSIKMITGCTKPTAGVVVLQGSRASVRQQHDNSLKFLGYCPQENSLWPKLTMKEHLELYAAVKGLGKEDAALSISRLVEALKLQEQLKAPVKTLSEGIKRKLCFVLSILGNPSVVLLDEPFTGMDPEGQQQMWQILQATVKNKERGTLLTTHYMSEAEAVCDRMAMMVSGTLRCIGSIQHLKNKFGRDYLLEIKMKEPTQVEALHTEILKLFPQAAWQERYSSLMAYKLPVEDVHPLSRAFFKLEAMKQTFNLEEYSLSQATLEQVFLELCKEQELGNVDDKIDTTVEWKLLPQEDP

SEQ ID NO: 177 - protein, 2595 aa, unidentified
MASLFHQLQILVWKNWLGVKRQPLWTLVLILWPVIIFIILAITRTKFPPTAKPTCYLAPRNLPSTGFFPFLQTLLCDTDSKCKDTPYGPQDLLRRKGIDDALFKDSEILRKSSNLDKDSSLSFQSTQVPERRHASLATVFPSPSSDLEIPGTYTFNGSQVLARILGLEKLLKQNSTSEDIRRELCDSYSGYIVDDAFSWTFLGRNVFNKFCLSNMTLLESSLQELNKQFSQLSSDPNNQKIVFQEIVRMLSFFSQVQEQKAVWQLLSSFPNVFQNDTSLSNLFDVLRKANSVLLVVQKVYPRFATNEGFRTLQKSVKHLLYTLDSPAQGDSDNITHVWNEDDGQTLSPSSLAAQLLILENFEDALLNISANSPYIPYLACVRNVTDSLARGSPENLRLLQSTIRFKKSFLRNGSYEDYFPPVPEVLKSKLSQLRNLTELLCESETFSLIEKSCQLSDMSFGSLCEESEFDLQLLEAAELGTEIAASLLYHDNVISKKVRDLLTGDPSKINLNMDQFLEQALQMNYLENITQLIPIIEAMLHVNNSADASEKPGQLLEMFKNVEELKEDLRRTTGMSNRTIDKLLAIPIPDNRAEIISQVFWLHSCDTNITTPKLEDAMKEFCNLSLSERSRQSYLIGLTLLHYLNIYNFTYKVFFPRKDQKPVEKMMELFIRLKEILNQMASGTHPLLDKMRSLKQMHLPRSVPLTQAMYRSNRMNTPQGSFSTISQALCSQGITTEYLTAMLPSSQRPKGNHTKDFLTYKLTKEQIASKYGIPINSTPFCFSLYKDIINMPAGPVIWAFLKPMLLGRILYAPYNPVTKAIMEKSNVTLRQLAELREKSQEWMDKSPLFMNSFHLLNQAIPMLQNTLRNPFVQVFVKFSVGLDAVELLKQIDELDILRLKLENNIDIIDQLNTLSSLTVNISSCVLYDRIQAAKTIDEMEREAKRLYKSNELFGSVIFKLPSNRSWHRGYDSGNVFLPPVIKYTIRMSLKTAQTTRSLRTKIWAPGPHNSPSHNQIYGRAFIYLQDSIERAIIELQTGRNSQEIAVQVQAIPYPCFMKDNFLTSVSYSLPIVLMVAWVVFIAAFVKKLVYEKDLRLHEYMKMMGVNSCSHFFAWLIESVGFLLVTIVILIIILKFGNILPKTNGFILFLYFSDYSFSVIAMSYLISVFFNNTNIAALIGSLIYIIAFFPFIVLVTVENELSYVLKVFMSLLSPTAFSYASQYIARYEEQGIGLQWENMYTSPVQDDTTSFGWLCCLILADSFIYFLIAWYVRNVFPGTYGMAAPWYFPILPSYWKERFGCAEVKPEKSNGLMFTNIMMQNTNPSASPEYMFSSNIEPEPKDLTVGVALHGVTKIYGSKVAVDNLNLNFYEGHITSLLGPNGAGKTTTISMLTGLFGASAGTIFVYGKDIKTDLHTVRKNMGVCMQHDVLFSYLTTKEHLLLYGSIKVPHWTKKQLHEEVKRTLKDTGLYSHRHKRVGTLSGGMKRKLSISIALIGGSRVVILDEPSTGVDPCSRRSIWDVISKNKTARTIILSTHHLDEAEVLSDRIAFLEQGGLRCCGSPFYLKEAFGDGYHLTLTKKKSPNLNANAVCDTMAVTAMIQSHLPEAYLKEDIGGELVYVLPPFSTKVSGAYLSLLRALDNGMGDLNIGCYGISDTTVEEVFLNLTKESQKNSAMSLEHLTQKKIGNSNANGISTPDDLSVSSSNFTDRDDKILTRGERLDGFGLLLKKIMAILIKRFHHTRRNWKGLIAQVILPIVFVTTAMGLGTLRNSSNSYPEIQISPSLYGTSEQTAFYANYHPSTEALVSAMWDFPGIDNMCLNTSDLQCLNKDSLEKWNTSGEPITNFGVCSCSENVQECPKFNYSPPHRRTYSSQVIYNLTGQRVENYLISTANEFVQKRYGGWSFGLPLTKDLRFDITGVPANRTLAKVWYDPEGYHSLPAYLNSLNNFLLRVNMSKYDAARHGIIMYSHPYPGVQDQEQATISSLIDILVALSILMGYSVTTASFVTYVVREHQTKAKQLQHISGIGVTCYWVTNFIYDMVFYLVPVAFSIGIIAIFKLPAFYSENNLGAVSLLLLLFGYATFSWMYLLAGLFHETGMAFITYVCVNLFFGINSIVSLSVVYFLSKEKPNDPTLELISETLKRIFLIFPQFCFGYGLIELSQQQSVLDFLKAYGVEYPNETFEMNKLGAMFVALVSQGTMFFSLRLLINESLIKKLRLFFRKFNSSHVRETIDEDEDVRAERLRVESGAAEFDLVQLYCLTKTYQLIHKKIIAVNNISIGIPAGECFGLLGVNGAGKTTIFKMLTGDIIPSSGNILIRNKTGSLGHVDSHSSLVGYCPQEDALDDLVTVEEHLYFYARVHGIPEKDIKETVHKLLRRLHLMPFKDRATSMCSYGTKRKLSTALALIGKPSILLLDEPSSGMDPKSKRHLWKIISEEVQNKCSVILTSHSMEECEALCTRLAIMVNGKFQCIGSLQHIKSRFGRGFTVKVHLKNNKVTMETLTKFMQLHFPKTYLKDQHLSMLEYHVPVTAGGVANIFDLLETNKTALNITNFLVSQTTLEEVFINFAKDQKSYETADTSSQGSTISVDSQDDQMES

SEQ ID NO: 178 - protein, 5058 aa, unidentified
MGHAGCQFKALLWKNWLCRLRNPVLFLAEFFWPCILFVILTVLRFQEPPRYRDICYLQPRDLPSCGVIPFVQSLLCNTGSRCRNFSYEGSMEHHFRLSRFQTAADPKKVNNLAFLKEIQDLAEEIHGMMDKAKNLKRLWVERSNTPDSSYGSSFFTMDLNKTEEVILKLESLHQQPHIWDFLLLLPRLHTSHDHVEDGMDVAVNLLQTILNSLISLEDLDWLPLNQTFSQVSELVLNVTISTLTFLQQHGVAVTEPVYHLSMQNIVWDPQKVQYDLKSQFGFDDLHTEQILNSSAELKEIPTDTSLEKMVCSVLSSTSEDEAEKWGHVGGCHPKWSEAKNYLVHAVSWLRVYQQVFVQWQQGSLLQKTLTGMGHSLEALRNQFEEESKPWKVVEALHTALLLLNDSLSADGPKDNHTFPKILQHLWKLQSLLQNLPQWPALKRFLQLDGALRNAIAQNLHFVQEVLICLETSANDFKWFELNQLKLEKDVFFWELKQMLAKNAVCPNGRFSEKEVFLPPGNSSIWGGLQGLLCYCNSSETSVLNKLLGSVEDADRILQEVITWHKNMSVLIPEEYLDWQELEMQLSEASLSCTRLFLLLGADPSPENDVFSSDCKHQLVSTVIFHTLEKTQFFLEQAYYWKAFKKFIRKTCEVAQYVNMQESFQNRLLAFPEESPCFEENMDWKMISDNYFQFLNNLLKSPTASISRALNFTKHLLMMEKKLHTLEDEQMNFLLSFVEFFEKLLLPNLFDSSIVPSFHSLPSLTEDILNISSLWTNHLKSLKRDPSATDAQKLLEFGNEVIWKMQTLGSHWIRKEPKNLLRFIELILFEINPKLLELWAYGISKGKRAKLENFFTLLNFSVPENEILSTSFNFSQLFHSDWPKSPAMNIDFVRLSEAIITSLHEFGFLEQEQISEALNTVYAIRNASDLFSALSEPQKQEVDKILTHIHLNVFQDKDSALLLQIYSSFYRYIYELLNIQSRGSSLTFLTQISKHILDIIKQFNFQNISKAFAFLFKTAEVLGGISNVSYCQQLLSIFNFLELQAQSFMSTEGQELEVIHTTLTGLKQLLIIDEDFRISLFQYMSQFFNSSVEDLLDNKCLISDNKHISSVNYSTSEESSFVFPLAQIFSNLSANVSVFNKFMSIHCTVSWLQMWTEIWETISQLFKFDMNVFTSLHHGFTQLLDELEDDVKVSKSCQGILPTHNVARLILNLFKNVTQANDFHNWEDFLDLRDFLVALGNALVSVKKLNLEQVEKSLFTMEAALHQLKTFPFNESTSREFLNSLLEVFIEFSSTSEYIVRNLDSINDFLSNNLTNYGEKFENIITELREAIVFLRNVSHDRDLFSCADIFQNVTECILEDGFLYVNTSQRMLRILDTLNSTFSSENTISSLKGCIVWLDVINHLYLLSNSSFSQGHLQNILGNFRDIENKMNSILKIVTWVLNIKKPLCSSNGSHINCVNIYLKDVTDFLNIVLTTVFEKEKKPKFEILLALLNDSTKQVRMSINNLTTDFDFASQSNWRYFTELILRPIEMSDEIPNQFQNIWLHLITLGKEFQKLVKGIYFNILENNSSSKTENLLNIFATSPKEKDVNSVGNSIYHLASYLAFSLSHDLQNSPKIIISPEIMKATGLGIQLIRDVFNSLMPVVHHTSPQNAGYMQALKKVTSVMRTLKKADIDLLVDQLEQVSVNLMDFFKNISSVGTGNLVVNLLVGLMEKFADSSHSWNVNHLLQLSRLFPKDVVDAVIDVYYVLPHAVRLLQGVPGKNITEGLKDVYSFTLLHGITISNITKEDFAIVIKILLDTIELVSDKPDIISEALACFPVVWCWNHTNSGFRQNSKIDPCNVHGLMSSSFYGKVASILDHFHLSPQGEDSPCSNESSRMEITRKVVCIIHELVDWNSILLELSEVFHVNISLVKTVQKFWHKILPFVPPSINQTRDSISELCPSGSIKQVALQIIEKLKNVNFTKVTSGENILDKLSSLNKILNINEDTETSVQNIISSNLERTVQLISEDWSLEKSTHNLLSLFMMLQNANVTGSSLEALSSFIEKSETPYNFEELWPKFQQIMKDLTQDFRIRHLLSEMNKGIKSINSMALQKITLQFAHFLEILDSPSLKTLEIIEDFLLVTKNWLQEYANEDYSRMIETLFIPVTNESSTEDIALLAKAIATFWGSLKNISRAGNFDVAFLTHLLNQEQLTNFSVVQLLFENILINLINNLAGNSQEAAWNLNDTDLQIMNFINLILNHMQSETSRKTVLSLRSIVDFTEQFLKTFFSLFLKEDSENKISLLLKYFHKDVIAEMSFVPKDKILEILKLDQFLTLMIQDRLMNIFSSLKETIYHLMKSSFILDNGEFYFDTHQGLKFMQDLFNALLRETSMKNKTENNIDFFTVVSQLFFHVNKSEDLFKLNQDLGSALHLVRECSTEMARLLDTILHSPNKDFYALYPTLQEVILANLTDLLFFINNSFPLRNRATLEITKRLVGAISRASEESHVLKPLLEMSGTLVMLLNDSADLRDLATSMDSIVKLLKLVKKVSGKMSTVFKTHFISNTKDSVKFFDTLYSIMQQSVQNLVKEIATLKKIDHFTFEKINDLLVPFLDLAFEMIGVEPYISSNSDIFSMSPSILSYMNQSKDFSDILEEIAEFLTSVKMNLEDMRSLAVAFNNETQTFSMDSVNLREEILGCLVPINNITNQMDFLYPNPISTHSGPQDIKWEIIHEVIPFLDKILSQNSTEIGSFLKMVICLTLEALWKNLKKDNWNVSNVLMTFTQHPNNLLKTIETVLEASSGIKSDYEGDLNKSLYFDTPLSQNITHHQLEKAIHNVLSRIALWRKGLLFNNSEWITSTRTLFQPLFEIFIKATTGKNVTSEKEERTKKEMIDFPYSFKPFFCLEKYLGGLFVLTKYWQQIPLTDQSVVEICEVFQQTVKPSEAMEMLQKVKMMVVRVLTIVAENPSWTKDILCATLSCKQNGIRHLILSAIQGVTLAQDHFQEIEKIWSSPNQLNCESLSKNLSSTLESFKSSLENATGQDCTSQPRLETVQQHLYMLAKSLEETWSSGNPIMTFLSNFTVTEDVKIKDLMKNITKLTEELRSSIQISNETIHSILEANISHSKVLFSALTVALSGKCDQEILHLLLTFPKGEKSWIAAEELCSLPGSKVYSLIVLLSRNLDVRAFIYKTLMPSEANGLLNSLLDIVSSLSALLAKAQHVFEYLPEFLHTFKITALLETLDFQQVSQNVQARSSAFGSFQFVMKMVCKDQASFLSDSNMFINLPRVKELLEDDKEKFNIPEDSTPFCLKLYQEILQLPNGALVWTFLKPILHGKILYTPNTPEINKVIQKANYTFYIVDKLKTLSETLLEMSSLFQRSGSGQMFNQLQEALRNKFVRNFVENQLHIDVDKLTEKLQTYGGLLDEMFNHAGAGRFRFLGSILVNLSSCVALNRFQALQSVDILETKAHELLQQNSFLASIIFSNSLFDKNFRSESVKLPPHVSYTIRTNVLYSVRTDVVKNPSWKFHPQNLPADGFKYNYVFAPLQDMIERAIILVQTGQEALEPAAQTQAAPYPCHTSDLFLNNVGFFFPLIMMLTWMVSVASMVRKLVYEQEIQIEEYMRMMGVHPVIHFLAWFLENMAVLTISSATLAIVLKTSGIFAHSNTFIVFLFLLDFGMSVVMLSYLLSAFFSQANTAALCTSLVYMISFLPYIVLLVLHNQLSFVNQTFLCLLSTTAFGQGVFFITFLEGQETGIQWNNMYQALEQGGMTFGWVCWMILFDSSLYFLCGWYLSNLIPGTFGLRKPWYFPFTASYWKSVGFLVEKRQYFLSSSLFFFNENFDNKGSSLQNREGELEGSAPGVTLVSVTKEYEGHKAVVQDLSLTFYRDQITALLGTNGAGKTTIISMLTGLHPPTSGTIIINGKNLQTDLSRVRMELGVCPQQDILLDNLTVREHLLLFASIKAPQWTKKELHQQVNQTLQDVDLTQHQHKQTRALSGGLKRKLSLGIAFMGMSRTVVLDEPTSGVDPCSRHSLWDILLKYREGRTIIFTTHHLDEAEALSDRVAVLQHGRLRCCGPPFCLKEAYGQGLRLTLTRQPSVLEAHDLKDMACVTSLIKIYIPQAFLKDSSGSELTYTIPKDTDKACLKGLFQALDENLHQLHLTGYGISDTTLEEVFLMLLQDSNKKSHIALGTESELQNHRPTGHLSGYCGSLARPATVQGVQLLRAQVAAILARRLRRTLRAGKSTLADLLLPVLFVALAMGLFMVRPLATEYPPLRLTPGHYQRAETYFFSSGGDNLDLTRVLLRKFRDQDLPCADLNPRQKNSSCWRTDPFSHPEFQDSCGCLKCPNRSASAPYLTNHLGHTLLNLSGFNMEEYLLAPSEKPRLGGWSFGLKIPSEAGGANGNISKPPTLAKVWYNQKGFHSLPSYLNHLNNLILWQHLPPTVDWRQYGITLYSHPYGGALLNKDKILESIRQCGVALCIVLGFSILSASIGSSVVRDRVIGAKRLQHISGLGYRMYWFTNFLYDMLFYLVSVCLCVAVIVAFQLTAFTFRKNLAATALLLSLFGYATLPWMYLMSRIFSSSDVAFISYVSLNFIFGLCTMLITIMPRLLAIISKAKNLQNIYDVLKWVFTIFPQFCLGQGLVELCYNQIKYDLTHNFGIDSYVSPFEMNFLGWIFVQLASQGTVLLLLRVLLHWDLLRWPRGHSTLQGTVKSSKDTDVEKEEKRVFEGRTNGDILVLYNLSKHYRRFFQNIIAVQDISLGIPKGECFGLLGVNGAGKSTTFKMLNGEVSLTSGHAIIRTPMGDAVDLSSAGTAGVLIGYCPQQDALDELLTGWEHLYYYCSLRGIPRQCIPEVAGDLIRRLHLEAHADKPVATYSGGTKRKLSTALALVGKPDILLLDEPSSGMDPCSKRYLWQTIMKEVREGCAAVLTSHSMEECEALCTRLAIMVNGSFKCLGSPQHIKNRFGDGYTVKVWLCKEANQHCTVSDHLKLYFPGIQFKGQHLNLLEYHVPKRWGCLADLFKVIENNKTFLNIKHYSINQTTLEQVFINFASEQQQTLQSTLDPSTDSHHTHHLPI

SEQ ID NO: 179 - protein, 2435 aa, unidentified
MGFLHQLQLLLWKNVTLKRRSPWVLAFEIFIPLVLFFILLGLRQKKPTISVKEAFYTAAPLTSAGILPVMQSLCPDGQRDEFGFLQYANSTVTQLLERLDRVVEEGNLFDPARPSLGSELEALRQHLEALSAGPGTSGSHLDRSTVSSFSLDSVARNPQELWRFLTQNLSLPNSTAQALLAARVDPPEVYHLLFGPSSALDSQSGLHKGQEPWSRLGGNPLFRMEELLLAPALLEQLTCTPGSGELGRILTVPESQKGALQGYRDAVCSGQAAARARRFSGLSAELRNQLDVAKVSQQLGLDAPNGSDSSPQAPPPRRLQALLGDLLDAQKVLQDVDVLSALALLLPQGACTGRTPGPPASGAGGAANGTGAGAVMGPNATAEEGAPSAAALATPDTLQGQCSAFVQLWAGLQPILCGNNRTIEPEALRRGNMSSLGFTSKEQRNLGLLVHLMTSNPKILYAPAGSEVDRVILKANETFAFVGNVTHYAQVWLNISAEIRSFLEQGRLQQHLRWLQQYVAELRLHPEALNLSLDELPPALRQDNFSLPSGMALLQQLDTIDNAACGWIQFMSKVSVDIFKGFPDEESIVNYTLNQAYQDNVTVFASVIFQTRKDGSLPPHVHYKIRQNSSFTEKTNEIRRAYWRPGPNTGGRFYFLYGFVWIQDMMERAIIDTFVGHDVVEPGSYVQMFPYPCYTRDDFLFVIEHMMPLCMVISWVYSVAMTIQHIVAEKEHRLKEVMKTMGLNNAVHWVAWFITGFVQLSISVTALTAILKYGQVLMHSHVVIIWLFLAVYAVATIMFCFLVSVLYSKAKLASACGGIIYFLSYVPYMYVAIREEVAHDKITAFEKCIASLMSTTAFGLGSKYFALYEVAGVGIQWHTFSQSPVEGDDFNLLLAVTMLMVDAVVYGILTWYIEAVHPGMYGLPRPWYFPLQKSYWLGSGRTEAWEWSWPWARTPRLSVMEEDQACAMESRRFEETRGMEEEPTHLPLVVCVDKLTKVYKDDKKLALNKLSLNLYENQVVSFLGHNGAGKTTTMSILTGLFPPTSGSATIYGHDIRTEMDEIRKNLGMCPQHNVLFDRLTVEEHLWFYSRLKSMAQEEIRREMDKMIEDLELSNKRHSLVQTLSGGMKRKLSVAIAFVGGSRAIILDEPTAGVDPYARRAIWDLILKYKPGRTILLSTHHMDEADLLGDRIAIISHGKLKCCGSPLFLKGTYGDGYRLTLVKRPAEPGGPQEPGLASSPPGRAPLSSCSELQVSQFIRKHVASCLLVSDTSTELSYILPSEAAKKGAFERLFQHLERSLDALHLSSFGLMDTTLEEVFLKVSEEDQSLENSEADVKESRKDVLPGAEGPASGEGHAGNLARCSELTQSQASLQSASSVGSARGDEGAGYTDVYGDYRPLFDNPQDPDNVSLQEVEAEALSRVGQGSRKLDGGWLKVRQFHGLLVKRFHCARRNSKALFSQILLPAFFVCVAMTVALSVPEIGDLPPLVLSPSQYHNYTQPRGNFIPYANEERREYRLRLSPDASPQQLVSTFRLPSGVGATCVLKSPANGSLGPTLNLSSGESRLLAARFFDSMCLESFTQGLPLSNFVPPPPSPAPSDSPASPDEDLQAWNVSLPPTAGPEMWTSAPSLPRLVREPVRCTCSAQGTGFSCPSSVGGHPPQMRVVTGDILTDITGHNVSEYLLFTSDRFRLHRYGAITFGNVLKSIPASFGTRAPPMVRKIAVRRAAQVFYNNKGYHSMPTYLNSLNNAILRANLPKSKGNPAAYGITVTNHPMNKTSASLSLDYLLQGTDVVIAIFIIVAMSFVPASFVVFLVAEKSTKAKHLQFVSGCNPIIYWLANYVWDMLNYLVPATCCVIILFVFDLPAYTSPTNFPAVLSLFLLYGWSITPIMYPASFWFEVPSSAYVFLIVINLFIGITATVATFLLQLFEHDKDLKVVNSYLKSCFLIFPNYNLGHGLMEMAYNEYINEYYAKIGQFDKMKSPFEWDIVTRGLVAMAVEGVVGFLLTIMCQYNFLRRPQRMPVSTKPVEDDVDVASERQRVLRGDADNDMVKIENLTKVYKSRKIGRILAVDRLCLGVRPGECFGLLGVNGAGKTSTFKMLTGDESTTGGEAFVNGHSVLKELLQVQQSLGYCPQCDALFDELTAREHLQLYTRLRGISWKDEARVVKWALEKLELTKYADKPAGTYSGGNKRKLSTAIALIGYPAFIFLDEPTTGMDPKARRFLWNLILDLIKTGRSVVLTSHSMEECEALCTRLAIMVNGRLRCLGSIQHLKNRFGDGYMITVRTKSSQSVKDVVRFFNRNFPEAMLKERHHTKVQYQLKSEHISLAQVFSKMEQVSGVLGIEDYSVSQTTLDNVFVNFAKKQSDNLEQQETEPPSALQSPLGCLLSLLRPRSAPTELRALVADEPEDLDTEDEGLISFEEERAQLSFNTDTLC

SEQ ID NO: 180 - protein, 1704 aa, unidentified
MAVLRQLALLLWKNYTLQKRKVLVTVLELFLPLLFSGILIWLRLKIQSENVPNATIYPGQSIQELPLFFTFPPPGDTWELAYIPSHSDAAKTVTETVRRALVINMRVRGFPSEKDFEDYIRYDNCSSSVLAAVVFEHPFNHSKEPLPLAVKYHLRFSYTRRNYMWTQTGSFFLKETEGWHTTSLFPLFPNPGPREPTSPDGGEPGYIREGFLAVQHAVDRAIMEYHADAATRQLFQRLTVTIKRFPYPPFIADPFLVAIQYQLPLLLLLSFTYTALTIARAVVQEKERRLKEYMRMMGLSSWLHWSAWFLLFFLFLLIAASFMTLLFCVKVKPNVAVLSRSDPSLVLAFLLCFAISTISFSFMVSTFFSKANMAAAFGGFLYFFTYIPYFFVAPRYNWMTLSQKLCSCLLSNVAMAMGAQLIGKFEAKGMGIQWRDLLSPVNVDDDFCFGQVLGMLLLDSVLYGLVTWYMEAVFPGQFGVPQPWYFFIMPSYWCGKPRAVAGKEEEDSDPEKALRNEYFEAEPEDLVAGIKIKHLSKVFRVGNKDRAAVRDLNLNLYEGQITVLLGHNGAGKTTTLSMLTGLFPPTSGRAYISGYEISQDMVQIRKSLGLCPQHDILFDNLTVAEHLYFYAQLKGLSRQKCPEEVKQMLHIIGLEDKWNSRSRFLSGGMRRKLSIGIALIAGSKVLILDEPTSGMDAISRRAIWDLLQRQKSDRTIVLTTHFMDEADLLGDRIAIMAKGELQCCGSSLFLKQKYGAGYHMTLVKEPHCNPEDISQLVHHHVPNATLESSAGAELSFILPRESTHRFEGLFAKLEKKQKELGIASFGASITTMEEVFLRVGKLVDSSMDIQAIQLPALQYQHERRASDWAVDSNLCGAMDPSDGIGALIEEERTAVKLNTGLALHCQQFWAMFLKKAAYSWREWKMVAAQVLVPLTCVTLALLAINYSSELFDDPMLRLTLGEYGRTVVPFSVPGTSQLGQQLSEHLKDALQAEGQEPREVLGDLEEFLIFRASVEGGGFNERCLVAASFRDVGERTVVNALFNNQAYHSPATALAVVDNLLFKLLCGPHASIVVSNFPQPRSALQAAKDQFNEGRKGFDIALNLLFAMAFLASTFSILAVSERAVQAKHVQFVSGVHVASFWLSALLWDLISFLIPSLLLLVVFKAFDVRAFTRDGHMADTLLLLLLYGWAIIPLMYLMNFFFLGAATAYTRLTIFNILSGIATFLMVTIMRIPAVKLEELSKTLDHVFLVLPNHCLGMAVSSFYENYETRRYCTSSEVAAHYCKKYNIQYQENFYAWSAPGVGRFVASMAASGCAYLILLFLIETNLLQRLRGILCALRRRRTLTELYTRMPVLPEDQDVADERTRILAPSPDSLLHTPLIIKELSKVYEQRVPLLAVDRLSLAVQKGECFGLLGFNGAGKTTTFKMLTGEESLTSGDAFVGGHRISSDVGKVRQRIGYCPQFDALLDHMTGREMLVMYARLRGIPERHIGACVENTLRGLLLEPHANKLVRTYSGGNKRKLSTGIALIGEPAVIFLDEPSTGMDPVARRLLWDTVARARESGKAIIITSHSMEECEALCTRLAIMVQGQFKCLGSPQHLKSKFGSGYSLRAKVQSEGQQEALEEFKAFVDLTFPGSVLEDEHQGMVHYHLPGRDLSWAKVFGILEKAKEKYGVDDYSVSQISLEQVFLSFAHLQPPTAEEGR

SEQ ID NO: 181 - protein, 2273 aa, unidentified [sequence omitted]

SEQ ID NO: 182 - protein, 1642 aa, unidentified
MSTAIREVGVWRQTRTLLLKNYLIKCRTKKSSVQEILFPLFFLFWLILISMMHPNKKYEEVPNIELNPMDKFTLSNLILGYTPVTNITSSIMQKVSTDHLPDVIITEEYTNEKEMLTSSLSKPSNFVGVVFKDSMSYELRFFPDMIPVSSIYMDSRAGCSKSCEAAQYWSSGFTVLQASIDAAIIQLKTNVSLWKELESTKAVIMGETAVVEIDTFPRGVILIYLVIAFSPFGYFLAIHIVAEKEKKIKEFLKIMGLHDTAFWLSWVLLYTSLIFLMSLLMAVIATASLLFPQSSSIVIFLLFFLYGLSSVFFALMLTPLFKKSKHVGIVEFFVTVAFGFIGLMIILIESFPKSLVWLFSPFCHCTFVIGIAQVMHLEDFNEGASFSNLTAGPYPLIITIIMLTLNSIFYVLLAVYLDQVIPGEFGLRRSSLYFLKPSYWSKSKRNYEELSEGNVNGNISFSEIIEPVSSEFVGKEAIRISGIQKTYRKKGENVEALRNLSFDIYEGQITALLGHSGTGKSTLMNILCGLCPPSDGFASIYGHRVSEIDEMFEARKMIGICPQLDIHFDVLTVEENLSILASIKGIPANNIIQEVQKVLLDLDMQTIKDNQAKKLSGGQKRKLSLGIAVLGNPKILLLDEPTAGMDPCSRHIVWNLLKYRKANRVTVFSTHFMDEADILADRKAVISQGMLKCVGSSMFLKSKWGIGYRLSMYIDKYCATESLSSLVKQHIPGATLLQQNDQQLVYSLPFKDMDKFSGLFSALDSHSNLGVISYGVSMTTLEDVFLKLEVEAEIDQADYSVFTQQPLEEEMDSKSFDEMEQSLLILSETKAALVSTMSLWKQQMYTIAKFHFFTLKRESKSVRSVLLLLLIFFTVQIFMFLVHHSFKNAVVPIKLVPDLYFLKPGDKPHKYKTSLLLQNSADSDISDLISFFTSQNIMVTMINDSDYVSVAPHSAALNVMHSEKDYVFAAVFNSTMVYSLPILVNIISNYYLYHLNVTETIQIWSTPFFQEITDIVFKIELYFQAALLGIIVTAMPPYFAMENAENHKIKAYTQLKLSGLLPSAYWIGQAVVDIPLFFIILILMLGSLLAFHYGLYFYTVKFLAVVFCLIGYVPSVILFTYIASFTFKKILNTKEFWSFIYSVAALACIAITEITFFMGYTIATILHYAFCIIIPIYPLLGCLISFIKISWKNVRKNVDTYNPWDRLSVAVISPYLQCVLWIFLLQYYEKKYGGRSIRKDPFFRNLSTKSKNRKLPEPPDNEDEDEDVKAERLKVKELMGCQCCEEKPSIMVSNLHKEYDDKKDFLLSRKVKKVATKYISFCVKKGEILGLLGPNGAGKSTIINILVGDIEPTSGQVFLGDYSSETSEDDDSLKCMGYCPQINPLWPDTTLQEHFEIYGAVKGMSASDMKEVISRITHALDLKEHLQKTVKKLPAGIKRKLCFALSMLGNPQITLLDEPSTGMDPKAKQHMWRAIRTAFKNRKRAAILTTHYMEEAEAVCDRVAIMVSGQLRCIGTVQHLKSKFGKGYFLEIKLKDWIENLEVDRLQREIQYIFPNASRQESFSSILAYKIPKEDVQSLSQSFFKLEEAKHAFAIEEYSFSQATLEQVFVELTKEQEEEDNSCGTLNSTLWWERTQEDRVVF

SEQ ID NO: 183 - protein, 1617 aa, unidentified
MNMKQKSVYQQTKALLCKNFLKKWRMKRESLLEWGLSILLGLCIALFSSSMRNVQFPGMAPQNLGRVDKFNSSSLMVVYTPISNLTQQIMNKTALAPLLKGTSVIGAPNKTHMDEILLENLPYAMGIIFNETFSYKLIFFQGYNSPLWKEDFSAHCWDGYGEFSCTLTKYWNRGFVALQTAINTAIIEITTNHPVMEELMSVTAITMKTLPFITKNLLHNEMFILFFLLHFSPLVYFISLNVTKERKKSKNLMKMMGLQDSAFWLSWGLIYAGFIFIISIFVTIIITFTQIIVMTGFMVIFILFFLYGLSLVALVFLMSVLLKKAVLTNLVVFLLTLFWGCLGFTVFYEQLPSSLEWILNICSPFAFTTGMIQIIKLDYNLNGVIFPDPSGDSYTMIATFSMLLLDGLIYLLLALYFDKILPYGDERHYSPLFFLNSSSCFQHQRTNAKVIEKEIDAEHPSDDYFEPVAPEFQGKEAIRIRNVKKEYKGKSGKVEALKGLLFDIYEGQITAILGHSGAGKSSLLNILNGLSVPTEGSVTIYNKNLSEMQDLEEIRKITGVCPQFNVQFDILTVKENLSLFAKIKGIHLKEVEQEVQRILLELDMQNIQDNLAKHLSEGQKRKLTFGITILGDPQILLLDEPTTGLDPFSRDQVWSLLRERRADHVILFSTQSMDEADILADRKVIMSNGRLKCAGSSMFLKRRWGLGYHLSLHRNEICNPEQITSFITHHIPDAKLKTENKEKLVYTLPLERTNTFPDLFSDLDKCSDQGVTGYDISMSTLNEVFMKLEGQSTIEQDFEQVEMIRDSESLNEMELAHSSFSEMQTAVSDMGLWRMQVFAMARLRFLKLKRQTKVLLTLLLVFGIAIFPLIVENIMYAMLNEKIDWEFKNELYFLSPGQLPQEPRTSLLIINNTESNIEDFIKSLKHQNILLEVDDFENRNGTDGLSYNGAIIVSGKQKDYRFSVVCNTKRLHCFPILMNIISNGLLQMFNHTQHIRIESSPFPLSHIGLWTGLPDGSFFLFLVLCSISPYITMGSISDYKKNAKSQLWISGLYTSAYWCGQALVDVSFFILILLLMYLIFYIENMQYLLITSQIVFALVIVTPGYAASLVFFIYMISFIFRKRRKNSGLWSFYFFFASTIMFSITLINHFDLSILITTMVLVPSYTLLGFKTFLEVRDQEHYREFPEANFELSATDFLVCFIPYFQTLLFVFVLRCMELKCGKKRMRKDPVFRISPQSRDAKPNPEEPIDEDEDIQTERIRTATALTTSILDEKPVIIASCLHKEYAGQKKSCFSKRKKKIAARNISFCVQEGEILGLLGPNGAGKSSSIRMISGITKPTAGEVELKGCSSVLGHLGYCPQENVLWPMLTLREHLEVYAAVKGLRKADARLAIARLVSAFKLHEQLNVPVQKLTAGITRKLCFVLSLLGNSPVLLLDEPSTGIDPTGQQQMWQAIQAVVKNTERGVLLTTHNLAEAEALCDRVAIMVSGRLRCIGSIQHLKNKLGKDYILELKVKETSQVTLVHTEILKLFPQAAGQERYSSLLTYKLPVADVYPLSQTFHKLEAVKHNFNLEEYSLSQCTLEKVFLELSKEQEVGNFDEEIDTTMRWKLLPHSDEP

SEQ ID NO: 184 - protein, 2146 aa, unidentified
MAFWTQLMLLLWKNFMYRRRQPVQLLVELLWPLFLFFILVAVRHSHPPLEHHECHFPNKPLPSAGTVPWLQGLICNVNNTCFPQLTPGEEPGRLSNFNDSLVSRLLADARTVLGGASAHRTLAGLGKLIATLRAARSTAQPQPTKQSPLEPPMLDVAELLTSLLRTESLGLALGQAQEPLHSLLEAAEDLAQELLALRSLVELRALLQRPRGTSGPLELLSEALCSVRGPSSTVGPSLNWYEASDLMELVGQEPESALPDSSLSPACSELIGALDSHPLSRLLWRRLKPLILGKLLFAPDTPFTRKLMAQVNRTFEELTLLRDVREVWEMLGPRIFTFMNDSSNVAMLQRLLQMQDEGRRQPRPGGRDHMEALRSFLDPGSGGYSWQDAHADVGHLVGTLGRVTECLSLDKLEAAPSEAALVSRALQLLAEHRFWAGVVFLGPEDSSDPTEHPTPDLGPGHVRIKIRMDIDVVTRTNKIRDRFWDPGPAADPLTDLRYVWGGFVYLQDLVERAAVRVLSGANPRAGLYLQQMPYPCYVDDVFLRVLSRSLPLFLTLAWIYSVTLTVKAVVREKETRLRDTMRAMGLSRAVLWLGWFLSCLGPFLLSAALLVLVLKLGDILPYSHPGVVFLFLAAFAVATVTQSFLLSAFFSRANLAAACGGLAYFSLYLPYVLCVAWRDRLPAGGRVAASLLSPVAFGFGCESLALLEEQGEGAQWHNVGTRPTADVFSLAQVSGLLLLDAALYGLATWYLEAVCPGQYGIPEPWNFPFRRSYWCGPRPPKSPAPCPTPLDPKVLVEEAPPGLSPGVSVRSLEKRFPGSPQPALRGLSLDFYQGHITAFLGHNGAGKTTTLSILSGLFPPSGGSAFILGHDVRSSMAAIRPHLGVCPQYNVLFDMLTVDEHVWFYGRLKGLSAAVVGPEQDRLLQDVGLVSKQSVQTRHLSGGMQRKLSVAIAFVGGSQVVILDEPTAGVDPASRRGIWELLLKYREGRTLILSTHHLDEAELLGDRVAVVAGGRLCCCGSPLFLRRHLGSGYYLTLVKARLPLTTNEKADTDMEGSVDTRQEKKNGSQGSRVGTPQLLALVQHWVPGARLVEELPHELVLVLPYTGAHDGSFATLFRELDTRLAELRLTGYGISDTSLEEIFLKVVEECAADTDMEDGSCGQHLCTGIAGLDVTLRLKMPPQETALENGEPAGSAPETDQGSGPDAVGRVQGWALTRQQLQALLLKRFLLARRSRRGLFAQIVLPALFVGLALVFSLIVPPFGHYPALRLSPTMYGAQVSFFSEDAPGDPGRARLLEALLQEAGLEEPPVQHSSHRFSAPEVPAEVAKVLASGNWTPESPSPACQCSRPGARRLLPDCPAAAGGPPPPQAVTGSGEVVQNLTGRNLSDFLVKTYPRLVRQGLKTKKWVNEVRYGGFSLGGRDPGLPSGQELGRSVEELWALLSPLPGGALDRVLKNLTAWAHSLDAQDSLKIWFNNKGWHSMVAFVNRASNAILRAHLPPGPARHAHSITTLNHPLNLTKEQLSEGALMASSVDVLVSICVVFAMSFVPASFTLVLIEERVTRAKHLQLMGGLSPTLYWLGNFLWDMCNYLVPACIVVLIFLAFQQRAYVAPANLPALLLLLLLYGWSITPLMYPASFFFSVPSTAYVVLTCINLFIGINGSMATFVLELFSDQKLQEVSRILKQVFLIFPHFCLGRGLIDMVRNQAMADAFERLGDRQFQSPLRWEVVGKNLLAMVIQGPLFLLFTLLLQHRSQLLPQPRVRSLPLLGEEDEDVARERERVVQGATQGDVLVLRNLTKVYRGQRMPAVDRLCLGIPPGECFGLLGVNGAGKTSTFRMVTGDTLASRGEAVLAGHSVAREPSAAHLSMGYCPQSDAIFELLTGREHLELLARLRGVPEAQVAQTAGSGLARLGLSWYADRPAGTYSGGNKRKLATALALVGDPAVVFLDEPTTGMDPSARRFLWNSLLAVVREGRSVMLTSHSMEECEALCSRLAIMVNGRFRCLGSPQHLKGRFAAGHTLTLRVPAARSQPAAAFVAAEFPGAELREAHGGRLRFQLPPGGRCALARVFGELAVHGAEHGVEDFSVSQTMLEEVFLYFSKDQGKDEDTEEQKEAGVGVDPAPGLQHPKRVSQFLDDPSTAETVL

SEQ ID NO: 185 - protein, 1581 aa, unidentified
MRKRKISVCQQTWALLCKNFLKKWRMKRESLMEWLNSLLLLLCLYIYPHSHQVNDFSSLLTMDLGRVDTFNESRFSVVYTPVTNTTQQIMNKVASTPFLAGKEVLGLPDEESIKEFTANYPEEIVRVTFTNTYSYHLKFLLGHGMPAKKEHKDHTAHCYETNEDVYCEVSVFWKEGFVALQAAINAAIIEITTNHSVMEELMSVTGKNMKMHSFIGQSGVITDLYLFSCIISFSSFIYYASVNVTRERKRMKALMTMMGLRDSAFWLSWGLLYAGFIFIMALFLALVIRSTQFIILSGFMVVFSLFLLYGLSLVALAFLMSILVKKSFLTGLVVFLLTVFWGCLGFTSLYRHLPASLEWILSLLSPFAFMLGMAQLLHLDYDLNSNAFPHPSDGSNLIVATNFMLAFDTCLYLALAIYFEKILPNEYGHRRPPLFFLKSSFWSQTQKTDHVALEDEMDADPSFHDSFEQAPPEFQGKEAIRIRNVTKEYKGKPDKIEALKDLVFDIYEGQITAILGHSGAGKSTLLNILSGLSVPTKGSVTIYNNKLSEMADLENLSKLTGVCPQSNVQFDFLTVRENLRLFAKIKGILPQEVDKEIFLLDEPTAGLDPFSRHQVWNLLKERKTDRVILFSTQFMDEADILADRKVFLSQGKLKCAGSSLFLKKKWGIGYHLSLQLNEICVEENITSLVKQHIPDAKLSAKSEGKLIYTLPLERTNKFPELYKDLDSYPDLGIENYGVSMTTLNEVFLKLEGKSTINESDIAILGEVQAEKADDTERLVEMEQVLSSLNKMRKTIGGVALWRQQICAIARVRLLKLKHERKALLALLLILMAGFCPLLVEYTMVKIYQNSYTWELSPHLYFLAPGQQPHDPLTQLLIINKTGASIDDFIQSVEHQNIALEVDAFGTRNGTDDPSYNGAITVCCNEKNYSFSLACNAKRLNCFPVLMDIVSNGLLGMVKPSVHIRTERSTFLENGQDNPIGFLAYIMFWLVLTSSCPPYIAMSSIDDYKNRARSQLRISGLSPSAYWFGQALVDVSLYFLVFVFIYLMSYISNFEDMLLTIIHIIQIPCAVGYSFSLIFMTYVISFIFRKGRKNSGIWSFCFYVVTVFSVAGFAFSIFESDIPFIFTFLIPPATMIGCLFLSSHLLFSSLFSEERMDVQPFLVFLIPFLHFIIFLFTLRCLEWKFGKKSMRKDPFFRISPRSSDVCQNPEEPEGEDEDVQMERVRTANALNSTNFDEKPVIIASCLRKEYAGKRKGCFSKRKNKIATRNVSFCVRKGEVLGLLGHNGAGKSTSIKVITGDTKPTAGQVLLKGSGGGDALEFLGYCPQENALWPNLTVRQHLEVYAAVKGLRKGDAEVAITRLVDALKLQDQLKSPVKTLSEGIKRKLCFVLSILGNPSVVLLDEPSTGMDPEGQQQMWQAIRATFRNTERGALLTTHYMAEAEAVCDRVAIMVSGRLRCIGSIQHLKSKFGKDYLLEMKVKNLAQVEPLHAEILRLFPQAARQERYSSLMVYKLPVEDVQPLAQAFFKLEKVKQSFDLEEYSLSQSTLEQVFLELSKEQELGDFEEDFDPSVKWKLLPQEEP

SEQ ID NO: 186 - protein, 1624 aa, unidentified
MSKRRMSVGQQTWALLCKNCLKKWRMKRQTLLEWLFSFLLVLFLYLFFSNLHQVHDTPQMSSMDLGRVDSFNDTNYVIAFAPESKTTQEIMNKVASAPFLKGRTIMGWPDEKSMDELDLNYSIDAVRVIFTDTFSYHLKFSWGHRIPMMKEHRDHSAHCQAVNEKMKCEGSEFWEKGFVAFQAAINAAIIEIATNHSVMEQLMSVTGVHMKILPFVAQGGVATDFFIFFCIISFSTFIYYVSVNVTQERQYITSLMTMMGLRESAFWLSWGLMYAGFILIMATLMALIVKSAQIVVLTGFVMVFTLFLLYGLSLITLAFLMSVLIKKPFLTGLVVFLLIVFWGILGFPALYTRLPAFLEWTLCLLSPFAFTVGMAQLIHLDYDVNSNAHLDSSQNPYLIIATLFMLVFDTLLYLVLTLYFDKILPAEYGHRCSPLFFLKSCFWFQHGRANHVVLENETDSDPTPNDCFEPVSPEFCGKEAIRIKNLKKEYAGKCERVEALKGVVFDIYEGQITALLGHSGAGKTTLLNILSGLSVPTSGSVTVYNHTLSRMADIENISKFTGFCPQSNVQFGFLTVKENLRLFAKIKGILPHEVEKEVQRVVQELEMENIQDILAQNLSGGQNRKLTFGIAILGDPQVLLLDEPTAGLDPLSRHRIWNLLKEGKSDRVILFSTQFIDEADILADRKVFISNGKLKCAGSSLFLKKKWGIGYHLSLHLNERCDPESITSLVKQHISDAKLTAQSEEKLVYILPLERTNKFPELYRDLDRCSNQGIEDYGVSITTLNEVFLKLEGKSTIDESDIGIWGQLQTDGAKDIGSLVELEQVLSSFHETRKTISGVALWRQQVCAIAKVRFLKLKKERKSLWTILLLFGISFIPQLLEHLFYESYQKSYPWELSPNTYFLSPGQQPQDPLTHLLVINKTGSTIDNFLHSLRRQNIAIEVDAFGTRNGTDDPSYNGAIIVSGDEKDHRFSIACNTKRLNCFPVLLDVISNGLLGIFNSSEHIQTDRSTFFEEHMDYEYGYRSNTFFWIPMAASFTPYIAMSSIGDYKKKAHSQLRISGLYPSAYWFGQALVDVSLYFLILLLMQIMDYIFSPEEIIFIIQNLLIQILCSIGYVSSLVFLTYVISFIFRNGRKNSGIWSFFFLIVVIFSIVATDLNEYGFLGLFFGTMLIPPFTLIGSLFIFSEISPDSMDYLGASESEIVYLALLIPYLHFLIFLFILRCLEMNCRKKLMRKDPVFRISPRSNAIFPNPEEPEGEEEDIQMERMRTVNAMAVRDFDETPVIIASCLRKEYAGKKKNCFSKRKKKIATRNVSFCVKKGEVIGLLGHNGAGKSTTIKMITGDTKPTAGQVILKGSGGGEPLGFLGYCPQENALWPNLTVRQHLEVYAAVKGLRKGDAMIAITRLVDALKLQDQLKAPVKTLSEGIKRKLCFVLSILGNPSVVLLDEPSTGMDPEGQQQMWQVIRATFRNTERGALLTTHYMAEAEAVCDRVAIMVSGRLRCIGSIQHLKSKFGKDYLLEMKLKNLAQMEPLHAEILRLFPQAAQQERFSSLMVYKLPVEDVRPLSQAFFKLEIVKQSFDLEEYSLSQSTLEQVFLELSKEQELGDLEEDFDPSVKWKLLLQEEP

SEQ ID NO: 187 - protein, 1280 aa, unidentified
MDLEGDRNGGAKKKNFFKLNNKSEKDKKEKKPTVSVFSMFRYSNWLDKLYMVVGTLAAIIHGAGLPLMMLVFGEMTDIFANAGNLEDLMSNITNRSDINDTGFFMNLEEDMTRYAYYYSGIGAGVLVAAYIQVSFWCLAAGRQIHKIRKQFFHAIMRQEIGWFDVHDVGELNTRLTDDVSKINEGIGDKIGMFFQSMATFFTGFIVGFTRGWKLTLVILAISPVLGLSAAVWAKILSSFTDKELLAYAKAGAVAEEVLAAIRTVIAFGGQKKELERYNKNLEEAKRIGIKKAITANISIGAAFLLIYASYALAFWYGTTLVLSGEYSIGQVLTVFFSVLIGAFSVGQASPSIEAFANARGAAYEIFKIIDNKPSIDSYSKSGHKPDNIKGNLEFRNVHFSYPSRKEVKILKGLNLKVQSGQTVALVGNSGCGKSTTVQLMQRLYDPTEGMVSVDGQDIRTINVRFLREIIGVVSQEPVLFATTIAENIRYGRENVTMDEIEKAVKEANAYDFIMKLPHKFDTLVGERGAQLSGGQKQRIAIARALVRNPKILLLDEATSALDTESEAVVQVALDKARKGRTTIVIAHRLSTVRNADVIAGFDDGVIVEKGNHDELMKEKGIYFKLVTMQTAGNEVELENAADESKSEIDALEMSSNDSRSSLIRKRSTRRSVRGSQAQDRKLSTKEALDESIPPVSFWRIMKLNLTEWPYFVVGVFCAIINGGLQPAFAIIFSKIIGVFTRIDDPETKRQNSNLFSLLFLALGIISFITFFLQGFTFGKAGEILTKRLRYMVFRSMLRQDVSWFDDPKNTTGALTTRLANDAAQVKGAIGSRLAVITQNIANLGTGIIISFIYGWQLTLLLLAIVPIIAIAGVVEMKMLSGQALKDKKELEGSGKIATEAIENFRTVVSLTQEQKFEHMYAQSLQVPYRNSLRKAHIFGITFSFTQAMMYFSYAGCFRFGAYLVAHKLMSFEDVLLVFSAVVFGAMAVGQVSSFAPDYAKAKISAAHIIMIIEKTPLIDSYSTEGLMPNTLEGNVTFGEVVFNYPTRPDIPVLQGLSLEVKKGQTLALVGSSGCGKSTVVQLLERFYDPLAGKVLLDGKEIKRLNVQWLRAHLGIVSQEPILFDCSIAENIAYGDNSRVVSQEEIVRAAKEANIHAFIESLPNKYSTKVGDKGTQLSGGQKQRIAIARALVRQPHILLLDEATSALDTESEKVVQEALDKAREGRTCIVIAHRLSTIQNADLIVVFQNGRVKEHGTHQQLLAQKGIYFSMVSVQAGTKRQ

SEQ ID NO: 188 - protein, 738 aa, unidentified
MRGPPAWPLRLLEPPSPAEPGRLLPVACVWAAASRVPGSLSPFTGLRPARLWGAGPALLWGVGAARRWRSGCRGGGPGASRGVLGLARLLGLWARGPGSCRCGAFAGPGAPRLPRARFPGGPAAAAWAGDEAWRRGPAAPPGDKGRLRPAAAGLPEARKLLGLAYPERRRLAAAVGFLTMSSVISMSAPFFLGKIIDVIYTNPTVDYSDNLTRLCLGLSAVFLCGAAANAIRVYLMQTSGQRIVNRLRTSLFSSILRQEVAFFDKTRTGELINRLSSDTALLGRSVTENLSDGLRAGAQASVGISMMFFVSPNLATFVLSVVPPVSIIAVIYGRYLRKLTKVTQDSLAQATQLAEERIGNVRTVRAFGKEMTEIEKYASKVDHVMQLARKEAFARAGFFGATGLSGNLIVLSVLYKGGLLMGSAHMTVGELSSFLMYAFWVGISIGGLSSFYSELMKGLGAGGRLWELLEREPKLPFNEGVILNEKSFQGALEFKNVHFAYPARPEVPIFQDFSLSIPSGSVTALVGPSGSGKSTVLSLLLRLYDPASGTISLDGHDIRQLNPVWLRSKIGTVSQEPILFSCSIAENIAYGADDPSSVTAEEIQRVAEVANAVAFIRNFPQGFNTVVGEKGVLLSGGQKQRIAIARALLKNPKILLLDEATSALDAENEYLVQEALDRLMDGRTVLVIAHRLSTIKNANMVAVLDQGKITEYGKHEELLSKPNGIYRKLMNKQSFISA

SEQ ID NO: 189 - protein, 1321 aa, unidentified
MSDSVILRSIKKFGEENDGFESDKSYNNDKKSRLQDEKKGDGVRVGFFQLFRFSSSTDIWLMFVGSLCAFLHGIAQPGVLLIFGTMTDVFIDYDVELQELQIPGKACVNNTIVWTNSSLNQNMTNGTRCGLLNIESEMIKFASYYAGIAVAVLITGYIQICFWVIAAARQIQKMRKFYFRRIMRMEIGWFDCNSVGELNTRFSDDINKINDAIADQMALFIQRMTSTICGFLLGFFRGWKLTLVIISVSPLIGIGAATIGLSVSKFTDYELKAYAKAGVVADEVISSMRTVAAFGGEKREVERYEKNLVFAQRWGIRKGIVMGFFTGFVWCLIFLCYALAFWYGSTLVLDEGEYTPGTLVQIFLSVIVGALNLGNASPCLEAFATGRAAATSIFETIDRKPIIDCMSEDGYKLDRIKGEIEFHNVTFHYPSRPEVKILNDLNMVIKPGEMTALVGPSGAGKSTALQLIQRFYDPCEGMVTVDGHDIRSLNIQWLRDQIGIVEQEPVLFSTTIAENIRYGREDATMEDIVQAAKEANAYNFIMDLPQQFDTLVGEGGGQMSGGQKQRVAIARALIRNPKILLLDMATSALDNESEAMVQEVLSKIQHGHTIISVAHRLSTVRAADTIIGFEHGTAVERGTHEELLERKGVYFTLVTLQSQGNQALNEEDIKDATEDDMLARTFSRGSYQDSLRASIRQRSKSQLSYLVHEPPLAVVDHKSTYEEDRKDKDIPVQEEVEPAPVRRILKFSAPEWPYMLVGSVGAAVNGTVTPLYAFLFSQILGTFSIPDKEEQRSQINGVCLLFVAMGCVSLFTQFLQGYAFAKSGELLTKRLRKFGFRAMLGQDIAWFDDLRNSPGALTTRLATDASQVQGAAGSQIGMIVNSFTNVTVAMIIAFSFSWKLSLVILCFFPFLALSGATQTRMLTGFASRDKQALEMVGQITNEALSNIRTVAGIGKERRFIEALETELEKPFKTAIQKANIYGFCFAFAQCIMFIANSASYRYGGYLISNEGLHFSYVFRVISAVVLSATALGRAFSYTPSYAKAKISAARFFQLLDRQPPISVYNTAGEKWDNFQGKIDFVDCKFTYPSRPDSQVLNGLSVSISPGQTLAFVGSSGCGKSTSIQLLERFYDPDQGKVMIDGHDSKKVNVQFLRSNIGIVSQEPVLFACSIMDNIKYGDNTKEIPMERVIAAAKQAQLHDFVMSLPEKYETNVGSQGSQLSRGEKQRIAIARAIVRDPKILLLDEATSALDTESEKTVQVALDKAREGRTCIVIAHRLSTIQNADIIAVMAQGVVIEKGTHEELMAQKGAYYKLVTTGSPIS

SEQ ID NO: 190 - protein, 1286 aa, unidentified
MDLEAAKNGTAWRPTSAEGDFELGISSKQKRKKTKTVKMIGVLTLFRYSDWQDKLFMSLGTIMAIAHGSGLPLMMIVFGEMTDKFVDTAGNFSFPVNFSLSLLNPGKILEEEMTRYAYYYSGLGAGVLVAAYIQVSFWTLAAGRQIRKIRQKFFHAILRQEIGWFDINDTTELNTRLTDDISKISEGIGDKVGMFFQAVATFFAGFIVGFIRGWKLTLVIMAISPILGLSAAVWAKILSAFSDKELAAYAKAGAVAEEALGAIRTVIAFGGQNKELERYQKHLENAKEIGIKKAISANISMGIAFLLIYASYALAFWYGSTLVISKEYTIGNAMTVFFSILIGAFSVGQAAPCIDAFANARGAAYVIFDIIDNNPKIDSFSERGHKPDSIKGNLEFNDVHFSYPSRANVKILKGLNLKVQSGQTVALVGSSGCGKSTTVQLIQRLYDPDEGTINIDGQDIRNFNVNYLREIIGVVSQEPVLFSTTIAENICYGRGNVTMDEIKKAVKEANAYEFIMKLPQKFDTLVGERGAQLSGGQKQRIAIARALVRNPKILLLDEATSALDTESEAEVQAALDKAREGRTTIVIAHRLSTVRNADVIAGFEDGVIVEQGSHSELMKKEGVYFKLVNMQTSGSQIQSEEFELNDEKAATRMAPNGWKSRLFRHSTQKNLKNSQMCQKSLDVETDGLEANVPPVSFLKVLKLNKTEWPYFVVGTVCAIANGGLQPAFSVIFSEIIAIFGPGDDAVKQQKCNIFSLIFLFLGIISFFTFFLQGFTFGKAGEILTRRLRSMAFKAMLRQDMSWFDDHKNSTGALSTRLATDAAQVQGATGTRLALIAQNIANLGTGIIISFIYGWQLTLLLLAVVPIIAVSGIVEMKLLAGNAKRDKKELEAAGKIATEAIENIRTVVSLTQERKFESMYVEKLYGPYRNSVQKAHIYGITFSISQAFMYFSYAGCFRFGAYLIVNGHMRFRDVILVFSAIVFGAVALGHASSFAPDYAKAKLSAAHLFMLFERQPLIDSYSEEGLKPDKFEGNITFNEVVFNYPTRANVPVLQGLSLEVKKGQTLALVGSSGCGKSTVVQLLERFYDPLAGTVFVDFGFQLLDGQEAKKLNVQWLRAQLGIVSQEPILFDCSIAENIAYGDNSRVVSQDEIVSAAKAANIHPFIETLPHKYETRVGDKGTQLSGGQKQRIAIARALIRQPQILLLDEATSALDTESEKVVQEALDKAREGRTCIVIAHRLSTIQNADLIVVFQNGRVKEHGTHQQLLAQKGIYFSMVSVQAGTQNL

SEQ ID NO: 191 - protein, 1257 aa, unidentified
MENSERAEEMQENYQRNGTAEEQPKLRKEAVGSIEIFRFADGLDITLMILGILASLVNGACLPLMPLVLGEMSDNLISGCLVQTNTTNYQNCTQSQEKLNEDMTLLTLYYVGIGVAALIFGYIQISLWIITAARQTKRIRKQFFHSVLAQDIGWFDSCDIGELNTRMTDDIDKISDGIGDKIALLFQNMSTFSIGLAVGLVKGWKLTLVTLSTSPLIMASAAACSRMVISLTSKELSAYSKAGAVAEEVLSSIRTVIAFRAQEKELQRYTQNLKDAKDFGIKRTIASKVSLGAVYFFMNGTYGLAFWYGTSLILNGEPGYTIGTVLAVFFSVIHSSYCIGAAVPHFETFAIARGAAFHIFQVIDKKPSIDNFSTAGYKPESIEGTVEFKNVSFNYPSRPSIKILKGLNLRIKSGETVALVGLNGSGKSTVVQLLQRLYDPDDGFIMVDENDIRALNVRHYRDHIGVVSQEPVLFGTTISNNIKYGRDDVTDEEMERAAREANAYDFIMEFPNKFNTLVGEKGAQMSGGQKQRIAIARALVRNPKILILDEATSALDSESKSAVQAALEKASKGRTTIVVAHRLSTIRSADLIVTLKDGMLAEKGAHAELMAKRGLYYSLVMSQDIKKADEQMESMTYSTERKTNSLPLHSVKSIKSDFIDKAEESTQSKEISLPEVSLLKILKLNKPEWPFVVLGTLASVLNGTVHPVFSIIFAKIITMFGNNDKTTLKHDAEIYSMIFVILGVICFVSYFMQGLFYGRAGEILTMRLRHLAFKAMLYQDIAWFDEKENSTGGLTTILAIDIAQIQGATGSRIGVLTQNATNMGLSVIISFIYGWEMTFLILSIAPVLAVTGMIETAAMTGFANKDKQELKHAGKIATEALENIRTIVSLTREKAFEQMYEEMLQTQHRNTSKKAQIIGSCYAFSHAFIYFAYAAGFRFGAYLIQAGRMTPEGMFIVFTAIAYGAMAIGETLVLAPEYSKAKSGAAHLFALLEKKPNIDSRSQEGKKPDTCEGNLEFREVSFFYPCRPDVFILRGLSLSIERGKTVAFVGSSGCGKSTSVQLLQRLYDPVQGQVLFDGVDAKELNVQWLRSQIAIVPQEPVLFNCSIAENIAYGDNSRVVPLDEIKEAANAANIHSFIEGLPEKYNTQVGLKGAQLSGGQKQRLAIARALLQKPKILLLDEATSALDNDSEKVVQHALDKARTGRTCLVVTHRLSAIQNADLIVVLHNGKIKEQGTHQELLRNRDIYFKLVNAQSVQ

SEQ ID NO: 192 - protein, 842 aa, unidentified
MVTVGNYCEAEGPVGPAWMQDGLSPCFFFTLVPSTRMALGTLALVLALPCRRRERPAGADSLSWGAGPRISPYVLQLLLATLQAALPLAGLAGRVGTARGAPLPSYLLLASVLESLAGACGLWLLVVERSQARQRLAMGIWIKFRHSPGLLLLWTVAFAAENLALVSWNSPQWWWARADLGQQVQFSLWVLRYVVSGGLFVLGLWAPGLRPQSYTLQVHEEDQDVERSQVRSAAQQSTWRDFGRKLRLLSGYLWPRGSPALQLVVLICLGLMGLERALNVLVPIFYRNIVNLLTEKAPWNSLAWTVTSYVFLKFLQGGGTGSTGFVSNLRTFLWIRVQQFTSRRVELLIFSHLHELSLRWHLGRRTGEVLRIADRGTSSVTGLLSYLVFNVIPTLADIIIGIIYFSMFFNAWFGLIVFLCMSLYLTLTIVVTEWRTKFRRAMNTQENATRARAVDSLLNFETVKYYNAESYEVERYREAIIKYQGLEWKSSASLVLLNQTQNLVIGLGLLAGSLLCAYFVTEQKLQVGDYVLFGTYIIQLYMPLNWFGTYYRMIQTNFIDMENMFDLLKEETEVKDLPGAGPLRFQKGRIEFENVHFSYADGRETLQDVSFTVMPGQTLALVGPSGAGKSTILRLLFRFYDISSGCIRIDGQDISQVTQASLRSHIGVVPQDTVLFNDTIADNIRYGRVTAGNDEVEAAAQAAGIHDAIMAFPEGYRTQVGERGLKLSGGEKQRVAIARTILKAPGIILLDEATSALDTSNERAIQASLAKVCANRTTIVVAHRLSTVVNADQILVIKDGCIVERGRHEALLSRGGVYADMWQLQQGQEETSEDTKPQTMER

SEQ ID NO: 193 - protein, 752 aa, unidentified
MALLAMHSWRWAAAAAAFEKRRHSAILIRPLVSVSGSGPQWRPHQLGALGTARAYQIPESLKSITWQRLGKGNSGQFLDAAKALQVWPLIEKRTCWHGHAGGGLHTDPKEGLKDVDTRKIIKAMLSYVWPKDRPDLRARVAISLGFLGGAKAMNIVVPFMFKYAVDSLNQMSGNMLNLSDAPNTVATMATAVLIGYGVSRAGAAFFNEVRNAVFGKVAQNSIRRIAKNVFLHLHNLDLGFHLSRQTGALSKAIDRGTRGISFVLSALVFNLLPIMFEVMLVSGVLYYKCGAQFALVTLGTLGTYTAFTVAVTRWRTRFRIEMNKADNDAGNAAIDSLLNYETVKYFNNERYEAQRYDGFLKTYETASLKSTSTLAMLNFGQSAIFSVGLTAIMVLASQGIVAGTLTVGDLVMVNGLLFQLSLPLNFLGTVYRETRQALIDMNTLFTLLKVDTQIKDKVMASPLQITPQTATVAFDNVHFEYIEGQKVLSGISFEVPAGKKVAIVGGSGSGKSTIVRLLFRFYEPQKGSIYLAGQNIQDVSLESLRRAVGVVPQDAVLFHNTIYYNLLYGNISASPEEVYAVAKLAGLHDAILRMPHGYDTQVGERGLKLSGGEKQRVAIARAILKDPPVILYDEATSSLDSITEETILGAMKDVVKHRTSIFIAHRLSTVVDADEIIVLDQGKVAERGTHHGLLANPHSIYSEMWHTQSSRVQNHDNPKWEAKKENISKEEERKKLQEEIVNSVKGCGNCSC

SEQ ID NO: 194 - protein, 735 aa, unidentified
MLVHLFRVGIRGGPFPGRLLPPLRFQTFSAVRNTWRNGKTGQLHKAEGEYSDGYRSSSLLRAVAHLRSQLWAHLPRAPLAPRWSPSAWCWVGGALLGPMVLSKHPHLCLVALCEAEEAPPASSTPHVVGSRFNWKLFWQFLHPHLLVLGVAVVLALGAALVNVQIPLLLGQLVEVVAKYTRDHVGSFMTESQNLSTHLLILYGVQGLLTFGYLVLLSHVGERMAVDMRRALFSSLLRQDITFFDANKTGQLVSRLTTDVQEFKSSFKLVISQGLRSCTQVAGCLVSLSMLSTRLTLLLMVATPALMGVGTLMGSGLRKLSRQCQEQIARAMGVADEALGNVRTVRAFAMEQREEERYGAELEACRCRAEELGRGIALFQGLSNIAFNCMVLGTLFIGGSLVAGQQLTGGDLMSFLVASQTVQRSMANLSVLFGQVVRGLSAGARVFEYMALNPCIPLSGGCCVPKEQLRGSVTFQNVCFSYPCRPGFEVLKDFTLTLPPGKIVALVGQSGGGKTTVASLLERFYDPTAGVVMLDGRDLRTLDPSWLRGQVVGFISQEPVLFGTTIMENIRFGKLEASDEEVYTAAREANAHEFITSFPEGYNTVVGERGTTLSGGQKQRLAIARALIKQPTVLILDEATSALDAESERVVQEALDRASAGRTVLVIAHRLSTVRGAHCIVVMADGRVWEAGTHEELLKKGGLYAELIRRQALDAPRTAAPPPKKPEGPRSHQHKS

SEQ ID NO: 195 - protein, 766 aa, unidentified
MRLWKAVVVTLAFMSVDICVTTAIYVFSHLDRSLLEDIRHFNIFDSVLDLWAACLYRSCLLLGATIGVAKNSALGPRRLRASWLVITLVCLFVGIYAMVKLLLFSEVRRPIRDPWFWALFVWTYISLGASFLLWWLLSTVRPGTQALEPGAATEAEGFPGSGRPPPEQASGATLQKLLSYTKPDVAFLVAASFFLIVAALGETFLPYYTGRAIDGIVIQKSMDQFSTAVVIVCLLAIGSSFAAGIRGGIFTLIFARLNIRLRNCLFRSLVSQETSFFDENRTGDLISRLTSDTTMVSDLVSQNINVFLRNTVKVTGVVVFMFSLSWQLSLVTFMGFPIIMMVSNIYGKYYKRLSKEVQNALARASNTAEETISAMKTVRSFANEEEEAEVYLRKLQQVYKLNRKEAAAYMYYVWGSGLTLLVVQVSILYYGGHLVISGQMTSGNLIAFIIYEFVLGDCMESVGSVYSGLMQGVGAAEKVFEFIDRQPTMVHDGSLAPDHLEGRVDFENVTFTYRTRPHTQVLQNVSFSLSPGKVTALVGPSGSGKSSCVNILENFYPLEGGRVLLDGKPISAYDHKYLHRVISLVSQEPVLFARSITDNISYGLPTVPFEMVVEAAQKANAHGFIMELQDGYSTETGEKGAQLSGGQKQRVAMARALVRNPPVLILDEATSALDAESEYLIQQAIHGNLQKHTVLIIAHRLSTVEHAHLIVVLDKGRVVQQGTHQQLLAQGGLYAKLVQRQMLGLQPAADFTAGHNEPVANGSHKA

SEQ ID NO: 196 - protein, 1531 aa, unidentified
MALRGFCSADGSDPLWDWNVTWNTSNPDFTKCFQNTVLVWVPCFYLWACFPFYFLYLSRHDRGYIQMTPLNKTKTALGFLLWIVCWADLFYSFWERSRGIFLAPVFLVSPTLLGITMLLATFLIQLERRKGVQSSGIMLTFWLVALVCALAILRSKIMTALKEDAQVDLFRDITFYVYFSLLLIQLVLSCFSDRSPLFSETIHDPNPCPESSASFLSRITFWWITGLIVRGYRQPLEGSDLWSLNKEDTSEQVVPVLVKNWKKECAKTRKQPVKVVYSSKDPAQPKESSKVDANEEVEALIVKSPQKEWNPSLFKVLYKTFGPYFLMSFFFKAIHDLMMFSGPQILKLLIKFVNDTKAPDWQGYFYTVLLFVTACLQTLVLHQYFHICFVSGMRIKTAVIGAVYRKALVITNSARKSSTVGEIVNLMSVDAQRFMDLATYINMIWSAPLQVILALYLLWLNLGPSVLAGVAVMVLMVPVNAVMAMKTKTYQVAHMKSKDNRIKLMNEILNGIKVLKLYAWELAFKDKVLAIRQEELKVLKKSAYLSAVGTFTWVCTPFLVALCTFAVYVTIDENNILDAQTAFVSLALFNILRFPLNILPMVISSIVQASVSLKRLRIFLSHEELEPDSIERRPVKDGGGTNSITVRNATFTWARSDPPTLNGITFSIPEGALVAVVGQVGCGKSSLLSALLAEMDKVEGHVAIKGSVAYVPQQAWIQNDSLRENILFGCQLEEPYYRSVIQACALLPDLEILPSGDRTEIGEKGVNLSGGQKQRVSLARAVYSNADIYLFDDPLSAVDAHVGKHIFENVIGPKGMLKNKTRILVTHSMSYLPQVDVIIVMSGGKISEMGSYQELLARDGAFAEFLRTYASTEQEQDAEENGVTGVSGPGKEAKQMENGMLVTDSAGKQLQRQLSSSSSYSGDISRHHNSTAELQKAEAKKEETWKLMEADKAQTGQVKLSVYWDYMKAIGLFISFLSIFLFMCNHVSALASNYWLSLWTDDPIVNGTQEHTKVRLSVYGALGISQGIAVFGYSMAVSIGGILASRCLHVDLLHSILRSPMSFFERTPSGNLVNRFSKELDTVDSMIPEVIKMFMGSLFNVIGACIVILLATPIAAIIIPPLGLIYFFVQRFYVASSRQLKRLESVSRSPVYSHFNETLLGVSVIRAFEEQERFIHQSDLKVDENQKAYYPSIVANRWLAVRLECVGNCIVLFAALFAVISRHSLSAGLVGLSVSYSLQVTTYLNWLVRMSSEMETNIVAVERLKEYSETEKEAPWQIQETAPPSSWPQVGRVEFRNYCLRYREDLDFVLRHINVTINGGEKVGIVGRTGAGKSSLTLGLFRINESAEGEIIIDGINIAKIGLHDLRFKITIIPQDPVLFSGSLRMNLDPFSQYSDEEVWTSLELAHLKDFVSALPDKLDHECAEGGENLSVGQRQLVCLARALLRKTKILVLDEATAAVDLETDDLIQSTIRTQFEDCTVLTIAHRLNTIMDYTRVIVLDKGEIQEYGAPSDLLQQRGLFYSMAKDAGLV

SEQ ID NO: 197 - protein, 1492 aa, unidentified
MERLLAQLCGSSAAWPLPLWEGDTTGHCFTQLVLSALPHALLAVLSACYLGTPRSPDYILPCSPGWRLRLAASFLLSVFPLLDLLPVALPPGAGPGPIGLEVLAGCVAAVAWISHSLALWVLAHSPHGHSRGPLALALVALLPAPALVLTVLWHCQRGTLLPPLLPGPMARLCLLILQLAALLAYALGWAAPGGPREPWAQEPLLPEDQEPEVAEDGESWLSRFSYAWLAPLLARGACGELRQPQDICRLPHRLQPTYLARVFQAHWQEGARLWRALYGAFGRCYLALGLLKLVGTMLGFSGPLLLSLLVGFLEEGQEPLSHGLLYALGLAGGAVLGAVLQNQYGYEVYKVTLQARGAVLNILYCKALQLGPSRPPTGEALNLLGTDSERLLNFAGSFHEAWGLPLQLAITLYLLYQQVGVAFVGGLILALLLVPVNKVIATRIMASNQEMLQHKDARVKLVTELLSGIRVIKFCGWEQALGARVEACRARELGRLRVIKYLDAACVYLWAALPVVISIVIFITYVLMGHQLTATKVFTALALVRMLILPLNNFPWVINGLLEAKVSLDRIQLFLDLPNHNPQAYYSPDPPAEPSTVLELHGALFSWDPVGTSLETFISHLEVKKGMLVGIVGKVGCGKSSLLAAIAGELHRLRGHVAVRGLSKGFGLATQEPWIQFATIRDNILFGKTFDAQLYKEVLEACALNDDLSILPAGDQTEVGEKGVTLSGGQRARIALARAVYQEKELYLLDDPLAAVDADVANHLLHRCILGMLSYTTRLLCTHRTEYLERADAVLLMEAGRLIRAGPPSEILPLVQAVPKAWAENGQESDSATAQSVQNPEKTKEGLEEEQSTSGRLLQEESKKEGAVALHVYQAYWKAVGQGLALAILFSLLLMQATRNAADWWLSHWISQLKAENSSQEAQPSTSPASMGLFSPQLLLFSPGNLYIPVFPLPKAAPNGSSDIRFYLTVYATIAGVNSLCTLLRAVLFAAGTLQAAATLHRRLLHRVLMAPVTFFNATPTGRILNRFSSDVACADDSLPFILNILLANAAGLLGLLAVLGSGLPWLLLLLPPLSIMYYHVQRHYRASSRELRRLGSLTLSPLYSHLADTLAGLSVLRATGATYRFEEENLRLLELNQRCQFATSATMQWLDIRLQLMGAAVVSAIAGIALVQHQQGLANPGLVGLSLSYALSLTGLLSGLVSSFTQTEAMLVSVERLEEYTCDLPQEPQGQPLQLGTGWLTQGGVEFQDVVLAYRPGLPNALDGVTFCVQPGEKLGIVGRTGSGKSSLLLVLFRLLEPSSGRVLLDGVDTSQLELAQLRSQLAIIPQEPFLFSGTVRENLDPQGLHKDRALWQALKQCHLSEVITSMGGLDGELGEGGRSLSLGQRQLLCLARALLTDAKILCIDEATASVDQKTDQLLQQTICKRFANKTVLTIAHRLNTILNSDRVLVLQAGRVVELDSPATLRNQPHSLFQQLLQSSQQGVPASLGGP

SEQ ID NO: 198 - protein, 1382 aa, unidentified
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHITSGEAISFFTGDVNYLFEGVCYGPLVLITCASLVICSISSYFIIGYTAFIAILCYLLVFPLAVFMTRMAVKAQHHTSEVSDQRIRVTSEVLTCIKLIKMYTWEKPFAKIIEDLRRKERKLLEKCGLVQSLTSITLFIIPTVATAVWVLIHTSLKLKLTASMAFSMLASLNLLRLSVFFVPIAVKGLTNSKSAVMRFKKFFLQESPVFYVQTLQDPSKALVFEEATLSWQQTCPGIVNGALELERNGHASEGMTRPRDALGPEEEGNSLGPELHKINLVVSKGMMLGVCGNTGSGKSSLLSAILEEMHLLEGSVGVQGSLAYVPQQAWIVSGNIRENILMGGAYDKARYLQVLHCCSLNRDLELLPFGDMTEIGERGLNLSGGQKQRISLARAVYSDRQIYLLDDPLSAVDAHVGKHIFEECIKKTLRGKTVVLVTHQLQYLEFCGQIILLENGKICENGTHSELMQKKGKYAQLIQKMHKEATSDMLQDTAKIAEKPKVESQALATSLEESLNGNAVPEHQLTQEEEMEEGSLSWRVYHHYIQAAGGYMVSCIIFFFVVLIVFLTIFSFWWLSYWLEQGSGTNSSRESNGTMADLGNIADNPQLSFYQLVYGLNALLLICVGVCSSGIFTKVTRKASTALHNKLFNKVFRCPMSFFDTIPIGRLLNCFAGDLEQLDQLLPIFSEQFLVLSLMVIAVLLIVSVLSPYILLMGAIIMVICFIYYMMFKKAIGVFKRLENYSRSPLFSHILNSLQGLSSIHVYGKTEDFISQFKRLTDAQNNYLLLFLSSTRWMALRLEIMTNLVTLAVALFVAFGISSTPYSFKVMAVNIVLQLASSFQATARIGLETEAQFTAVERILQYMKMCVSEAPLHMEGTSCPQGWPQHGEIIFQDYHMKYRDNTPTVLHGINLTIRGHEVVGIVGRTGSGKSSLGMALFRLVEPMAGRILIDGVDICSIGLEDLRSKLSVIPQDPVLLSGTIRFNLDPFDRHTDQQIWDALERTFLTKAISKFPKKLHTDVVENGGNFSVGERQLLCIARAVLRNSKIILIDEATASIDMETDTLIQRTIREAFQGCTVLVIAHRVTTVLNCDHILVMGNGKVVEFDRPEVLRKKPGSLFAALMATATSSLR

SEQ ID NO: 199 - protein, 1359 aa, unidentified
MVGEGPYLISDLDQRGRRRSFAERYDPSLKTMIPVRPCARLAPNPVDDAGLLSFATFSWLTPVMVKGYRQRLTVDTLPPLSTYDSSDTNAKRFRVLWDEEVARVGPEKASLSHVVWKFQRTRVLMDIVANILCIIMAAIGPVILIHQILQQTERTSGKVWVGIGLCIALFATEFTKVFFWALAWAINYRTAIRLKVALSTLVFENLVSFKTLTHISVGEVLNILSSDSYSLFEAALFCPLPATIPILMVFCAAYAFFILGPTALIGISVYVIFIPVQMFMAKLNSAFRRSAILVTDKRVQTMNEFLTCIRLIKMYAWEKSFTNTIQDIRRRERKLLEKAGFVQSGNSALAPIVSTIAIVLTLSCHILLRRKLTAPVAFSVIAMFNVMKFSIAILPFSIKAMAEANVSLRRMKKILIDKSPPSYITQPEDPDTVLLLANATLTWEHEASRKSTPKKLQNQKRHLCKKQRSEAYSERSPPAKGATGPEEQSDSLKSVLHSISFVVRKGKILGICGNVGSGKSSLLAALLGQMQLQKGVVAVNGTLAYVSQQAWIFHGNVRENILFGEKYDHQRYQHTVRVCGLQKDLSNLPYGDLTEIGERGLNLSGGQRQRISLARAVYSDRQLYLLDDPLSAVDAHVGKHVFEECIKKTLRGKTVVLVTHQLQFLESCDEVILLEDGEICEKGTHKELMEERGRYAKLIHNLRGLQFKDPEHLYNAAMVEAFKESPAEREEDAGIIVLAPGNEKDEGKESETGSEFVDTKVPEHQLIQTESPQEGTVTWKTYHTYIKASGGYLLSLFTVFLFLLMIGSAAFSNWWLGLWLDKGSRMTCGPQGNRTMCEVGAVLADIGQHVYQWVYTASMVFMLVFGVTKGFVFTKTTLMASSSLHDTVFDKILKSPMSFFDTTPTGRLMNRFSKDMDELDVRLPFHAENFLQQFFMVVFILVILAAVFPAVLLVVASLAVGFFILLRIFHRGVQELKKVENVSRSPWFTHITSSMQGLGIIHAYGKKESCITYHLLYFNCALRWFALRMDVLMNILTFTVALLVTLSFSSISTSSKGLSLSYIIQLSGLLQVCVRTGTETQAKFTSVELLREYISTCVPECTHPLKVGTCPKDWPSRGEITFRDYQMRYRDNTPLVLDSLNLNIQSGQTVGIVGRTGSGKSSLGMALFRLVEPASGTIFIDEVDICILSLEDLRTKLTVIPQDPVLFVGTVRYNLDPFESHTDEMLWQVLERTFMRDTIMKLPEKLQAEVTENGENFSVGERQLLCVARALLRNSKIILLDEATASMDSKTDTLVQNTIKDAFKGCTVLTIAHRLNTVLNCDHVLVMENGKVIEFDKPEVLAEKPDSAFAMLLAAEVRL

SEQ ID NO: 200 - protein, 1545 aa, unidentified
MLEKFCNSTFWNSSFLDSPEADLPLCFEQTVLVWIPLGYLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARRALQRRQEKSSQQNSGARLPGLNKNQSQSQDALVLEDVEKKKKKSGTKKDVPKSWLMKALFKTFYMVLLKSFLLKLVNDIFTFVSPQLLKLLISFASDRDTYLWIGYLCAILLFTAALIQSFCLQCYFQLCFKLGVKVRTAIMASVYKKALTLSNLARKEYTVGETVNLMSVDAQKLMDVTNFMHMLWSSVLQIVLSIFFLWRELGPSVLAGVGVMVLVIPINAILSTKSKTIQVKNMKNKDKRLKIMNEILSGIKILKYFAWEPSFRDQVQNLRKKELKNLLAFSQLQCVVIFVFQLTPVLVSVVTFSVYVLVDSNNILDAQKAFTSITLFNILRFPLSMLPMMISSMLQASVSTERLEKYLGGDDLDTSAIRHDCNFDKAMQFSEASFTWEHDSEATVRDVNLDIMAGQLVAVIGPVGSGKSSLISAMLGEMENVHGHITIKGTTAYVPQQSWIQNGTIKDNILFGTEFNEKRYQQVLEACALLPDLEMLPGGDLAEIGEKGINLSGGQKQRISLARATYQNLDIYLLDDPLSAVDAHVGKHIFNKVLGPNGLLKGKTRLLVTHSMHFLPQVDEIVVLGNGTIVEKGSYSALLAKKGEFAKNLKTFLRHTGPEEEATVHDGSEEEDDDYGLISSVEEIPEDAASITMRRENSFRRTLSRSSRSNGRHLKSLRNSLKTRNVNSLKEDEELVKGQKLIKKEFIETGKVKFSIYLEYLQAIGLFSIFFIILAFVMNSVAFIGSNLWLSAWTSDSKIFNSTDYPASQRDMRVGVYGALGLAQGIFVFIAHFWSAFGFVHASNILHKQLLNNILRAPMRFFDTTPTGRIVNRFAGDISTVDDTLPQSLRSWITCFLGIISTLVMICMATPVFTIIVIPLGIIYVSVQMFYVSTSRQLRRLDSVTRSPIYSHFSETVSGLPVIRAFEHQQRFLKHNEVRIDTNQKCVFSWITSNRWLAIRLELVGNLTVFFSALMMVIYRDTLSGDTVGFVLSNALNITQTLNWLVRMTSEIETNIVAVERITEYTKVENEAPWVTDKRPPPDWPSKGKIQFNNYQVRYRPELDLVLRGITCDIGSMEKIGVVGRTGAGKSSLTNCLFRILEAAGGQIIIDGVDIASIGLHDLREKLTIIPQDPILFSGSLRMNLDPFNNYSDEEIWKALELAHLKSFVASLQLGLSHEVTEAGGNLSIGQRQLLCLGRALLRKSKILVLDEATAAVDLETDNLIQTTIQNEFAHCTVITIAHRLHTIMDSDKVMVLDNGKIIECGSPEELLQIPGPFYFMAKEAGIENVNSTKF

SEQ ID NO: 201 - protein, 1527 aa, unidentified
MDALCGSGELGSKFWDSNLSVHTENPDLTPCFQNSLLAWVPCIYLWVALPCYLLYLRHHCRGYIILSHLSKLKMVLGVLLWCVSWADLFYSFHGLVHGRAPAPVFFVTPLVVGVTMLLATLLIQYERLQGVQSSGVLIIFWFLCVVCAIVPFRSKILLAKAEGEISDPFRFTTFYIHFALVLSALILACFREKPPFFSAKNVDPNPYPETSAGFLSRLFFWWFTKMAIYGYRHPLEEKDLWSLKEEDRSQMVVQQLLEAWRKQEKQTARHKASAAPGKNASGEDEVLLGARPRPRKPSFLKALLATFGSSFLISACFKLIQDLLSFINPQLLSILIRFISNPMAPSWWGFLVAGLMFLCSMMQSLILQHYYHYIFVTGVKFRTGIMGVIYRKALVITNSVKRASTVGEIVNLMSVDAQRFMDLAPFLNLLWSAPLQIILAIYFLWQNLGPSVLAGVAFMVLLIPLNGAVAVKMRAFQVKQMKLKDSRIKLMSEILNGIKVLKLYAWEPSFLKQVEGIRQGELQLLRTAAYLHTTTTFTWMCSPFLVTLITLWVYVYVDPNNVLDAEKAFVSVSLFNILRLPLNMLPQLISNLTQASVSLKRIQQFLSQEELDPQSVERKTISPGYAITIHSGTFTWAQDLPPTLHSLDIQVPKGALVAVVGPVGCGKSSLVSALLGEMEKLEGKVHMKGSVAYVPQQAWIQNCTLQENVLFGKALNPKRYQQTLEACALLADLEMLPGGDQTEIGEKGINLSGGQRQRVSLARAVYSDADIFLLDDPLSAVDSHVAKHIFDHVIGPEGVLAGKTRVLVTHGISFLPQTDFIIVLADGQVSEMGPYPALLQRNGSFANFLCNYAPDEDQGHLEDSWTALEGAEDKEALLIEDTLSNHTDLTDNDPVTYVVQKQFMRQLSALSSDGEGQGRPVPRRHLGPSEKVQVTEAKADGALTQEEKAAIGTVELSVFWDYAKAVGLCTTLAICLLYVGQSAAAIGANVWLSAWTNDAMADSRQNNTSLRLGVYAALGILQGFLVMLAAMAMAAGGIQAARVLHQALLHNKIRSPQSFFDTTPSGRILNCFSKDIYVVDEVLAPVILMLLNSFFNAISTLVVIMASTPLFTVVILPLAVLYTLVQRFYAATSRQLKRLESVSRSPIYSHFSETVTGASVIRAYNRSRDFEIISDTKVDANQRSCYPYIISNRWLSIGVEFVGNCVVLFAALFAVIGRSSLNPGLVGLSVSYSLQVTFALNWMIRMMSDLESNIVAVERVKEYSKTETEAPWVVEGSRPPEGWPPRGEVEFRNYSVRYRPGLDLVLRDLSLHVHGGEKVGIVGRTGAGKSSMTLCLFRILEAAKGEIRIDGLNVADIGLHDLRSQLTIIPQDPILFSGTLRMNLDPFGSYSEEDIWWALELSHLHTFVSSQPAGLDFQCSEGGENLSVGQRQLVCLARALLRKSRILVLDEATAAIDLETDNLIQATIRTQFDTCTVLTIAHRLNTIMDYTRVLVLDKGVVAEFDSPANLIAARGIFYGMARDAGLA

SEQ ID NO: 202 - protein, 1325 aa, unidentified
MLPVYQEVKPNPLQDANLCSRVFFWWLNPLFKIGHKRRLEEDDMYSVLPEDRSQHLGEELQGFWDKEVLRAENDAQKPSLTRAIIKCYWKSYLVLGIFTLIEESAKVIQPIFLGKIINYFENYDPMDSVALNTAYAYATVLTFCTLILAILHHLYFYHVQCAGMRLRVAMCHMIYRKALRLSNMAMGKTTTGQIVNLLSNDVNKFDQVTVFLHFLWAGPLQAIAVTALLWMEIGISCLAGMAVLIILLPLQSCFGKLFSSLRSKTATFTDARIRTMNEVITGIRIIKMYAWEKSFSNLITNLRKKEISKILRSSCLRGMNLASFFSASKIIVFVTFTTYVLLGSVITASRVFVAVTLYGAVRLTVTLFFPSAIERVSEAIVSIRRIQTFLLLDEISQRNRQLPSDGKKMVHVQDFTAFWDKASETPTLQGLSFTVRPGELLAVVGPVGAGKSSLLSAVLGELAPSHGLVSVHGRIAYVSQQPWVFSGTLRSNILFGKKYEKERYEKVIKACALKKDLQLLEDGDLTVIGDRGTTLSGGQKARVNLARAVYQDADIYLLDDPLSAVDAEVSRHLFELCICQILHEKITILVTHQLQYLKAASQILILKDGKMVQKGTYTEFLKSGIDFGSLLKKDNEESEQPPVPGTPTLRNRTFSESSVWSQQSSRPSLKDGALESQDTENVPVTLSEENRSEGKVGFQAYKNYFRAGAHWIVFIFLILLNTAAQVAYVLQDWWLSYWANKQSMLNVTVNGGGNVTEKLDLNWYLGIYSGLTVATVLFGIARSLLVFYVLVNSSQTLHNKMFESILKAPVLFFDRNPIGRILNRFSKDIGHLDDLLPLTFLDFIQTLLQVVGVVSVAVAVIPWIAIPLVPLGIIFIFLRRYFLETSRDVKRLESTTRSPVFSHLSSSLQGLWTIRAYKAEERCQELFDAHQDLHSEAWFLFLTTSRWFAVRLDAICAMFVIIVAFGSLILAKTLDAGQVGLALSYALTLMGMFQWCVRQSAEVENMMISVERVIEYTDLEKEAPWEYQKRPPPAWPHEGVIIFDNVNFMYSPGGPLVLKHLTALIKSQEKVGIVGRTGAGKSSLISALFRLSEPEGKIWIDKILTTEIGLHDLRKKMSIIPQEPVLFTGTMRKNLDPFNEHTDEELWNALQEVQLKETIEDLPGKMDTELAESGSNFSVGQRQLVCLARAILRKNQILIIDEATANVDPRTDELIQKKIREKFAHCTVLTIAHRLNTIIDSDKIMVLDSGRLKEYDEPYVLLQNKESLFYKMVQQLGKAEAAALTETAKQVYFKRNYPHIGHTDHMVTNTSNGQPSTLTIFETAL

SEQ ID NO: 203 - protein, 1437 aa, unidentified
MKDIDIGKEYIIPSPGYRSVRERTSTSGTHRDREDSKFRRTRPLECQDALETAARAEGLSLDASMHSQLRILDEEHPKGKYHHGLSALKPIRTTSKHQHPVDNAGLFSCMTFSWLSSLARVAHKKGELSMEDVWSLSKHESSDVNCRRLERLWQEELNEVGPDAASLRRVVWIFCRTRLILSIVCLMITQLAGFSGPAFMVKHLLEYTQATESNLQYSLLLVLGLLLTEIVRSWSLALTWALNYRTGVRLRGAILTMAFKKILKLKNIKEKSLGELINICSNDGQRMFEAAAVGSLLAGGPVVAILGMIYNVIILGPTGFLGSAVFILFYPAMMFASRLTAYFRRKCVAATDERVQKMNEVLTYIKFIKMYAWVKAFSQSVQKIREEERRILEKAGYFQSITVGVAPIVVVIASVVTFSVHMTLGFDLTAAQAFTVVTVFNSMTFALKVTPFSVKSLSEASVAVDRFKSLFLMEEVHMIKNKPASPHIKIEMKNATLAWDSSHSSIQNSPKLTPKMKKDKRASRGKKEKVRQLQRTEHQAVLAEQKGHLLLDSDERPSPEEEEGKHIHLGHLRLQRTLHSIDLEIQEGKLVGICGSVGSGKTSLISAILGQMTLLEGSIAISGTFAYVAQQAWILNATLRDNILFGKEYDEERYNSVLNSCCLRPDLAILPSSDLTEIGERGANLSGGQRQRISLARALYSDRSIYILDDPLSALDAHVGNHIFNSAIRKHLKSKTVLFVTHQLQYLVDCDEVIFMKEGCITERGTHEELMNLNGDYATIFNNLLLGETPPVEINSKKETSGSQKKSQDKGPKTGSVKKEKAVKPEEGQLVQLEEKGQGSVPWSVYGVYIQAAGGPLAFLVIMALFMLNVGSTAFSTWWLSYWIKQGSGNTTVTRGNETSVSDSMKDNPHMQYYASIYALSMAVMLILKAIRGVVFVKGTLRASSRLHDELFRRILRSPMKFFDTTPTGRILNRFSKDMDEVDVRLPFQAEMFIQNVILVFFCVGMIAGVFPWFLVAVGPLVILFSVLHIVSRVLIRELKRLDNITQSPFLSHITSSIQGLATIHAYNKGQEFLHRYQELLDDNQAPFFLFTCAMRWLAVRLDLISIALITTTGLMIVLMHGQIPPAYAGLAISYAVQLTGLFQFTVRLASETEARFTSVERINHYIKTLSLEAPARIKNKAPSPDWPQEGEVTFENAEMRYRENLPLVLKKVSFTIKPKEKIGIVGRTGSGKSSLGMALFRLVELSGGCIKIDGVRISDIGLADLRSKLSIIPQEPVLFSGTVRSNLDPFNQYTEDQIWDALERTHMKECIAQLPLKLESEVMENGDNFSVGERQLLCIARALLRHCKILILDEATAAMDTETDLLIQETIREAFADCTMLTIAHRLHTVLGSDRIMVLAQGQVVEFDTPSVLLSNDSSRFYAMFAAAENKVAVKG

SEQ ID NO: 204 - protein, 1503 aa, unidentified
MAAPAEPCAGQGVWNQTEPEPAATSLLSLCFLRTAGVWVPPMYLWVLGPIYLLFIHHHGRGYLRMSPLFKAKMVLGFALIVLCTSSVAVALWKIQQGTPEAPEFLIHPTVWLTTMSFAVFLIHTERKKGVQSSGVLFGYWLLCFVLPATNAAQQASGAGFQSDPVRHLSTYLCLSLVVAQFVLSCLADQPPFFPEDPQQSNPCPETGAAFPSKATFWWVSGLVWRGYRRPLRPKDLWSLGRENSSEELVSRLEKEWMRNRSAARRHNKAIAFKRKGGSGMKAPETEPFLRQEGSQWRPLLKAIWQVFHSTFLLGTLSLIISDVFRFTVPKLLSLFLEFIGDPKPPAWKGYLLAVLMFLSACLQTLFEQQNMYRLKVLQMRLRSAITGLVYRKVLALSSGSRKASAVGDVVNLVSVDVQRLTESVLYLNGLWLPLVWIVVCFVYLWQLLGPSALTAIAVFLSLLPLNFFISKKRNHHQEEQMRQKDSRARLTSSILRNSKTIKFHGWEGAFLDRVLGIRGQELGALRTSGLLFSVSLVSFQVSTFLVALVVFAVHTLVAENAMNAEKAFVTLTVLNILNKAQAFLPFSIHSLVQARVSFDRLVTFLCLEEVDPGVVDSSSSGSAAGKDCITIHSATFAWSQESPPCLHRINLTVPQGCLLAVVGPVGAGKSSLLSALLGELSKVEGFVSIEGAVAYVPQEAWVQNTSVVENVCFGQELDPPWLERVLEACALQPDVDSFPEGIHTSIGEQGMNLSGGQKQRLSLARAVYRKAAVYLLDDPLAALDAHVGQHVFNQVIGPGGLLQGTTRILVTHALHILPQADWIIVLANGAIAEMGSYQELLQRKGALMCLLDQARQPGDRGEGETEPGTSTKDPRGTSAGRRPELRRERSIKSVPEKDRTTSEAQTEVPLDDPDRAGWPAGKDSIQYGRVKATVHLAYLRAVGTPLCLYALFLFLCQQVASFCRGYWLSLWADDPAVGGQQTQAALRGGIFGLLGCLQAIGLFASMAAVLLGGARASRLLFQRLLWDVVRSPISFFERTPIGHLLNRFSKETDTVDVDIPDKLRSLLMYAFGLLEVSLVVAVATPLATVAILPLFLLYAGFQSLYVVSSCQLRRLESASYSSVCSHMAETFQGSTVVRAFRTQAPFVAQNNARVDESQRISFPRLVADRWLAANVELLGNGLVFAAATCAVLSKAHLSAGLVGFSVSAALQVTQTLQWVVRNWTDLENSIVSVERMQDYAWTPKEAPWRLPTCAAQPPWPQGGQIEFRDFGLRYRPELPLAVQGVSFKIHAGEKVGIVGRTGAGKSSLASGLLRLQEAAEGGIWIDGVPIAHVGLHTLRSRISIIPQDPILFPGSLRMNLDLLQEHSDEAIWAALETVQLKALVASLPGQLQYKCADRGEDLSVGQKQLLCLARALLRKTQILILDEATAAVDPGTELQMQAMLGSWFAQCTVLLIAHRLRSVMDCARVLVMDKGQVAESGSPAQLLAQKGLFYRLAQESGLV

SEQ ID NO: 205 - protein, 1581 aa, unidentified
MPLAFCGSENHSAAYRVDQGVLNNGCFVDALNVVPHVFLLFITFPILFIGWGSQSSKVHIHHSTWLHFPGHNLRWILTFMLLFVLVCEIAEGILSDGVTESHHLHLYMPAGMAFMAAVTSVVYYHNIETSNFPKLLIALLVYWTLAFITKTIKFVKFLDHAIGFSQLRFCLTGLLVILYGMLLLVEVNVIRVRRYIFFKTPREVKPPEDLQDLGVRFLQPFVNLLSKGTYWWMNAFIKTAHKKPIDLRAIGKLPIAMRALTNYQRLCEAFDAQVRKDIQGTQGARAIWQALSHAFGRRLVLSSTFRILADLLGFAGPLCIFGIVDHLGKENDVFQPKTQFLGVYFVSSQEFLANAYVLAVLLFLALLLQRTFLQASYYVAIETGINLRGAIQTKIYNKIMHLSTSNLSMGEMTAGQICNLVAIDTNQLMWFFFLCPNLWAMPVQIIVGVILLYYILGVSALIGAAVIILLAPVQYFVATKLSQAQRSTLEYSNERLKQTNEMLRGIKLLKLYAWENIFRTRVETTRRKEMTSLRAFAIYTSISIFMNTAIPIAAVLITFVGHVSFFKEADFSPSVAFASLSLFHILVTPLFLLSSVVRSTVKALVSVQKLSEFLSSAEIREEQCAPHEPTPQGPASKYQAVPLRVVNRKRPAREDCRGLTGPLQSLVPSADGDADNCCVQIMGGYFTWTPDGIPTLSNITIRIPRGQLTMIVGQVGCGKSSLLLAALGEMQKVSGAVFWSSLPDSEIGEDPSPERETATDLDIRKRGPVAYASQKPWLLNATVEENIIFESPFNKQRYKMVIEACSLQPDIDILPHGDQTQIGERGINLSGGQRQRISVARALYQHANVVFLDDPFSALDIHLSDHLMQAGILELLRDDKRTVVLVTHKLQYLPHADWIIAMKDGTIQREGTLKDFQRSECQLFEHWKTLMNRQDQELEKETVTERKATEPPQGLSRAMSSRDGLLQDEEEEEEEAAESEEDDNLSSMLHQRAEIPWRACAKYLSSAGILLLSLLVFSQLLKHMVLVAIDYWLAKWTDSALTLTPAARNCSLSQECTLDQTVYAMVFTVLCSLGIVLCLVTSVTVEWTGLKVAKRLHRSLLNRIILAPMRFFETTPLGSILNRFSSDCNTIDQHIPSTLECLSRSTLLCVSALAVISYVTPVFLVALLPLAIVCYFIQKYFRVASRDLQQLDDTTQLPLLSHFAETVEGLTTIRAFRYEARFQQKLLEYTDSNNIASLFLTAANRWLEVRMEYIGACVVLIAAVTSISNSLHRELSAGLVGLGLTYALMVSNYLNWMVRNLADMELQLGAVKRIHGLLKTEAESYEGLLAPSLIPKNWPDQGKIQIQNLSVRYDSSLKPVLKHVNALIAPGQKIGICGRTGSGKSSFSLAFFRMVDTFEGHIIIDGIDIAKLPLHTLRSRLSIILQDPVLFSGTIRFNLDPERKCSDSTLWEALEIAQLKLVVKALPGGLDAIITEGGENFSQGQRQLFCLARAFVRKTSIFIMDEATASIDMATENILQKVVMTAFADRTVVTIAHRVHTILSADLVIVLKRGAILEFDKPEKLLSRKDSVFASFVRADK

SEQ ID NO: 206 - protein, 1549 aa, unidentified
MSLSFCGNNISSYNINDGVLQNSCFVDALNLVPHVFLLFITFPILFIGWGSQSSKVQIHHNTWLHFPGHNLRWILTFALLFVHVCEIAEGIVSDSRRESRHLHLFMPAVMGFVATTTSIVYYHNIETSNFPKLLLALFLYWVMAFITKTIKLVKYCQSGLDISNLRFCITGMMVILNGLLMAVEINVIRVRRYVFFMNPQKVKPPEDLQDLGVRFLQPFVNLLSKATYWWMNTLIISAHKKPIDLKAIGKLPIAMRAVTNYVCLKDAYEEQKKKVADHPNRTPSIWLAMYRAFGRPILLSSTFRYLADLLGFAGPLCISGIVQRVNETQNGTNNTTGISETLSSKEFLENAYVLAVLLFLALILQRTFLQASYYVTIETGINLRGALLAMIYNKILRLSTSNLSMGEMTLGQINNLVAIETNQLMWFLFLCPNLWAMPVQIIMGVILLYNLLGSSALVGAAVIVLLAPIQYFIATKLAEAQKSTLDYSTERLKKTNEILKGIKLLKLYAWEHIFCKSVEETRMKELSSLKTFALYTSLSIFMNAAIPIAAVLATFVTHAYASGNNLKPAEAFASLSLFHILVTPLFLLSTVVRFAVKAIISVQKLNEFLLSDEIGDDSWRTGESSLPFESCKKHTGVQPKTINRKQPGRYHLDSYEQSTRRLRPAETEDIAIKVTNGYFSWGSGLATLSNIDIRIPTGQLTMIVGQVGCGKSSLLLAILGEMQTLEGKVHWSNVNESEPSFEATRSRNRYSVAYAAQKPWLLNATVEENITFGSPFNKQRYKAVTDACSLQPDIDLLPFGDQTEIGERGINLSGGQRQRICVARALYQNTNIVFLDDPFSALDIHLSDHLMQEGILKFLQDDKRTLVLVTHKLQYLTHADWIIAMKDGSVLREGTLKDIQTKDVELYEHWKTLMNRQDQELEKDMEADQTTLERKTLRRAMYSREAKAQMEDEDEEEEEEEDEDDNMSTVMRLRTKMPWKTCWRYLTSGGFFLLILMIFSKLLKHSVIVAIDYWLATWTSEYSINNTGKADQTYYVAGFSILCGAGIFLCLVTSLTVEWMGLTAAKNLHHNLLNKIILGPIRFFDTTPLGLILNRFSADTNIIDQHIPPTLESLTRSTLLCLSAIGMISYATPVFLVALLPLGVAFYFIQKYFRVASKDLQELDDSTQLPLLCHFSETAEGLTTIRAFRHETRFKQRMLELTDTNNIAYLFLSAANRWLEVRTDYLGACIVLTASIASISGSSNSGLVGLGLLYALTITNYLNWVVRNLADLEVQMGAVKKVNSFLTMESENYEGTMDPSQVPEHWPQEGEIKIHDLCVRYENNLKPVLKHVKAYIKPGQKVGICGRTGSGKSSLSLAFFRMVDIFDGKIVIDGIDISKLPLHTLRSRLSIILQDPILFSGSIRFNLDPECKCTDDRLWEALEIAQLKNMVKSLPGGLDAVVTEGGENFSVGQRQLFCLARAFVRKSSILIMDEATASIDMATENILQKVVMTAFADRTVVTIAHRVSSIMDAGLVLVFSEGILVECDTVPNLLAHKNGLFSTLVMTNK

SEQ ID NO: 207 - protein, 745 aa, unidentified [sequence omitted]

SEQ ID NO: 208 - protein, 740 aa, unidentified
MTHMLNAAADRVKWTRSSAAKRAACLVAAAYALKTLYPIIGKRLKQSGHGKKKAAAYPAAENTEILHCTETICEKPSPGVNADFFKQLLELRKILFPKLVTTETGWLCLHSVALISRTFLSIYVAGLDGKIVKSIVEKKPRTFIIKLIKWLMIAIPATFVNSAIRYLECKLALAFRTRLVDHAYETYFTNQTYYKVINMDGRLANPDQSLTEDIMMFSQSVAHLYSNLTKPILDVMLTSYTLIQTATSRGASPIGPTLLAGLVVYATAKVLKACSPKFGKLVAEEAHRKGYLRYVHSRIIANVEEIAFYRGHKVEMKQLQKSYKALADQMNLILSKRLWYIMIEQFLMKYVWSSSGLIMVAIPIITATGFADGEDGQKQVMVSERTEAFTTARNLLASGADAIERIMSSYKEVTELAGYTARVYNMFWVFDEVKRGIYKRTAVIQESESHSKNGAKVELPLSDTLAIKGKVIDVDHGIICENVPIITPAGEVVASRLNFKVEEGMHLLITGPNGCGKSSLFRILSGLWPVYEGVLYKPPPQHMFYIPQRPYMSLGSLRDQVIYPDSVDDMHDKGYTDQDLERILHNVHLYHIVQREGGWDAVMDWKDVLSGGEKQRMGMARMFYHKPKYALLDECTSAVSIDVEGKIFQAAKGAGISLLSITHRPSLWKYHTHLLQFDGEGGWRFEQLDTAIRLTLSEEKQKLESQLAGIPKMQQRLNELCKILGEDSVLKTIKNEDETS

SEQ ID NO: 209 - protein, 659 aa, unidentified
MAAFSKYLTARNSSLAGAAFLLLCLLHKRRRALGLHGKKSGKPPLQNNEKEGKKERAVVDKVFFSRLIQILKIMVPRTFCKETGYLVLIAVMLVSRTYCDVWMIQNGTLIESGIIGRSRKDFKRYLLNFIAAMPLISLVNNFLKYGLNELKLCFRVRLTKYLYEEYLQAFTYYKMGNLDNRIANPDQLLTQDVEKFCNSVVDLYSNLSKPFLDIVLYIFKLTSAIGAQGPASMMAYLVVSGLFLTRLRRPIGKMTITEQKYEGEYRYVNSRLITNSEEIAFYNGNKREKQTVHSVFRKLVEHLHNFILFRFSMGFIDSIIAKYLATVVGYLVVSRPFLDLSHPRHLKSTHSELLEDYYQSGRMLLRMSQALGRIVLAGREMTRLAGFTARITELMQVLKDLNHGKYERTMVSQQEKGIEGVQVIPLIPGAGEIIIADNIIKFDHVPLATPNGDVLIRDLNFEVRSGANVLICGPNGCGKSSLFRVLGELWPLFGGRLTKPERGKLFYVPQRPYMTLGTLRDQVIYPDGREDQKRKGISDLVLKEYLDNVQLGHILEREGGWDSVQDWMDVLSGGEKQRMAMARLFYHKPQFAILDECTSAVSVDVEGYIYSHCRKVGITLFTVSHRKSLWKHHEYYLHMDGRGNYEFKQITEDTVEFGS

SEQ ID NO: 210 - protein, 606 aa, unidentified
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQRLLQTQRELMSKELWLYIGINTFDYLGSILSYVVIAIPIFSGVYGDLSPAELSTLVSKNAFVCIYLISCFTQLIDLSTTLSDVAGYTHRIGQLRETLLDMSLKSQDCEILGESEWGLDTPPGWPAAEPADTAFLLERVSISAPSSDKPLIKDLSLKISEGQSLLITGNTGTGKTSLLRVLGGLWTSTRGSVQMLTDFGPHGVLFLPQKPFFTDGTLREQVIYPLKEVYPDSGSADDERILRFLELAGLSNLVARTEGLDQQVDWNWYDVLSPGEMQRLSFARLFYLQPKYAVLDEATSALTEEVESELYRIGQQLGMTFISVGHRQSLEKFHSLVLKLCGGGRWELMRIKVE

SEQ ID NO: 211 - protein, 678 aa, unidentified
MACLMAAFSVGTAMNASSYSAEMTEPKSVCVSVDEVVSSNMEATETDLLNGHLKKVDNNLTEAQRFSSLPRRAAVNIEFRDLSYSVPEGPWWRKKGYKTLLKGISGKFNSGELVAIMGPSGAGKSTLMNILAGYRETGMKGAVLINGLPRDLRCFRKVSCYIMQDDMLLPHLTVQEAMMVSAHLKLQEKDEGRREMVKEILTALGLLSCANTRTGSLSGGQRKRLAIALELVNNPPVMFFDEPTSGLDSASCFQVVSLMKGLAQGGRSIICTIHQPSAKLFELFDQLYVLSQGQCVYRGKVCNLVPYLRDLGLNCPTYHNPADFVMEVASGEYGDQNSRLVRAVREGMCDSDHKRDLGGDAEVNPFLWHRPSEEVKQTKRLKGLRKDSSSMEGCHSFSASCLTQFCILFKRTFLSIMRDSVLTHLRITSHIGIGLLIGLLYLGIGNEAKKVLSNSGFLFFSMLFLMFAALMPTVLTFPLEMGVFLREHLNYWYSLKAYYLAKTMADVPFQIMFPVAYCSIVYWMTSQPSDAVRFVLFAALGTMTSLVAQSLGLLIGAASTSLQVATFVGPVTAIPVLLFSGFFVSFDTIPTYLQWMSYISYVRYGFEGVILSIYGLDREDLHCDIDETCHFQKSEAILRELDVENAKLYLDFIVLGIFFISLRLIAYFVLRYKIRAER

SEQ ID NO: 212 - protein, 655 aa, unidentified
MSSSNVEVFIPVSQGNTNGFPATASNDLKAFTEGAVLSFHNICYRVKLKSGFLPCRKPVEKEILSNINGIMKPGLNAILGPTGGGKSSLLDVLAARKDPSGLSGDVLINGAPRPANFKCNSGYVVQDDVVMGTLTVRENLQFSAALRLATTMTNHEKNERINRVIQELGLDKVADSKVGTQFIRGVSGGERKRTSIGMELITDPSILFLDEPTTGLDSSTANAVLLLLKRMSKQGRTIIFSIHQPRYSIFKLFDSLTLLASGRLMFHGPAQEALGYFESAGYHCEAYNNPADFFLDIINGDSTAVALNREEDFKATEIIEPSKQDKPLIEKLAEIYVNSSFYKETKAELHQLSGGEKKKKITVFKEISYTTSFCHQLRWVSKRSFKNLLGNPQASIAQIIVTVVLGLVIGAIYFGLKNDSTGIQNRAGVLFFLTTNQCFSSVSAVELFVVEKKLFIHEYISGYYRVSSYFLGKLLSDLLPMRMLPSIIFTCIVYFMLGLKPKADAFFVMMFTLMMVAYSASSMALAIAAGQSVVSVATLLMTICFVFMMIFSGLLVNLTTIASWLSWLQYFSIPRYGFTALQHNEFLGQNFCPGLNATGNNPCNYATCTGEEYLVKQGIDLSPWGLWKNHVALACMIVIFLTIAYLKLLFLKKYS

SEQ ID NO: 213 - protein, 646 aa, unidentified
MAEKALEAVGCGLGPGAVAMAVTLEDGAEPPVLTTHLKKVENHITEAQRFSHLPKRSAVDIEFVELSYSVREGPCWRKRGYKTLLKCLSGKFCRRELIGIMGPSGAGKSTFMNILAGYRESGMKGQILVNGRPRELRTFRKMSCYIMQDDMLLPHLTVLEAMMVSANLKLSEKQEVKKELVTEILTALGLMSCSHTRTALLSGGQRKRLAIALELVNNPPVMFFDEPTSGLDSASCFQVVSLMKSLAQGGRTIICTIHQPSAKLFEMFDKLYILSQGQCIFKGVVTNLIPYLKGLGLHCPTYHNPADFIIEVASGEYGDLNPMLFRAVQNGLCAMAEKKSSPEKNEVPAPCPPCPPEVDPIESHTFATSTLTQFCILFKRTFLSILRDTVLTHLRFMSHVVIGVLIGLLYLHIGDDASKVFNNTGCLFFSMLFLMFAALMPTVLTFPLEMAVFMREHLNYWYSLKAYYLAKTMADVPFQVVCPVVYCSIVYWMTGQPAETSRFLLFSALATATALVAQSLGLLIGAASNSLQVATFVGPVTAIPVLLFSGFFVSFKTIPTYLQWSSYLSYVRYGFEGVILTIYGMERGDLTCLEERCPFREPQSILRALDVEDAKLYMDFLVLGIFFLALRLLAYLVLRYRVKSER

SEQ ID NO: 214 - protein, 651 aa, unidentified
MGDLSSLTPGGSMGLQVNRGSQSSLEGAPATAPEPHSLGILHASYSVSHRVRPWWDITSCRQQWTRQILKDVSLYVESGQIMCILGSSGSGKTTLLDAMSGRLGRAGTFLGEVYVNGRALRREQFQDCFSYVLQSDTLLSSLTVRETLHYTALLAIRRGNPGSFQKKVEAVMAELSLSHVADRLIGNYSLGGISTGERRRVSIAAQLLQDPKVMLFDEPTTGLDCMTANQIVVLLVELARRNRIVVLTIHQPRSELFQLFDKIAILSFGELIFCGTPAEMLDFFNDCGYPCPEHSNPFDFYMDLTSVDTQSKEREIETSKRVQMIESAYKKSAICHKTLKNIERMKHLKTLPMVPFKTKDSPGVFSKLGVLLRRVTRNLVRNKLAVITRLLQNLIMGLFLLFFVLRVRSNVLKGAIQDRVGLLYQFVGATPYTGMLNAVNLFPVLRAVSDQESQDGLYQKWQMMLAYALHVLPFSVVATMIFSSVCYWTLGLHPEVARFGYFSAALLAPHLIGEFLTLVLLGIVQNPNIVNSVVALLSIAGVLVGSGFLRNIQEMPIPFKIISYFTFQKYCSEILVVNEFYGLNFTCGSSNVSVTTNPMCAFTQGIQFIEKTCPGATSRFTMNFLILYSFIPALVILGIVVFKIRDHLISR

SEQ ID NO: 215 - protein, 673 aa, unidentified
MAGKAAEERGLPKGATPQDTSGLQDRLFSSESDNSLYFTYSGQPNTLEVRDLNYQVDLASQVPWFEQLAQFKMPWTSPSCQNSCELGIQNLSFKVRSGQMLAIIGSSGCGRASLLDVITGRGHGGKIKSGQIWINGQPSSPQLVRKCVAHVRQHNQLLPNLTVRETLAFIAQMRLPRTFSQAQRDKRVEDVIAELRLRQCADTRVGNMYVRGLSGGERRRVSIGVQLLWNPGILILDEPTSGLDSFTAHNLVKTLSRLAKGNRLVLISLHQPRSDIFRLFDLVLLMTSGTPIYLGAAQHMVQYFTAIGYPCPRYSNPADFYVDLTSIDRRSREQELATREKAQSLAALFLEKVRDLDDFLWKAETKDLDEDTCVESSVTPLDTNCLPSPTKMPGAVQQFTTLIRRQISNDFRDLPTLLIHGAEACLMSMTIGFLYFGHGSIQLSFMDTAALLFMIGALIPFNVILDVISKCYSERAMLYYELEDGLYTTGPYFFAKILGELPEHCAYIIIYGMPTYWLANLRPGLQPFLLHFLLVWLVVFCCRIMALAAAALLPTFHMASFFSNALYNSFYLAGGFMINLSSLWTVPAWISKVSFLRWCFEGLMKIQFSRRTYKMPLGNLTIAVSGDKILSVMELDSYPLYAIYLIVIGLSGGFMVLYYVSLRFIKQKPSQDW

SEQ ID NO: 216 - protein, 405 aa, unidentified
MLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQDTYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLTAGLCQLVERNRKVIEKVVDIDFVLQARTIRQFDERYTSVAFGYQDCVTYYKAASPRTKIDAIRIPVLYLSAADDPFSPVCALPIQAAQHSPYVALLITARGGHIGFLEGLLPWQHWYMSRLLHQYAKAIFQDPEGLPDLRALLPSEDRNS

SEQ ID NO: 217 - protein, 398 aa, unidentified
MRKRTEPVALEHERCAAAGSSSSGSAAAALDADCRLKQNLRLTGPAAAEPRCAADAGMKRALGRRKGVWLRLRKILFCVLGLYIAIPFLIKLCPGIQAKLIFLNFVRVPYFIDLKKPQDQGLNHTCNYYLQPEEDVTIGVWHTVPAVWWKNAQGKDQMWYEDALASSHPIILYLHGNAGTRGGDHRVELYKVLSSLGYHVVTFDYRGWGDSVGTPSERGMTYDALHVFDWIKARSGDNPVYIWGHSLGTGVATNLVRRLCERETPPDALILESPFTNIREEAKSHPFSVIYRYFPGFDWFFLDPITSSGIKFANDENVKHISCPLLILHAEDDPVVPFQLGRKLYSIAAPARSFRDFKVQFVPFHSDLGYRHKYIYKSPELPRILREFLGKSEPEHQH

SEQ ID NO: 218 - protein, 337 aa, unidentified
MEKSWMLWNFVERWLIALASWSWALCRISLLPLIVTFHLYGGIILLLLIFISIAGILYKFQDVLLYFPEQPSSSRLYVPMPTGIPHENIFIRTKDGIRLNLILIRYTGDNSPYSPTIIYFHGNAGNIGHRLPNALLMLVNLKVNLLLVDYRGYGKSEGEASEEGLYLDSEAVLDYVMTRPDLDKTKIFLFGRSLGGAVAIHLASENSHRISAIMVENTFLSIPHMASTLFSFFPMRYLPLWCYKNKFLSYRKISQCRMPSLFISGLSDQLIPPVMMKQLYELSPSRTKRLAIFPDGTHNDTWQCQGYFTALEQFIKEVVKSHSPEEMAKTSSNVTII

SEQ ID NO: 219 - protein, 271 aa, unidentified
MVGALCGCWFRLGGARPLIPLGPTVVQTSMSRSQVALLGLSLLLMLLLYVGLPGPPEQTSCLWGDPNVTVLAGLTPGNSPIFYREVLPLNQAHRVEVVLLHGKAFNSHTWEQLGTLQLLSQRGYRAVALDLPGFGNSAPSKEASTEAGRAALLERALRDLEVQNAVLVSPSLSGHYALPFLMRGHHQLHGFVPIAPTSTQNYTQEQFWAVKTPTLILYGELDHILARESLRQLRHLPNHSVVKLRNAGHACYLHKPQDFHLVLLAFLDHLP

SEQ ID NO: 220 - protein, 558 aa, unidentified
MAKLLSCVLGPRLYKIYRERDSERAPASVPETPTAVTAPHSSSWDTYYQPRALEKHADSILALASVFWSISYYSSPFAFFYLYRKGYLSLSKVVPFSHYAGTLLLLLAGVACLRGIGRWTNPQYRQFITILEATHRNQSSENKRQLANYNFDFRSWPVDFHWEEPSSRKESRGGPSRRGVALLRPEPLHRGTADTLLNRVKKLPCQITSYLVAHTLGRRMLYPGSVYLLQKALMPVLLQGQARLVEECNGRRAKLLACDGNEIDTMFVDRRGTAEPQGQKLVICCEGNAGFYEVGCVSTPLEAGYSVLGWNHPGFAGSTGVPFPQNEANAMDVVVQFAIHRLGFQPQDIIIYAWSIGGFTATWAAMSYPDVSAMILDASFDDLVPLALKVMPDSWRGLVTRTVRQHLNLNNAEQLCRYQGPVLLIRRTKDEIITTTVPEDIMSNRGNDLLLKLLQHRYPRVMAEEGLRVVRQWLEASSQLEEASIYSRWEVEEDWCLSVLRSYQAEHGPDFPWSVGEDMSADGRRQLALFLARKHLHNFEATHCTPLPAQNFQMPWHL

SEQ ID NO: 221 - protein, 425 aa, unidentified
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALRAQETFMQWDQCRRFYNFLMADNMKKIILSHRQALFGDHVKKPQSLEDTDLSRLYTATSLMQIDDNVMRKFHGYNSLKEYYEEESCMRYLHRIYVPLMLVNAADDPLVHESLLTIPKSLSEKRENVMFVLPLHGGHLGFFEGSVLFPEPLTWMDKLVVEYANAICQWERNKLQCSDTEQVEADLE

SEQ ID NO: 222 - protein, 409 aa, unidentified
MQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLLTPRTYCCANTEDLETVIHHVHSLYPSAPFLAAGVSMGGMLLLNYLGKIGSKTPLMAAATFSVGWNTFACSESLEKPLNWLLFNYYLTTCLQSSVNKHRHMFVKQVDMDHVMKAKSIREFDKRFTSVMFGYQTIDDYYTDASPSPRLKSVGIPVLCLNSVDDVFSPSHAIPIETAKQNPNVALVLTSYGGHIGFLEGIWPRQSTYMDRVFKQFVQAMVEHGHELS

SEQ ID NO: 223 - protein, 337 aa, unidentified
MDLDVVNMFVIAGGTLAIPILAFVASFLLWPSALIRIYYWYWRRTLGMQVRYVHHEDYQFCYSFRGRPGHKPSILMLHGFSAHKDMWLSVVKFLPKNLHLVCVDMPGHEGTTRSSLDDLSIDGQVKRIHQFVECLKLNKKPFHLVGTSMGGQVAGVYAAYYPSDVSSLCLVCPAGLQYSTDNQFVQRLKELQGSAAVEKIPLIPSTPEEMSEMLQLCSYVRFKVPQQILQGLVDVRIPHNNFYRKLFLEIVSEKSRYSLHQNMDKIKVPTQIIWGKQDQVLDVSGADMLAKSIANCQVELLENCGHSVVMERPRKTAKLIIDFLASVHNTDNNKKLD

SEQ ID NO: 224 - protein, 268 aa, unidentified
MGTEKESPEPDCQKQFQAAVSVIQNLPKNGSYRPSYEEMLRFYSYYKQATMGPCLVPRPGFWDPIGRYKWDAWNSLGKMSREEAMSAYITEMKLVAQKVIDTVPLGEVAEDMFGYFEPLYQVIPDMPRPPETFLRRVTGWKEQVVNGDVGAVSEPPCLPKEPAPPSPESHSPRDLDSEVFCDSLEQLEPELSSGQHLEESVIPGTAPCPPQRKRGCGAARRGPRSWTCGCWGQFEHYRRACRRCRRGCRAWRACPGPLSSLTLSVRLE

SEQ ID NO: 225 - protein, 534 aa, unidentified
MFQFHAGSWESWCCCCLIPADRPWDRGQHWQLEMADTRSVHETRFEAAVKVIQSLPKNGSFQPTNEMMLKFYSFYKQATEGPCKLSRPGFWDPIGRYKWDAWSSLGDMTKEEAMIAYVEEMKKIIETMPMTEKVEELLRVIGPFYEIVEDKKSGRSSDITSVRLEKISKCLEDLGNVLTSTPNAKTVNGKAESSDSGAESEEEEAQEEVKGAEQSDNDKKMMKKSADHKNLEVIVTNGYDKDGFVQDIQNDIHASSSLNGRSTEEVKPIDENLGQTGKSAVCIHQDINDDHVEDVTGIQHLTSDSDSEVYCDSMEQFGQEESLDSFTSNNGPFQYYLGGHSSQPMENSGFREDIQVPPGNGNIGNMQVVAVEGKGEVKHGGEDGRNNSGAPHREKRGGETDEFSNVRRGRGHRMQHLSEGTKGRQVGSGGDGERWGSDRGSRGSLNEQIALVLMRLQEDMQNVLQRLQKLETLTALQAKSSTSTLQTAPQPTSQRPSWWPFEMSPGVLTFAIIWPFIAQWLVYLYYQRRRRKLN

SEQ ID NO: 226 - protein, 1306 aa, unidentified
MGAASGRRGPGLLLPLPLLLLLPPQPALALDPGLQPGNFSADEAGAQLFAQSYNSSAEQVLFQSVAASWAHDTNITAENARRQEEAALLSQEFAEAWGQKAKELYEPIWQNFTDPQLRRIIGAVRTLGSANLPLAKRQQYNALLSNMSRIYSTAKVCLPNKTATCWSLDPDLTNILASSRSYAMLLFAWEGWHNAAGIPLKPLYEDFTALSNEAYKQDGFTDTGAYWRSWYNSPTFEDDLEHLYQQLEPLYLNLHAFVRRALHRRYGDRYINLRGPIPAHLLGDMWAQSWENIYDMVVPFPDKPNLDVTSTMLQQGWNATHMFRVAEEFFTSLELSPMPPEFWEGSMLEKPADGREVVCHASAWDFYNRKDFRIKQCTRVTMDQLSTVHHEMGHIQYYLQYKDLPVSLRRGANPGFHEAIGDVLALSVSTPEHLHKIGLLDRVTNDTESDINYLLKMALEKIAFLPFGYLVDQWRWGVFSGRTPPSRYNFDWWYLRTKYQGICPPVTRNETHFDAGAKFHVPNVTPYIRYFVSFVLQFQFHEALCKEAGYEGPLHQCDIYRSTKAGAKLRKVLQAGSSRPWQEVLKDMVGLDALDAQPLLKYFQPVTQWLQEQNQQNGEVLGWPEYQWHPPLPDNYPEGIDLVTDEAEASKFVEEYDRTSQVVWNEYAEANWNYNTNITTETSKILLQKNMQIANHTLKYGTQARKFDVNQLQNTTIKRIIKKVQDLERAALPAQELEEYNKILLDMETTYSVATVCHPNGSCLQLEPDLTNVMATSRKYEDLLWAWEGWRDKAGRAILQFYPKYVELINQAARLNGYVDAGDSWRSMYETPSLEQDLERLFQELQPLYLNLHAYVRRALHRHYGAQHINLEGPIPAHLLGNMWAQTWSNIYDLVVPFPSAPSMDTTEAMLKQGWTPRRMFKEADDFFTSLGLLPVPPEFWNKSMLEKPTDGREVVCHASAWDFYNGKDFRIKQCTTVNLEDLVVAHHEMGHIQYFMQYKDLPVALREGANPGFHEAIGDVLALSVSTPKHLHSLNLLSSEGGSDEHDINFLMKMALDKIAFIPFSYLVDQWRWRVFDGSITKENYNQEWWSLRLKYQGLCPPVPRTQGDFDPGAKFHIPSSVPYIRYFVSFIIQFQFHEALCQAAGHTGPLHKCDIYQSKEAGQRLATAMKLGFSRPWPEAMQLITGQPNMSASAMLSYFKPLLDWLRTENELHGEKLGWPQYNWTPNSARSEGPLPDSGRVSFLGLDLDAQQARVGQWLLLFLGIALLVATLGLSQRLFSIRHRSLHRHSHGPQFGSEVELRHS

SEQ ID NO: 227 - protein, 805 aa, unidentified [sequence omitted]

SEQ ID NO: 228 - protein, 264 aa, unidentified
MPSIFAYQSSEVDWCESNFQYSELVAEFYNTFSNIPFFIFGPLMMLLMHPYAQKRSRYIYVVWVLFMIIGLFSMYFHMTLSFLGQLLDEIAILWLLGSGYSIWMPRCYFPSFLGGNRSQFIRLVFITTVVSTLLSFLRPTVNAYALNSIALHILYIVCQEYRKTSNKELRHLIEVSVVLWAVALTSWISDRLLCSFWQRIHFFYLHSIWHVLISITFPYGMVTMALVDANYEMPGETLKVRYWPRDSWPVGLPYVEIRGDDKDC

SEQ ID NO: 229 - protein, 275 aa, unidentified [sequence omitted]

SEQ ID NO: 230 - protein, 267 aa, unidentified [sequence omitted]

SEQ ID NO: 231 - protein, 614 aa, unidentified
MRPPQCLLHTPSLASPLLLLLLWLLGGGVGAEGREDAELLVTVRGGRLRGIRLKTPGGPVSAFLGIPFAEPPMGPRRFLPPEPKQPWSGVVDATTFQSVCYQYVDTLYPGFEGTEMWNPNRELSEDCLYLNVWTPYPRPTSPTPVLVWIYGGGFYSGASSLDVYDGRFLVQAERTVLVSMNYRVGAFGFLALPGSREAPGNVGLLDQRLALQWVQENVAAFGGDPTSVTLFGESAGAASVGMHLLSPPSRGLFHRAVLQSGAPNGPWATVGMGEARRRATQLAHLVGCPPGGTGGNDTELVACLRTRPAQVLVNHEWHVLPQESVFRFSFVPVVDGDFLSDTPEALINAGDFHGLQVLVGVVKDEGSYFLVYGAPGFSKDNESLISRAEFLAGVRVGVPQVSDLAAEAVVLHYTDWLHPEDPARLREALSDVVGDHNVVCPVAQLAGRLAAQGARVYAYVFEHRASTLSWPLWMGVPHGYEIEFIFGIPLDPSRNYTAEEKIFAQRLMRYWANFARTGDPNEPRDPKAPQWPPYTAGAQQYVSLDLRPLEVRRGLRAQACAFWNRFLPKLLSATDTLDEAERQWKAEFHRWSSYMVHWKNQFDHYSKQDRCSDL

SEQ ID NO: 232 - protein, 336 aa, unidentified
MGNCLHRAELSPSTENSSQLDFEDVWNSSYGVNDSFPDGDYGANLEAAAPCHSCNLLDDSALPFFILTSVLGILASSTVLFMLFRPLFRWQLCPGWPVLAQLAVGSALFSIVVPVLAPGLGSTRSSALCSLGYCVWYGSAFAQALLLGCHASLGHRLGAGQVPGLTLGLTVGIWGVAALLTLPVTLASGASGGLCTLIYSTELKALQATHTVACLAIFVLLPLGLFGAKGLKKALGMGPGPWMNILWAWFIFWWPHGVVLGLDFLVRSKLLLLSTCLAQQALDLLLNLAEALAILHCVATPLLLALFCHQATRTLLPSLPLPEGWSSHLDTLGSKS

SEQ ID NO: 233 - protein, 384 aa, unidentified
MAATASPQPLATEDADSENSSFYYYDYLDEVAFMLCRKDAVVSFGKVFLPVFYSLIFVLGLSGNLLLLMVLLRYVPRRRMVEIYLLNLAISNLLFLVTLPFWGISVAWHWVFGSFLCKMVSTLYTINFYSGIFFISCMSLDKYLEIVHAQPYHRLRTRAKSLLLATIVWAVSLAVSIPDMVFVQTHENPKGVWNCHADFGGHGTIWKLFLRFQQNLLGFLLPLLAMIFFYSRIGCVLVRLRPAGQGRALKIAAALVVAFFVLWFPYNLTLFLHTLLDLQVFGNCEVSQHLDYALQVTESIAFLHCCFSPILYAFSSHRFRQYLKAFLAAVLGWHLAPGTAQASLSSCSESSILTAQEEMTGMNDLGERQSENYPNKEDVGNKSA

SEQ ID NO: 234 - protein, 362 aa, unidentified
MDLHLFDYSEPGNFSDISWPCNSSDCIVVDTVMCPNMPNKSVLLYTLSFIYIFIFVIGMIANSVVVWVNIQAKTTGYDTHCYILNLAIADLWVVLTIPVWVVSLVQHNQWPMGELTCKVTHLIFSINLFGSIFFLTCMSVDRYLSITYFTNTPSSRKKMVRRVVCILVWLLAFCVSLPDTYYLKTVTSASNNETYCRSFYPEHSIKEWLIGMELVSVVLGFAVPFSIIAVFYFLLARAISASSDQEKHSSRKIIFSYVVVFLVCWLPYHVAVLLDIFSILHYIPFTCRLEHALFTALHVTQCLSLVHCCVNPVLYSFINRNYRYELMKAFIFKYSAKTGLTKLIDASRVSETEYSALEQSTK

SEQ ID NO: 235 - protein, 350 aa, unidentified
MALEQNQSTDYYYEENEMNGTYDYSQYELICIKEDVREFAKVFLPVFLTIVFVIGLAGNSMVVAIYAYYKKQRTKTDVYILNLAVADLLLLFTLPFWAVNAVHGWVLGKIMCKITSALYTLNFVSGMQFLACISIDRYVAVTKVPSQSGVGKPCWIICFCVWMAAILLSIPQLVFYTVNDNARCIPIFPRYLGTSMKALIQMLEICIGFVVPFLIMGVCYFITARTLMKMPNIKISRPLKVLLTVVIVFIVTQLPYNIVKFCRAIDIIYSLITSCNMSKRMDIAIQVTESIALFHSCLNPILYVFMGASFKNYVMKVAKKYGSWRRQRQSVEEFPFDSEGPTEPTSTFSI

SEQ ID NO: 236 - protein, 423 aa, unidentified
MAGKRSGWSRAALLQLLLGVNLVVMPPTRARSLRFVTLLYRHGDRSPVKTYPKDPYQEEEWPQGFGQLTKEGMLQHWELGQALRQRYHGFLNTSYHRQEVYVRSTDFDRTLMSAEANLAGLFPPNGMQRFNPNISWQPIPVHTVPITEDRLLKFPLGPCPRYEQLQNETRQTPEYQNESSRNAQFLDMVANETGLTDLTLETVWNVYDTLFCEQTHGLRLPPWASPQTMQRLSRLKDFSFRFLFGIYQQAEKARLQGGVLLAQIRKNLTLMATTSQLPKLLVYSAHDTTLVALQMALDVYNGEQAPYASCHIFELYQEDSGNFSVEMYFRNESDKAPWPLSLPGCPHRCPLQDFLRLTEPVVPKDWQQECQLASGPADTEVIVALAVCGSILFLLIVLLLTVLFRMQAQPPGYRHVADGEDHA

SEQ ID NO: 237 - protein, 386 aa, unidentified
MRAAPLLLARAASLSLGFLFLLFFWLDRSVLAKELKFVTLVFRHGDRSPIDTFPTDPIKESSWPQGFGQLTQLGMEQHYELGEYIRKRYRKFLNESYKHEQVYIRSTDVDRTLMSAMTNLAALFPPEGVSIWNPILLWQPIPVHTVPLSEDQLLYLPFRNCPRFQELESETLKSEEFQKRLHPYKDFIATLGKLSGLHGQDLFGIWSKVYDPLYCESVHNFTLPSWATEDTMTKLRELSELSLLSLYGIHKQKEKSRLQGGVLVNEILNHMKRATQIPSYKKLIMYSAHDTTVSGLQMALDVYNGLLPPYASCHLTELYFEKGEYFVEMYYRNETQHEPYPLMLPGCSPSCPLERFAELVGPVIPQDWSTECMTTNSHQGTEDSTD

SEQ ID NO: 238 - protein, 426 aa, unidentified
MAGLGFWGHPAGPLLLLLLLVLPPRALPEGPLVFVALVFRHGDRAPLASYPMDPHKEVASTLWPRGLGQLTTEGVRQQLELGRFLRSRYEAFLSPEYRREEVYIRSTDFDRTLESAQANLAGLFPEAAPGSPEARWRPIPVHTVPVAEDKLLRFPMRSCPRYHELLREATEAAEYQEALEGWTGFLSRLENFTGLSLVGEPLRRAWKVLDTLMCQQAHGLPLPAWASPDVLRTLAQISALDIGAHVGPPRAAEKAQLTGGILLNAILANFSRVQRLGLPLKMVMYSAHDSTLLALQGALGLYDGHTPPYAACLGFEFRKHLGNPAKDGGNVTVSLFYRNDSAHLPLPLSLPGCPAPCPLGRFYQLTAPARPPAHGVSCHGPYEAAIPPAPVVPLLAGAVAVLVALSLGLGLLAWRPGCLRALGGPV

SEQ ID NO: 239 - protein, 666 aa, unidentified
MTGTPKTQEGAKDLEVDMNKTEVTPRLWTTCRDGEVLLRLSKHGPGHETPMTIPEFFRESVNRFGTYPALASKNGKKWEILNFNQYYEACRKAAKSLIKLGLERFHGVGILGFNSAEWFITAVGAILAGGLCVGIYATNSAEVCQYVITHAKVNILLVENDQQLQKILSIPQSSLEPLKAIIQYRLPMKKNNNLYSWDDFMELGRSIPDTQLEQVIESQKANQCAVLIYTSGTTGIPKGVMLSHDNITWIAGAVTKDFKLTDKHETVVSYLPLSHIAAQMMDIWVPIKIGALTYFAQADALKGTLVSTLKEVKPTVFIGVPQIWEKIHEMVKKNSAKSMGLKKKAFVWARNIGFKVNSKKMLGKYNTPVSYRMAKTLVFSKVKTSLGLDHCHSFISGTAPLNQETAEFFLSLDIPIGELYGLSESSGPHTISNQNNYRLLSCGKILTGCKNMLFQQNKDGIGEICLWGRHIFMGYLESETETTEAIDDEGWLHSGDLGQLDGLGFLYVTGHIKEILITAGGENVPPIPVETLVKKKIPIISNAMLVGDKLKFLSMLLTLKCEMNQMSGEPLDKLNFEAINFCRGLGSQASTVTEIVKQQDPLVYKAIQQGINAVNQEAMNNAQRIEKWVILEKDFSIYGGELGPMMKLKRHFVAQKYKKQIDHMYH

SEQ ID NO: 240 - protein, 615 aa, unidentified
MAVYVGMLRLGRLCAGSSGVLGARAALSRSWQEARLQGVRFLSSREVDRMVSTPIGGLSYVQGCTKKHLNSKTVGQCLETTAQRVPEREALVVLHEDVRLTFAQLKEEVDKAASGLLSIGLCKGDRLGMWGPNSYAWVLMQLATAQAGIILVSVNPAYQAMELEYVLKKVGCKALVFPKQFKTQQYYNVLKQICPEVENAQPGALKSQRLPDLTTVISVDAPLPGTLLLDEVVAAGSTRQHLDQLQYNQQFLSCHDPINIQFTSGTTGSPKGATLSHYNIVNNSNILGERLKLHEKTPEQLRMILPNPLYHCLGSVAGTMMCLMYGATLILASPIFNGKKALEAISRERGTFLYGTPTMFVDILNQPDFSSYDISTMCGGVIAGSPAPPELIRAIINKINMKDLVVAYGTTENSPVTFAHFPEDTVEQKAESVGRIMPHTEARIMNMEAGTLAKLNTPGELCIRGYCVMLGYWGEPQKTEEAVDQDKWYWTGDVATMNEQGFCKIVGRSKDMIIRGGENIYPAELEDFFHTHPKVQEVQVVGVKDDRMGEEICACIRLKDGEETTVEEIKAFCKGKISHFKIPKYIVFVTNYPLTISGKIQKFKLREQMERHLNL

SEQ ID NO: 241 - protein, 576 aa, unidentified
MLPHVVLTFRRLGCALASCRLAPARHRGSGLLHTAPVARSDRSAPVFTRALAFGDRIALVDQHGRHTYRELYSRSLRLSQEICRLCGCVGGDLREERVSFLCANDASYVVAQWASWMSGGVAVPLYRKHPAAQLEYVICDSQSSVVLASQEYLELLSPVVRKLGVPLLPLTPAIYTGAVEEPAEVPVPEQGWRNKGAMIIYTSGTTGRPKGVLSTHQNIRAVVTGLVHKWAWTKDDVILHVLPLHHVHGVVNALLCPLWVGATCVMMPEFSPQQVWEKFLSSETPRINVFMAVPTIYTKLMEYYDRHFTQPHAQDFLRAVCEEKIRLMVSGSAALPLPVLEKWKNITGHTLLERYGMTEIGMALSGPLTTAVRLPGSVGTPLPGVQVRIVSENPQREACSYTIHAEGDERGTKVTPGFEEKEGELLVRGPSVFREYWNKPEETKSAFTLDGWFKTGDTVVFKDGQYWIRGRTSVDIIKTGGYKVSALEVEWHLLAHPSITDVAVIGVPDMTWGQRVTAVVTLREGHSLSHRELKEWARNVLAPYAVPSELVLVEEIPRNQMGKIDKKALIRHFHPS

SEQ ID NO: 242 - protein, 698 aa, unidentified
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLGRANRRKPKPPAPEDLAVICFTSGTTGNPKGAMVTHRNIVSDCSAFVKATENTVNPCPDDTLISFLPLAHMFERVVECVMLCHGAKIGFFQGDIRLLMDDLKVLQPTVFPVVPRLLNRMFDRIFGQANTTLKRWLLDFASKRKEAELRSGIIRNNSLWDRLIFHKVQSSLGGRVRLMVTGAAPVSATVLTFLRAALGCQFYEGYGQTECTAGCCLTMPGDWTAGHVGAPMPCNLIKLVDVEEMNYMAAEGEGEVCVKGPNVFQGYLKDPAKTAEALDKDGWLHTGDIGKWLPNGTLKIIDRKKHIFKLAQGEYIAPEKIENIYMRSEPVAQVFVHGESLQAFLIAIVVPDVETLCSWAQKRGFEGSFEELCRNKDVKKAILEDMVRLGKDSGLKPFEQVKGITLHPELFSIDNGLLTPTMKAKRPELRNYFRSQIDDLYSTIKV

SEQ ID NO: 243 - protein, 720 aa, unidentified
MNNHVSSKPSTMKLKHTINPILLYFIHFLISLYTILTYIPFYFFSESRQEKSNRIKAKPVNSKPDSAYRSVNSLDGLASVLYPGCDTLDKVFTYAKNKFKNKRLLGTREVLNEEDEVQPNGKIFKKVILGQYNWLSYEDVFVRAFNFGNGLQMLGQKPKTNIAIFCETRAEWMIAAQACFMYNFQLVTLYATLGGPAIVHALNETEVTNIITSKELLQTKLKDIVSLVPRLRHIITVDGKPPTWSEFPKGIIVHTMAAVEALGAKASMENQPHSKPLPSDIAVIMYTSGSTGLPKGVMISHSNIIAGITGMAERIPELGEEDVYIGYLPLAHVLELSAELVCLSHGCRIGYSSPQTLADQSSKIKKGSKGDTSMLKPTLMAAVPEIMDRIYKNVMNKVSEMSSFQRNLFILAYNYKMEQISKGRNTPLCDSFVFRKVRSLLGGNIRLLLCGGAPLSATTQRFMNICFCCPVGQGYGLTESAGAGTISEVWDYNTGRVGAPLVCCEIKLKNWEEGGYFNTDKPHPRGEILIGGQSVTMGYYKNEAKTKADFFEDENGQRWLCTGDIGEFEPDGCLKIIDRKKDLVKLQAGEYVSLGKVEAALKNLPLVDNICAYANSYHSYVIGFVVPNQKELTELARKKGLKGTWEELCNSCEMENEVLKVLSEAAISASLEKFEIPVKIRLSPEPWTPETGLVTDAFKLKRKELKTHYQADIERMYGRK

SEQ ID NO: 244 - protein, 711 aa, unidentified
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTALGLKPKNTIAIFCETRAEWMIAAQTCFKYNFPLVTLYATLGKEAVVHGLNESEASYLITSVELLESKLKTALLDISCVKHIIYVDNKAINKAEYPEGFEIHSMQSVEELGSNPENLGIPPSRPTPSDMAIVMYTSGSTGRPKGVMMHHSNLIAGMTGQCERIPGLGPKDTYIGYLPLAHVLELTAEISCFTYGCRIGYSSPLTLSDQSSKIKKGSKGDCTVLKPTLMAAVPEIMDRIYKNVMSKVQEMNYIQKTLFKIGYDYKLEQIKKGYDAPLCNLLLFKKVKALLGGNVRMMLSGGAPLSPQTHRFMNVCFCCPIGQGYGLTESCGAGTVTEVTDYTTGRVGAPLICCEIKLKDWQEGGYTINDKPNPRGEIVIGGQNISMGYFKNEEKTAEDYSVDENGQRWFCTGDIGEFHPDGCLQIIDRKKDLVKLQAGEYVSLGKVEAALKNCPLIDNICAFAKSDQSYVISFVVPNQKRLTLLAQQKGVEGTWVDICNNPAMEAEILKEIREAANAMKLERFEIPIKVRLSPEPWTPETGLVTDAFKLKRKELRNHYLKDIERMYGGK

SEQ ID NO: 245 - protein, 683 aa, unidentified
MLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDLSVICFTSGTTGDPKGAMITHQNIVSNAAAFLKCVEHAYEPTPDDVAISYLPLAHMFERIVQAVVYSCGARVGFFQGDIRLLADDMKTLKPTLFPAVPRLLNRIYDKVQNEAKTPLKKFLLKLAVSSKFKELQKGIIRHDSFWDKLIFAKIQDSLGGRVRVIVTGAAPMSTSVMTFFRAAMGCQVYEAYGQTECTGGCTFTLPGDWTSGHVGVPLACNYVKLEDVADMNYFTVNNEGEVCIKGTNVFKGYLKDPEKTQEALDSDGWLHTGDIGRWLPNGTLKIIDRKKNIFKLAQGEYIAPEKIENIYNRSQPVLQIFVHGESLRSSLVGVVVPDTDVLPSFAAKLGVKGSFEELCQNQVVREAILEDLQKIGKESGLKTFEQVKAIFLHPEPFSIENGLLTPTLKAKRGELSKYFRTQIDSLYEHIQD

SEQ ID NO: 246 - protein, 697 aa, unidentified
MQTQEILRILRLPELGDLGQFFRSLSATTLVSMGALAAILAYWFTHRPKALQPPCNLLMQSEEVEDSGGARRSVIGSGPQLLTHYYDDARTMYQVFRRGLSISGNGPCLGFRKPKQPYQWLSYQEVADRAEFLGSGLLQHNCKACTDQFIGVFAQNRPEWIIVELACYTYSMVVVPLYDTLGPGAIRYIINTADISTVIVDKPQKAVLLLEHVERKETPGLKLIILMDPFEEALKERGQKCGVVIKSMQAVEDCGQENHQAPVPPQPDDLSIVCFTSGTTGNPKGAMLTHGNVVADFSGFLKVTEKVIFPRQDDVLISFLPLAHMFERVIQSVVYCHGGRVGFFQGDIRLLSDDMKALCPTIFPVVPRLLNRMYDKIFSQANTPLKRWLLEFAAKRKQAEVRSGIIRNDSIWDELFFNKIQASLGGCVRMIVTGAAPASPTVLGFLRAALGCQVYEGYGQTECTAGCTFTTPGDWTSGHVGAPLPCNHIKLVDVEELNYWACKGEGEICVRGPNVFKGYLKDPDRTKEALDSDGWLHTGDIGKWLPAGTLKIIDRKKHIFKLAQGEYVAPEKIENIYIRSQPVAQIYVHGDSLKAFLVGIVVPDPEVMPSWAQKRGIEGTYADLCTNKDLKKAILEDMVRLGKESGLHSFEQVKAIHIHSDMFSVQNGLLTPTLKAKRPELREYFKKQIEELYSISM

SEQ ID NO: 247 - protein, 577 aa, unidentified
MQWLMRFRTLWGIHKSFHNIHPAPSQLRCRSLSEFGAPRWNDYEVPEEFNFASYVLDYWAQKEKEGKRGPNPAFWWVNGQGDEVKWSFREMGDLTRRVANVFTQTCGLQQGDHLALMLPRVPEWWLVAVGCMRTGIIFIPATILLKAKDILYRLQLSKAKGIVTIDALASEVDSIASQCPSLKTKLLVSDHSREGWLDFRSLVKSASPEHTCVKSKTLDPMVIFFTSGTTGFPKMAKHSHGLALQPSFPGSRKLRSLKTSDVSWCLSDSGWIVATIWTLVEPWTAGCTVFIHHLPQFDTKVIIQTLLKYPINHFWGVSSIYRMILQQDFTSIRFPALEHCYTGGEVVLPKDQEEWKRRTGLLLYENYGQSETGLICATYWGMKIKPGFMGKATPPYDVQVIDDKGSILPPNTEGNIGIRIKPVRPVSLFMCYEGDPEKTAKVECGDFYNTGDRGKMDEEGYICFLGRSDDIINASGYRIGPAEVESALVEHPAVAESAVVGSPDPIRGEVVKAFIVLTPQFLSHDKDQLTKELQQHVKSVTAPYKYPRKVEFVSELPKTITGKIERKELRKKETGQM

SEQ ID NO: 248 - protein, 577 aa, unidentified
MHWLRKVQGLCTLWGTQMSSRTLYINSRQLVSLQWGHQEVPAKFNFASDVLDHWADMEKAGKRLPSPALWWVNGKGKELMWNFRELSENSQQAANVLSGACGLQRGDRVAVVLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILCSLMEPWALGACTFVHLLPKFDPLVILKTLSSYPIKSMMGAPIVYRMLLQQDLSSYKFPHLQNCVTVGESLLPETLENWRAQTGLDIRESYGQTETGLTCMVSKTMKIKPGYMGTAASCYDVQIIDDKGNVLPPGTEGDIGIRVKPIRPIGIFSGYVDNPDKTAANIRGDFWLLGDRGIKDEDGYFQFMGRANDIINSSGYRIGPSEVENALMEHPAVVETAVISSPDPVRGEVVKAFVVLASQFLSHDPEQLTKELQQHVKSVTAPYKYPRKIEFVLNLPKTVTGKIQRAKLRDKEWKMSGKARAQ

SEQ ID NO: 249 - protein, 577 aa, unidentified
MHWLRKVQGLCTLWGTQMSSRTLYINSRQLVSLQWGHQEVPAKFNFASDVLDHWADMEKAGKRLPSPALWWVNGKGKELMWNFRELSENSQQAANILSGACGLQRGDRVAVMLPRVPEWWLVILGCIRAGLIFMPGTIQMKSTDILYRLQMSKAKAIVAGDEVIQEVDTVASECPSLRIKLLVSEKSCDGWLNFKKLLNEASTTHHCVETGSQEASAIYFTSGTSGLPKMAEHSYSSLGLKAKMDAGWTGLQASDIMWTISDTGWILNILGSLLESWTLGACTFVHLLPKFDPLVILKTLSSYPIKSMMGAPIVYRMLLQQDLSSYKFPHLQNCLAGGESLLPETLENWRAQTGLDIREFYGQTETGLTCMVSKTMKIKPGYMGTAASCYDVQVIDDKGNVLPPGTEGDIGIRVKPIRPIGIFSGYVENPDKTAANIRGDFWLLGDRGIKDEDGYFQFMGRADDIINSSGYRIGPSEVENALMKHPAVVETAVISSPDPVRGEVVKAFVILASQFLSHDPEQLTKELQQHVKSVTAPYKYPRKIEFVLNLPKTVTGKIQRTKLRDKEWKMSGKARAQ

SEQ ID NO: 250 - protein, 580 aa, unidentified
MKIFFRYQTFRFIWLTKPPGRRLHKDHQLWTPLTLADFEAINRCNRPLPKNFNFAADVLDQWSQKEKTGERPANPALWWVNGKGDEVKWSFRELGSLSRKAANVLTKPCGLQRGDRLAVILPRIPEWWLVNVACIRTGIIFMPGTIQLTAKDILYRLRASKAKCIVASEEVAPAVESIVLECPDLKTKLLVSPQSWNGWLSFQELFQFASEEHSCVETGSQEPMTIYFTSGTTGFPKMAQHSQSSLGIGFTLCGRYWLDLKSSDIIWNMSDTGWVKAAIGSVFSSWLCGACVFVHRMAQFDTDTFLDTLTTYPITTLCSPPTVYRMLVQKDLKRYKFKSLRHCLTGGEPLNPEVLEQWRVQTGLELYEGYGQTEVGMICANQKGQEIKPGSMGKGMLPYDVQIIDENGNVLPPGKEGEIALRLKPTRPFCFFSKYVDNPQKTAATIRGDFYVTGDRGVMDSDGYFWFVGRADDVIISSGYRIGPFEVESALIEHPAVVESAVVSSPDQIRGEVVKAFVVLAAPFKSYNPEKLTLELQDHVKKSTAPYKYPRKVEFVQELPKTITGKIKRNVLRDQEWRGR

SEQ ID NO: 251 - protein, 480 aa, unidentified
MLGRFQPFSLVRSFRLGFEACCYPNQKCATQTIRPPDSRCLVQAVSQNFNFAKDVLDQWSQLEKDGLRGPYPALWKVSAKGEEDKWSFERMTQLSKKAASILSDTCALSHGDRLMIILPPTPEAYWICLACVRLGITFVPGSPQLTAKKIRYQLRMSKAQCIVANEAMAPVVNSAVSDCPTLKTKLLVSDKSYDGWLDFKKLIQVAPPKQTYMRTKSQDPMAIFFTKGTTGAPKMVEYSQYGLGMGFSQASRRWMDLQPTDVLWSLGDAFGGSLSLSAVLGTWFQGACVFLCHMPTFCPETVLNVLSRFPITTLSANPEMYQELLQHKCFTSYRFKSLKQCVAAGGPISPGVIEDWKRITKLDIYEGYGQTETGLLCATSKTIKLKPSSLGKPLPPYIVQIVDENSNLLPPGEEGNIAIRIKLNQPASLYCPHMVSWEEYASARGHMLYLTGDRGIMDEDGYFWWSGRVDDVANALGQRL

SEQ ID NO: 252 - protein, 689 aa, unidentified [sequence omitted]

SEQ ID NO: 253 - protein, 701 aa, unidentified [sequence omitted]

SEQ ID NO: 254 - protein, 686 aa, unidentified
MKPSWLQCRKVTSAGGLGGPLPGSSPARGAGAALRALVVPGPRGGLGGRGCRALSSGSGSEYKTHFAASVTDPERFWGKAAEQISWYKPWTKTLENKHSPSTRWFVEGMLNICYNAVDRHIENGKGDKIAIIYDSPVTNTKATFTYKEVLEQVSKLAGVLVKHGIKKGDTVVIYMPMIPQAMYTMLACARIGAIHSLIFGGFASKELSSRIDHVKPKVVVTASFGIEPGRRVEYVPLVEEALKIGQHKPDKILIYNRPNMEAVPLAPGRDLDWDEEMAKAQSHDCVPVLSEHPLYILYTSGTTGLPKGVIRPTGGYAVMLHWSMSSIYGLQPGEVWWAASDLGWVVGHSYICYGPLLHGNTTVLYEGKPVGTPDAGAYFRVLAEHGVAALFTAPTAIRAIRQQDPGAALGKQYSLTRFKTLFVAGERCDVETLEWSKNVFRVPVLDHWWQTETGSPITASCVGLGNSKTPPPGQAGKSVPGYNVMILDDNMQKLKARCLGNIVVKLPLPPGAFSGLWKNQEAFKHLYFEKFPGYYDTMDAGYMDEEGYLYVMSRVDDVINVAGHRISAGAIEESILSHGTVADCAVVGKEDPLKGHVPLALCVLRKDINATEEQVLEEIVKHVRQNIGPVAAFRNAVFVKQLPKTRSGKIPRSALSAIVNGKPYKITSTIEDPSIFGHVEEMLKQA

SEQ ID NO: 255 - protein, 509 aa, unidentified
MVDGVMILPVLIMIALPSPSMEDEKPKVNPKLYMCVCEGLSCGNEDHCEGQQCFSSLSINDGFHVYQKGCFQVYEQGKMTCKTPPSPGQAVECCQGDWCNRNITAQLPTKGKSFPGTQNFHLEVGLIILSVVFAVCLLACLLGVALRKFKRRNQERLNPRDVEYGTIEGLITTNVGDSTLADLLDHSCTSGSGSGLPFLVQRTVARQITLLECVGKGRYGEVWRGSWQGENVAVKIFSSRDEKSWFRETELYNTVMLRHENILGFIASDMTSRHSSTQLWLITHYHEMGSLYDYLQLTTLDTVSCLRIVLSIASGLAHLHIEIFGTQGKPAIAHRDLKSKNILVKKNGQCCIADLGLAVMHSQSTNQLDVGNNPRVGTKRYMAPEVLDETIQVDCFDSYKRVDIWAFGLVLWEVARRMVSNGIVEDYKPPFYDVVPNDPSFEDMRKVVCVDQQRPNIPNRWFSDPTLTSLAKLMKECWYQNPSARLTALRIKKTLTKIDNSLDKLKTDC

SEQ ID NO: 256 - protein, 505 aa, unidentified
MAESAGASSFFPLVVLLLAGSGGSGPRGVQALLCACTSCLQANYTCETDGACMVSIFNLDGMEHHVRTCIPKVELVPAGKPFYCLSSEDLRNTHCCYTDYCNRIDLRVPSGHLKEPEHPSMWGPVELVGIIAGPVFLLFLIIIIVFLVINYHQRVYHNRQRLDMEDPSCEMCLSKDKTLQDLVYDLSTSGSGSGLPLFVQRTVARTIVLQEIIGKGRFGEVWRGRWRGGDVAVKIFSSREERSWFREAEIYQTVMLRHENILGFIAADNKDNGTWTQLWLVSDYHEHGSLFDYLNRYTVTIEGMIKLALSAASGLAHLHMEIVGTQGKPGIAHRDLKSKNILVKKNGMCAIADLGLAVRHDAVTDTIDIAPNQRVGTKRYMAPEVLDETINMKHFDSFKCADIYALGLVYWEIARRCNSGGVHEEYQLPYYDLVPSDPSIEEMRKVVCDQKLRPNIPNWWQSYEALRVMGKMMRECWYANGAARLTALRIKKTLSQLSVQEDVKI

SEQ ID NO: 257 - protein, 493 aa, unidentified
MTRALCSALRQALLLLAAAAELSPGLKCVCLLCDSSNFTCQTEGACWASVMLTNGKEQVIKSCVSLPELNAQVFCHSSNNVTKTECCFTDFCNNITLHLPTASPNAPKLGPMELAIIITVPVCLLSIAAMLTVWACQGRQCSYRKKKRPNVEEPLSECNLVNAGKTLKDLIYDVTASGSGSGLPLLVQRTIARTIVLQEIVGKGRFGEVWHGRWCGEDVAVKIFSSRDERSWFREAEIYQTVMLRHENILGFIAADNKDNGTWTQLWLVSEYHEQGSLYDYLNRNIVTVAGMIKLALSIASGLAHLHMEIVGTQGKPAIAHRDIKSKNILVKKCETCAIADLGLAVKHDSILNTIDIPQNPKVGTKRYMAPEMLDDTMNVNIFESFKRADIYSVGLVYWEIARRCSVGGIVEEYQLPYYDMVPSDPSIEEMRKVVCDQKFRPSIPNQWQSCEALRVMGRIMRECWYANGAARLTALRIKKTISQLCVKEDCKA

SEQ ID NO: 258 - protein, 513 aa, unidentified
MGAAAKLAFAVFLISCSSGAILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKRGTSVDVDLWLITAFHEKGSLSDFLKANVVSWNELCHIAETMARGLAYLHEDIPGLKDGHKPAISHRDIKSKNVLLKNNLTACIADFGLALKFEAGKSAGDTHGQVGTRRYMAPEVLEGAINFQRDAFLRIDMYAMGLVLWELASRCTAADGPVDEYMLPFEEEIGQHPSLEDMQEVVVHKKKRPVLRDYWQKHAGMAMLCETIEECWDHDAEARLSAGCVGERITQMQRLTNIITTEDIVTVVTMVTNVDFPPKESSL

SEQ ID NO: 259 - protein, 512 aa, unidentified
MTAPWVALALLWGSLCAGSGRGEAETRECIYYNANWELERTNQSGLERCEGEQDKRLHCYASWRNSSGTIELVKKGCWLDDFNCYDRQECVATEENPQVYFCCCEGNFCNERFTHLPEAGGPEVTYEPPPTAPTLLTVLAYSLLPIGGLSLIVLLAFWMYRHRKPPYGHVDIHEDPGPPPPSPLVGLKPLQLLEIKARGRFGCVWKAQLMNDFVAVKIFPLQDKQSWQSEREIFSTPGMKHENLLQFIAAEKRGSNLEVELWLITAFHDKGSLTDYLKGNIITWNELCHVAETMSRGLSYLHEDVPWCRGEGHKPSIAHRDFKSKNVLLKSDLTAVLADFGLAVRFEPGKPPGDTHGQVGTRRYMAPEVLEGAINFQRDAFLRIDMYAMGLVLWELVSRCKAADGPVDEYMLPFEEEIGQHPSLEELQEVVVHKKMRPTIKDHWLKHPGLAQLCVTIEECWDHDAEARLSAGCVEERVSLIRRSVNGTTSDCLVSLVTSVTNVDLPPKESSI

SEQ ID NO: 260 - protein, 503 aa, unidentified
MTLGSPRKGLLMLLMALVTQGDPVKPSRGPLVTCTCESPHCKGPTCRGAWCTVVLVREEGRHPQEHRGCGNLHRELCRGRPTEFVNHYCCDSHLCNHNVSLVLEATQPPSEQPGTDGQLALILGPVLALLALVALGVLGLWHVRRRQEKQRGLHSELGESSLILKASEQGDSMLGDLLDSDCTTGSGSGLPFLVQRTVARQVALVECVGKGRYGEVWRGLWHGESVAVKIFSSRDEQSWFRETEIYNTVLLRHDNILGFIASDMTSRNSSTQLWLITHYHEHGSLYDFLQRQTLEPHLALRLAVSAACGLAHLHVEIFGTQGKPAIAHRDFKSRNVLVKSNLQCCIADLGLAVMHSQGSDYLDIGNNPRVGTKRYMAPEVLDEQIRTDCFESYKWTDIWAFGLVLWEIARRTIVNGIVEDYRPPFYDVVPNDPSFEDMKKVVCVDQQTPTIPNRLAADPVLSGLAQMMRECWYPNPSARLTALRIKKTLQKISNSPEKPKVIQ

SEQ ID NO: 261 - protein, 748 aa, unidentified
MVLLRVLILLLSWAAGMGGQYGNPLNKYIRHYEGLSYNVDSLHQKHQRAKRAVSHEDQFLRLDFHAHGRHFNLRMKRDTSLFSDEFKVETSNKVLDYDTSHIYTGHIYGEEGSFSHGSVIDGRFEGFIQTRGGTFYVEPAERYIKDRTLPFHSVIYHEDDINYPHKYGPQGGCADHSVFERMRKYQMTGVEEVTQIPQEEHAANGPELLRKKRTTSAEKNTCQLYIQTDHLFFKYYGTREAVIAQISSHVKAIDTIYQTTDFSGIRNISFMVKRIRINTTADEKDPTNPFRFPNIGVEKFLELNSEQNHDDYCLAYVFTDRDFDDGVLGLAWVGAPSGSSGGICEKSKLYSDGKKKSLNTGIITVQNYGSHVPPKVSHITFAHEVGHNFGSPHDSGTECTPGESKNLGQKENGNYIMYARATSGDKLNNNKFSLCSIRNISQVLEKKRNNCFVESGQPICGNGMVEQGEECDCGYSDQCKDECCFDANQPEGRKCKLKPGKQCSPSQGPCCTAQCAFKSKSEKCRDDSDCAREGICNGFTALCPASDPKPNFTDCNRHTQVCINGQCAGSICEKYGLEECTCASSDGKDDKELCHVCCMKKMDPSTCASTGSVQWSRHFSGRTITLQPGSPCNDFRGYCDVFMRCRLVDADGPLARLKKAIFSPELYENIAEWIVAHWWAVLLMGIALIMLMAGFIKICSVHTPSSNPKLPPPKPLPGTLKRRRPPQPIQQPQRQRPRESYQMGHMRR

SEQ ID NO: 262 - protein, 769 aa, unidentified
MRLLRRWAFAALLLSLLPTPGLGTQGPAGALRWGGLPQLGGPGAPEVTEPSRLVRESSGGEVRKQQLDTRVRQEPPGGPPVHLAQVSFVIPAFNSNFTLDLELNHHLLSSQYVERHFSREGTTQHSTGAGDHCYYQGKLRGNPHSFAALSTCQGLHGVFSDGNLTYIVEPQEVAGPWGAPQGPLPHLIYRTPLLPDPLGCREPGCLFAVPAQSAPPNRPRLRRKRQVRRGHPTVHSETKYVELIVINDHQLFEQMRQSVVLTSNFAKSVVNLADVIYKEQLNTRIVLVAMETWADGDKIQVQDDLLETLARLMVYRREGLPEPSDATHLFSGRTFQSTSSGAAYVGGICSLSHGGGVNEYGNMGAMAVTLAQTLGQNLGMMWNKHRSSAGDCKCPDIWLGCIMEDTGFYLPRKFSRCSIDEYNQFLQEGGGSCLFNKPLKLLDPPECGNGFVEAGEECDCGSVQECSRAGGNCCKKCTLTHDAMCSDGLCCRRCKYEPRGVSCREAVNECDIAETCTGDSSQCPPNLHKLDGYYCDHEQGRCYGGRCKTRDRQCQVLWGHAAADRFCYEKLNVEGTERGSCGRKGSGWVQCSKQDVLCGFLLCVNISGAPRLGDLVGDISSVTFYHQGKELDCRGGHVQLADGSDLSYVEDGTACGPNMLCLDHRCLPASAFNFSTCPGSGERRICSHHGVCSNEGKCICQPDWTGKDCSIHNPLPTSPPTGETERYKGPSGTNIIIGSIAGAVLVAAIVLGGTGWGFKNIRRGRSGGA

SEQ ID NO: 263 - protein, 909 aa, unidentified
MAARPLPVSPARALLLALAGALLAPCEARGVSLWNQGRADEVVSASVGSGDLWIPVKSFDSKNHPEVLNIRLQRESKELIINLERNEGLIASSFTETHYLQDGTDVSLARNYTVILGHCYYHGHVRGYSDSAVSLSTCSGLRGLIVFENESYVLEPMKSATNRYKLFPAKKLKSVRGSCGSHHNTPNLAAKNVFPPPSQTWARRHKRETLKATKYVELVIVADNREFQRQGKDLEKVKQRLIEIANHVDKFYRPLNIRIVLVGVEVWNDMDKCSVSQDPFTSLHEFLDWRKMKLLPRKSHDNAQLVSGVYFQGTTIGMAPIMSMCTADQSGGIVMDHSDNPLGAAVTLAHELGHNFGMNHDTLDRGCSCQMAVEKGGCIMNASTGYPFPMVFSSCSRKDLETSLEKGMGVCLFNLPEVRESFGGQKCGNRFVEEGEECDCGEPEECMNRCCNATTCTLKPDAVCAHGLCCEDCQLKPAGTACRDSSNSCDLPEFCTGASPHCPANVYLHDGHSCQDVDGYCYNGICQTHEQQCVTLWGPGAKPAPGICFERVNSAGDPYGNCGKVSKSSFAKCEMRDAKCGKIQCQGGASRPVIGTNAVSIETNIPLQQGGRILCRGTHVYLGDDMPDPGLVLAGTKCADGKICLNRQCQNISVFGVHECAMQCHGRGVCNNRKNCHCEAHWAPPFCDKFGFGGSTDSGPIRQADNQGLTIGILVTILCLLAAGFVVYLKRKTLIRLLFTNKKTTIEKLRCVRPSRPPRGFQPCQAHLGHLGKGLMRKPPDSYPPKDNPRRLLQCQNVDISRPLNGLNVPQPQSTQRVLPPLHRAPRAPSVPARPLPAKPALRQAQGTCKPNPPQKPLPADPLARTTRLTHALARTPGQWETGLRLAPLRPAPQYPHQVPRSTHTAYIK

SEQ ID NO: 264 - protein, 863 aa, unidentified
MRLALLWALGLLGAGSPLPSWPLPNIGGTEEQQAESEKAPREPLEPQVLQDDLPISLKKVLQTSLPEPLRIKLELDGDSHILELLQNRELVPGRPTLVWYQPDGTRVVSEGHTLENCCYQGRVRGYAGSWVSICTCSGLRGLVVLTPERSYTLEQGPGDLQGPPIISRIQDLHLPGHTCALSWRESVHTQKPPEHPLGQRHIRRRRDVVTETKTVELVIVADHSEAQKYRDFQHLLNRTLEVALLLDTFFRPLNVRVALVGLEAWTQRDLVEISPNPAVTLENFLHWRRAHLLPRLPHDSAQLVTGTSFSGPTVGMAIQNSICSPDFSGGVNMDHSTSILGVASSIAHELGHSLGLDHDLPGNSCPCPGPAPAKTCIMEASTDFLPGLNFSNCSRRALEKALLDGMGSCLFERLPSLPPMAAFCGNMFVEPGEQCDCGFLDDCVDPCCDSLTCQLRPGAQCASDGPCCQNCQLRPSGWQCRPTRGDCDLPEFCPGDSSQCPPDVSLGDGEPCAGGQAVCMHGRCASYAQQCQSLWGPGAQPAAPLCLQTANTRGNAFGSCGRNPSGSYVSCTPRDAICGQLQCQTGRTQPLLGSIRDLLWETIDVNGTELNCSWVHLDLGSDVAQPLLTLPGTACGPGLVCIDHRCQRVDLLGAQECRSKCHGHGVCDSNRHCYCEEGWAPPDCTTQLKATSSLTTGLLLSLLVLLVLVMLGASYWYRARLHQRLCQLKGPTCQYRAAQSGPSERPGPPQRALLARGTKQASALSFPAPPSRPLPPDPVSKRLQAELADRPNPPTRPLPADPVVRSPKSQGPAKPPPPRKPLPADPQGRCPSGDLPGPGAGIPPLVVPSRPAPPPPTVSSLYL

SEQ ID NO: 265 - protein, 824 aa, unidentified
MRQSLLFLTSVVPFVLAPRPPDDPGFGPHQRLEKLDSLLSDYDILSLSNIQQHSVRKRDLQTSTHVETLLTFSALKRHFKLYLTSSTERFSQNFKVVVVDGKNESEYTVKWQDFFTGHVVGEPDSRVLAHIRDDDVIIRINTDGAEYNIEPLWRFVNDTKDKRMLVYKSEDIKNVSRLQSPKVCGYLKVDNEELLPKGLVDREPPEELVHRVKRRADPDPMKNTCKLLVVADHRFYRYMGRGEESTTTNYLIELIDRVDDIYRNTSWDNAGFKGYGIQIEQIRILKSPQEVKPGEKHYNMAKSYPNEEKDAWDVKMLLEQFSFDIAEEASKVCLAHLFTYQDFDMGTLGLAYVGSPRANSHGGVCPKAYYSPVGKKNIYLNSGLTSTKNYGKTILTKEADLVTTHELGHNFGAEHDPDGLAECAPNEDQGGKYVMYPIAVSGDHENNKMFSNCSKQSIYKTIESKAQECFQERSNKVCGNSRVDEGEECDPGIMYLNNDTCCNSDCTLKEGVQCSDRNSPCCKNCQFETAQKKCQEAINATCKGVSYCTGNSSECPPPGNAEDDTVCLDLGKCKDGKCIPFCEREQQLESCACNETDNSCKVCCRDLSGRCVPYVDAEQKNLFLRKGKPCTVGFCDMNGKCEKRVQDVIERFWDFIDQLSINTFGKFLADNIVGSVLVFSLIFWIPFSILVHCVDKKLDKQYESLSLFHPSNVEMLSSMDSASVRIIKPFPAPQTPGRLQPAPVIPSAPAAPKLDHQRMDTIQEDPSTDSHMDEDGFEKDPFPNSSTAAKSFEDLTDHPVTRSEKAASFKLQRQNRVDSKETEC

SEQ ID NO: 266 - protein, 739 aa, unidentified
MFLLLALLTELGRLQAHEGSEGIFLHVTVPRKIKSNDSEVSERKMIYIITIDGQPYTLHLGKQSFLPQNFLVYTYNETGSLHSVSPYFMMHCHYQGYAAEFPNSFVTLSICSGLRGFLQFENISYGIEPVESSARFEHIIYQMKNNDPNVSILAVNYSHIWQKDQPYKVPLNSQIKNLSKLLPQYLEIYIIVEKALYDYMGSEMMAVTQKIVQVIGLVNTMFTQFKLTVILSSLELWSNENQISTSGDADDILQRFLAWKRDYLILRPHDIAYLLVYRKHPKYVGATFPGTVCNKSYDAGIAMYPDAIGLEGFSVIIAQLLGLNVGLTYDDITQCFCLRATCIMNHEAVSASGRKIFSNCSMHDYRYFVSKFETKCLQKLSNLQPLHQNQPVCGNGILESNEECDCGNKNECQFKKCCDYNTCKLKGSVKCGSGPCCTSKCELSIAGTPCRKSIDPECDFTEYCNGTSSNCVPDTYALNGRLCKLGTAYCYNGQCQTTDNQCAKIFGKGAQGAPFACFKEVNSLHERSENCGFKNSQPLPCERKDVLCGKLACVQPHKNANKSDAQSTVYSYIQDHVCVSIATGSSMRSDGTDNAYVADGTMCGPEMYCVNKTCRKVHLMGYNCNATTKCKGKGICNNFGNCQCFPGHRPPDCKFQFGSPGGSIDDGNFQKSGDFYTEKGYNTHWNNWFILSFCIFLPFFIVFTTVIFKRNEISKSCNRENAEYNRNSSVVSESDDVGH

SEQ ID NO: 267 - protein, 955 aa, unidentified
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRIALVGLEVWTHGNMCEVSENPYSTLWSFLSWRRKLLAQKYHDNAQLITGMSFHGTTIGLAPLMAMCSVYQSGGVNMDHSENAIGVAATMAHEMGHNFGMTHDSADCCSASAADGGCIMAAATGHPFPKVFNGCNRRELDRYLQSGGGMCLSNMPDTRMLYGGRRCGNGYLEDGEECDCGEEEECNNPCCNASNCTLRPGAECAHGSCCHQCKLLAPGTLCREQARQCDLPEFCTGKSPHCPTNFYQMDGTPCEGGQAYCYNGMCLTYQEQCQQLWGPGARPAPDLCFEKVNVAGDTFGNCGKDMNGEHRKCNMRDAKCGKIQCQSSEARPLESNAVPIDTTIIMNGRQIQCRGTHVYRGPEEEGDMLDPGLVMTGTKCGYNHICFEGQCRNTSFFETEGCGKKCNGHGVCNNNQNCHCLPGWAPPFCNTPGHGGSIDSGPMPPESVGPVVAGVLVAILVLAVLMLMYYCCRQNNKLGQLKPSALPSKLRQQFSCPFRVSQNSGTGHANPTFKLQTPQGKRKVINTPEILRKPSQPPPRPPPDYLRGGSPPAPLPAHLSRAARNSPGPGSQIERTESSRRPPPSRPIPPAPNCIVSQDFSRPRPPQKALPANPVPGRRSLPRPGGASPLRPPGAGPQQSRPLAALAPKVSPREALKVKAGTRGLQGGRCRVEKTKQFMLLVVWTELPEQKPRAKHSCFLVPA

SEQ ID NO: 268 - protein, 735 aa, unidentified
MWRVLFLLSGLGGLRMDSNFDSLPVQITVPEKIRSIIKEGIESQASYKIVIEGKPYTVNLMQKNFLPHNFRVYSYSGTGIMKPLDQDFQNFCHYQGYIEGYPKSVVMVSTCTGLRGVLQFENVSYGIEPLESSVGFEHVIYQVKHKKADVSLYNEKDIESRDLSFKLQSVEPQQDFAKYIEMHVIVEKQLYNHMGSDTTVVAQKVFQLIGLTNAIFVSFNITIILSSLELWIDENKIATTGEANELLHTFLRWKTSYLVLRPHDVAFLLVYREKSNYVGATFQGKMCDANYAGGVVLHPRTISLESLAVILAQLLSLSMGITYDDINKCQCSGAVCIMNPEAIHFSGVKIFSNCSFEDFAHFISKQKSQCLHNQPRLDPFFKQQAVCGNAKLEAGEECDCGTEQDCALIGETCCDIATCRFKAGSNCAEGPCCENCLFMSKERMCRPSFEECDLPEYCNGSSASCPENHYVQTGHPCGLNQWICIDGVCMSGDKQCTDTFGKEVEFGPSECYSHLNSKTDVSGNCGISDSGYTQCEADNLQCGKLICKYVGKFLLQIPRATIIYANISGHLCIAVEFASDHADSQKMWIKDGTSCGSNKVCRNQRCVSSSYLGYDCTTDKCNDRGVCNNKKHCHCSASYLPPDCSVQSDLWPGGSIDSGNFPPVAIPARLPERRYIENIYHSKPMRWPFFLFIPFFIIFCVLIAIMVKVNFQRKKWRTEDYSSDEQPESESEPKG

SEQ ID NO: 269 - protein, 726 aa, unidentified
MAVGEPLVHIRVTLLLLWFGMFLSISGHSQARPSQYFTSPEVVIPLKVISRGRGAKAPGWLSYSLRFGGQRYIVHMRVNKLLFAAHLPVFTYTEQHALLQDQPFIQDDCYYHGYVEGVPESLVALSTCSGGFLGMLQINDLVYEIKPISVSATFEHLVYKIDSDDTQFPPMRCGLTEEKIAHQMELQLSYNFTLKQSSFVGWWTHQRFVELVVVVDNIRYLFSQSNATTVQHEVFNVVNIVDSFYHPLEVDVILTGIDIWTASNPLPTSGDLDNVLEDFSIWKNYNLNNRLQHDVAHLFIKDTQGMKLGVAYVKGICQNPFNTGVDVFEDNRLVVFAITLGHELGHNLGMQHDTQWCVCELQWCIMHAYRKVTTKFSNCSYAQYWDSTISSGLCIQPPPYPGNIFRLKYCGNLVVEEGEECDCGTIRQCAKDPCCLLNCTLHPGAACAFGICCKDCKFLPSGTLCRQQVGECDLPEWCNGTSHQCPDDVYVQDGISCNVNAFCYEKTCNNHDIQCKEIFGQDARSASQSCYQEINTQGNRFGHCGIVGTTYVKCWTPDIMCGRVQCENVGVIPNLIEHSTVQQFHLNDTTCWGTDYHLGMAIPDIGEVKDGTVCGPEKICIRKKCASMVHLSQACQPKTCNMRGICNNKQHCHCNHEWAPPYCKDKGYGGSADSGPPPKNNMEGLNVMGKLRYLSLLCLLPLVAFLLFCLHVLFKKRTKSKEDEEG

SEQ ID NO: 270 - protein, 722 aa, unidentified
MAVDGTLVYIRVTLLLLWLGVFLSISGYCQAGPSQHFTSPEVVIPLKVISRGRSAKAPGWLSYSLRFGGQKHVVHMRVKKLLVSRHLPVFTYTDDRALLEDQLFIPDDCYYHGYVEAAPESLVVFSACFGGFRGVLKISGLTYEIEPIRHSATFEHLVYKINSNETQFPAMRCGLTEKEVARQQLEFEEAENSALEPKSAGDWWTHAWFLELVVVVNHDFFIYSQSNISKVQEDVFLVVNIVDSMYKQLGTYIILIGIEIWNQGNVFPMTSIEQVLNDFSQWKQISLSQLQHDAAHMFIKNSLISILGLAYVAGICRPPIDCGVDNFQGDTWSLFANTVAHELGHTLGMQHDEEFCFCGERGCIMNTFRVPAEKFTNCSYADFMKTTLNQGSCLHNPPRLGEIFMLKRCGNGVVEREEQCDCGSVQQCEQDACCLLNCTLRPGAACAFGLCCKDCKFMPSGELCRQEVNECDLPEWCNGTSHQCPEDRYVQDGIPCSDSAYCYQKRCNNHDQHCREIFGKDAKSASQNCYKEINSQGNRFGHCGINGTTYLKCHISDVFCGRVQCENVRDIPLLQDHFTLQHTHINGVTCWGIDYHLRMNISDIGEVKDGTVCGPGKICIHKKCVSLSVLSHVCLPETCNMKGICNNKHHCHCGYGWSPPYCQHRGYGGSIDSGPASAKRGVFLPLIVIPSLSVLTFLFTVGLLMYLRQCSGPKETKAHSSG

SEQ ID NO: 271 - protein, 906 aa, unidentified
MQAAVAVSVPFLLLCVLGTCPPARCGQAGDASLMELEKRKENRFVERQSIVPLRLIYRSGGEDESRHDALDTRVRGDLGGPQLTHVDQASFQVDAFGTSFILDVVLNHDLLSSEYIERHIEHGGKTVEVKGGEHCYYQGHIRGNPDSFVALSTCHGLHGMFYDGNHTYLIEPEENDTTQEDFHFHSVYKSRLFEFSLDDLPSEFQQVNITPSKFILKPRPKRSKRQLRRYPRNVEEETKYIELMIVNDHLMFKKHRLSVVHTNTYAKSVVNMADLIYKDQLKTRIVLVAMETWATDNKFAISENPLITLREFMKYRRDFIKEKSDAVHLFSGSQFESSRSGAAYIGGICSLLKGGGVNEFGKTDLMAVTLAQSLAHNIGIISDKRKLASGECKCEDTWSGCIMGDTGYYLPKKFTQCNIEEYHDFLNSGGGACLFNKPSKLLDPPECGNGFIETGEECDCGTPAECVLEGAECCKKCTLTQDSQCSDGLCCKKCKFQPMGTVCREAVNDCDIRETCSGNSSQCAPNIHKMDGYSCDGVQGICFGGRCKTRDRQCKYIWGQKVTASDKYCYEKLNIEGTEKGNCGKDKDTWIQCNKRDVLCGYLLCTNIGNIPRLGELDGEITSTLVVQQGRTLNCSGGHVKLEEDVDLGYVEDGTPCGPQMMCLEHRCLPVASFNFSTCLSSKEGTICSGNGVCSNELKCVCNRHWIGSDCNTYFPHNDDAKTGITLSGNGVAGTNIIIGIIAGTILVLALILGITAWGYKNYREQRQLPQGDYVKKPGDGDSFYSDIPPGVSTNSASSSKKRSNGLSHSWSERIPDTKHISDICENGRPRSNSWQGNLGGNKKKIRGKRFRPRSNSTETLSPAKSPSSSTGSIASSRKYPYPMPPLPDEDKKVNRQSARLWETSI

SEQ ID NO: 272 - protein, 832 aa, unidentified
MKPPGSSSRQPPLAGCSLAGASCGPQRGPAGSVPASAPARTPPCRLLLVLLLLPPLAASSRPRAWGAAAPSAPHWNETAEKNLGVLADEDNTLQQNSSSNISYSNAMQKEITLPSRLIYYINQDSESPYHVLDTKARHQQKHNKAVHLAQASFQIEAFGSKFILDLILNNGLLSSDYVEIHYENGKPQYSKGGEHCYYHGSIRGVKDSKVALSTCNGLHGMFEDDTFVYMIEPLELVHDEKSTGRPHIIQKTLAGQYSKQMKNLTMERGDQWPFLSELQWLKRRKRAVNPSRGIFEEMKYLELMIVNDHKTYKKHRSSHAHTNNFAKSVVNLVDSIYKEQLNTRVVLVAVETWTEKDQIDITTNPVQMLHEFSKYRQRIKQHADAVHLISRVTFHYKRSSLSYFGGVCSRTRGVGVNEYGLPMAVAQVLSQSLAQNLGIQWEPSSRKPKCDCTESWGGCIMEETGVSHSRKFSKCSILEYRDFLQRGGGACLFNRPTKLFEPTECGNGYVEAGEECDCGFHVECYGLCCKKCSLSNGAHCSDGPCCNNTSCLFQPRGYECRDAVNECDITEYCTGDSGQCPPNLHKQDGYACNQNQGRCYNGECKTRDNQCQYIWGTKAAGSDKFCYEKLNTEGTEKGNCGKDGDRWIQCSKHDVFCGFLLCTNLTRAPRIGQLQGEIIPTSFYHQGRVIDCSGAHVVLDDDTDVGYVEDGTPCGPSMMCLDRKCLQIQALNMSSCPLDSKGKVCSGHGVCSNEATCICDFTWAGTDCSIRDPVRNLHPPKDEGPKGPSATNLIIGSIAGAILVAAIVLGGTGWGFKNVKKRRFDPTQQGPI

SEQ ID NO: 273 - protein, 775 aa, unidentified
MLQGLLPVSLLLSVAVSAIKELPGVKKYEVVYPIRLHPLHKREAKEPEQQEQFETELKYKMTINGKIAVLYLKKNKNLLAPGYTETYYNSTGKEITTSPQIMDDCYYQGHILNEKVSDASISTCRGLRGYFSQGDQRYFIEPLSPIHRDGQEHALFKYNPDEKNYDSTCGMDGVLWAHDLQQNIALPATKLVKLKDRKVQEHEKYIEYYLVLDNGEFKRYNENQDEIRKRVFEMANYVNMLYKKLNTHVALVGMEIWTDKDKIKITPNASFTLENFSKWRGSVLSRRKRHDIAQLITATELAGTTVGLAFMSTMCSPYSVGVVQDHSDNLLRVAGTMAHEMGHNFGMFHDDYSCKCPSTICVMDKALSFYIPTDFSSCSRLSYDKFFEDKLSNCLFNAPLPTDIISTPICGNQLVEMGEDCDCGTSEECTNICCDAKTCKIKATFQCALGECCEKCQFKKAGMVCRPAKDECDLPEMCNGKSGNCPDDRFQVNGFPCHHGKGHCLMGTCPTLQEQCTELWGPGTEVADKSCYNRNEGGSKYGYCRRVDDTLIPCKANDTMCGKLFCQGGSDNLPWKGRIVTFLTCKTFDPEDTSQEIGMVANGTKCGDNKVCINAECVDIEKAYKSTNCSSKCKGHAVCDHELQCQCEEGWIPPDCDDSSVVFHFSIVVGVLFPMAVIFVVVAMVIRHQSSREKQKKDQRPLSTTGTRPHKQKRKPQMVKAVQPQEMSQMKPHVYDLPVEGNEPPASFHKDTNALPPTVFKDNPVSTPKDSNPKA

SEQ ID NO: 274 - protein, 820 aa, unidentified
MKMLLLLHCLGVFLSCSGHIQDEHPQYHSPPDVVIPVRITGTTRGMTPPGWLSYILPFGGQKHIIHIKVKKLLFSKHLPVFTYTDQGAILEDQPFVQNNCYYHGYVEGDPESLVSLSTCFGGFQGILQINDFAYEIKPLAFSTTFEHLVYKMDSEEKQFSTMRSGFMQNEITCRMEFEEIDNSTQKQSSYVGWWIHFRIVEIVVVIDNYLYIRYERNDSKLLEDLYVIVNIVDSILDVIGVKVLLFGLEIWTNKNLIVVDDVRKSVHLYCKWKSENITPRMQHDTSHLFTTLGLRGLSGIGAFRGMCTPHRSCAIVTFMNKTLGTFSIAVAHHLGHNLGMNHDEDTCRCSQPRCIMHEGNPPITKFSNCSYGDFWEYTVERTKCLLETVHTKDIFNVKRCGNGVVEEGEECDCGPLKHCAKDPCCLSNCTLTDGSTCAFGLCCKDCKFLPSGKVCRKEVNECDLPEWCNGTSHKCPDDFYVEDGIPCKERGYCYEKSCHDRNEQCRRIFGAGANTASETCYKELNTLGDRVGHCGIKNATYIKCNISDVQCGRIQCENVTEIPNMSDHTTVHWARFNDIMCWSTDYHLGMKGPDIGEVKDGTECGIDHICIHRHCVHITILNSNCSPAFCNKRGICNNKHHCHCNYLWDPPNCLIKGYGGSVDSGPPPKRKKKKKFCYLCILLLIVLFILLCCLYRLCKKSKPIKKQQDVQTPSAKEEEKIQRRPHELPPQSQPWVMPSQSQPPVTPSQSHPQVMPSQSQPPVTPSQSQPRVMPSQSQPPVMPSQSHPQLTPSQSQPPVTPSQRQPQLMPSQSQPPVTPS

SEQ ID NO: 275 - protein, 790 aa, unidentified
MRSVQIFLSQCRLLLLLVPTMLLKSLGEDVIFHPEGEFDSYEVTIPEKLSFRGEVQGVVSPVSYLLQLKGKKHVLHLWPKRLLLPRHLRVFSFTEHGELLEDHPYIPKDCNYMGSVKESLDSKATISTCMGGLRGVFNIDAKHYQIEPLKASPSFEHVVYLLKKEQFGNQVCGLSDDEIEWQMAPYENKARLRDFPGSYKHPKYLELILLFDQSRYRFVNNNLSQVIHDAILLTGIMDTYFQDVRMRIHLKALEVWTDFNKIRVGYPELAEVLGRFVIYKKSVLNARLSSDWAHLYLQRKYNDALAWSFGKVCSLEYAGSVSTLLDTNILAPATWSAHELGHAVGMSHDEQYCQCRGRLNCIMGSGRTGFSNCSYISFFKHISSGATCLNNIPGLGYVLKRCGNKIVEDNEECDCGSTEECQKDRCCQSNCKLQPGANCSIGLCCHDCRFRPSGYVCRQEGNECDLAEYCDGNSSSCPNDVYKQDGTPCKYEGRCFRKGCRSRYMQCQSIFGPDAMEAPSECYDAVNLIGDQFGNCEITGIRNFKKCESANSICGRLQCINVETIPDLPEHTTIISTHLQAENLMCWGTGYHLSMKPMGIPDLGMINDGTSCGEGRVCFKKNCVNSSVLQFDCLPEKCNTRGVCNNRKNCHCMYGWAPPFCEEVGYGGSIDSGPPGLLRGAIPSSIWVVSIIMFRLILLILSVVFVFFRQVIGNHLKPKQEKMPLSKAKTEQEESKTKTVQEESKTKTGQEESEAKTGQEESKAKTGQEESKANIESKRPKAKSVKKQKK

SEQ ID NO: 276 - protein, 787 aa, unidentified
MFRLWLLLAGLCGLLASRPGFQNSLLQIVIPEKIQTNTNDSSEIEYEQISYIIPIDEKLYTVHLKQRYFLADNFMIYLYNQGSMNTYSSDIQTQCYYQGNIEGYPDSMVTLSTCSGLRGILQFENVSYGIEPLESAVEFQHVLYKLKNEDNDIAIFIDRSLKEQPMDDNIFISEKSEPAVPDLFPLYLEMHIVVDKTLYDYWGSDSMIVTNKVIEIVGLANSMFTQFKVTIVLSSLELWSDENKISTVGEADELLQKFLEWKQSYLNLRPHDIAYLLIYMDYPRYLGAVFPGTMCITRYSAGVALYPKEITLEAFAVIVTQMLALSLGISYDDPKKCQCSESTCIMNPEVVQSNGVKTFSSCSLRSFQNFISNVGVKCLQNKPQMQKKSPKPVCGNGRLEGNEICDCGTEAQCGPASCCDFRTCVLKDGAKCYKGLCCKDCQILQSGVECRPKAHPECDIAENCNGTSPECGPDITLINGLSCKNNKFICYDGDCHDLDARCESVFGKGSRNAPFACYEEIQSQSDRFGNCGRDRNNKYVFCGWRNLICGRLVCTYPTRKPFHQENGDVIYAFVRDSVCITVDYKLPRTVPDPLAVKNGSQCDIGRVCVNRECVESRIIKASAHVCSQQCSGHGVCDSRNKCHCSPGYKPPNCQIRSKGFSIFPEEDMGSIMERASGKTENTWLLGFLIALPILIVTTAIVLARKQLKKWFAKEEEFPSSESKSEGSTQTYASQSSSEGSTQTYASQTRSESSSQADTSKSKSEDSAEAYTSRSKSQDSTQTQSSSN

SEQ ID NO: 277 - protein, 813 aa, unidentified
MGWRPRRARGTPLLLLLLLLLLWPVPGAGVLQGHIPGQPVTPHWVLDGQPWRTVSLEEPVSKPDMGLVALEAEGQELLLELEKNHRLLAPGYIETHYGPDGQPVVLAPNHTDHCHYQGRVRGFPDSWVVLCTCSGMSGLITLSRNASYYLRPWPPRGSKDFSTHEIFRMEQLLTWKGTCGHRDPGNKAGMTSLPGGPQSRGRREARRTRKYLELYIVADHTLFLTRHRNLNHTKQRLLEVANYVDQLLRTLDIQVALTGLEVWTERDRSRVTQDANATLWAFLQWRRGLWAQRPHDSAQLLTGRAFQGATVGLAPVEGMCRAESSGGVSTDHSELPIGAAATMAHEIGHSLGLSHDPDGCCVEAAAESGGCVMAAATGHPFPRVFSACSRRQLRAFFRKGGGACLSNAPDPGLPVPPALCGNGFVEAGEECDCGPGQECRDLCCFAHNCSLRPGAQCAHGDCCVRCLLKPAGALCRQAMGDCDLPEFCTGTSSHCPPDVYLLDGSPCARGSGYCWDGACPTLEQQCQQLWGPGSHPAPEACFQVVNSAGDAHGNCGQDSEGHFLPCAGRDALCGKLQCQGGKPSLLAPHMVPVDSTVHLDGQEVTCRGALALPSAQLDLLGLGLVEPGTQCGPRMVCQSRRCRKNAFQELQRCLTACHSHGVCNSNHNCHCAPGWAPPFCDKPGFGGSMDSGPVQAENHDTFLLAMLLSVLLPLLPGAGLAWCCYRLPGAHLQRCSWGCRRDPACSGPKDGPHRDHPLGGVHPMELGPTATGQPWPLDPENSHEPSSHPEKPLPAVSPDPQADQVQMPRSCLW

SEQ ID NO: 278 - protein, 754 aa, unidentified
MLPGCIFLMILLIPQVKEKFILGVEGQQLVRPKKLPLIQKRDTGHTHDDDILKTYEEELLYEIKLNRKTLVLHLLRSREFLGSNYSETFYSMKGEAFTRHPQIMDHCFYQGSIVHEYDSAASISTCNGLRGFFRINDQRYLIEPVKYSDEGEHLVFKYNLRVPYGANYSCTELNFTRKTVPGDNESEEDSKIKGIHDEKYVELFIVADDTVYRRNGHPHNKLRNRIWGMVNFVNMIYKTLNIHVTLVGIEIWTHEDKIELYSNIETTLLRFSFWQEKILKTRKDFDHVVLLSGKWLYSHVQGISYPGGMCLPYYSTSIIKDLLPDTNIIANRMAHQLGHNLGMQHDEFPCTCPSGKCVMDSDGSIPALKFSKCSQNQYHQYLKDYKPTCMLNIPFPYNFHDFQFCGNKKLDEGEECDCGPAQECTNPCCDAHTCVLKPGFTCAEGECCESCQIKKAGSICRPAKDECDFPEMCTGHSPACPKDQFRVNGFPCKNSEGYCFMGKCPTREDQCSELFDDEAIESHDICYKMNTKGNKFGYCKNKENRFLPCEEKDVRCGKIYCTGGELSSLLGEDKTYHLKDPQKNATVKCKTIFLYHDSTDIGLVASGTKCGEGMVCNNGECLNMEKVYISTNCPSQCNENPVDGHGLQCHCEEGQAPVACEETLHVTNITILVVVLVLVIVGIGVLILLVRYRKCIKLKQVQSPPTETLGVENKGYFGDEQQIRTEPILPEIHFLNKPASKDSRGIADPNQSAK

SEQ ID NO: 279 - protein, 824 aa, unidentified
MRGLGLWLLGAMMLPAIAPSRPWALMEQYEVVLPWRLPGPRVRRALPSHLGLHPERVSYVLGATGHNFTLHLRKNRDLLGSGYTETYTAANGSEVTEQPRGQDHCFYQGHVEGYPDSAASLSTCAGLRGFFQVGSDLHLIEPLDEGGEGGRHAVYQAEHLLQTAGTCGVSDDSLGSLLGPRTAAVFRPRPGDSLPSRETRYVELYVVVDNAEFQMLGSEAAVRHRVLEVVNHVDKLYQKLNFRVVLVGLEIWNSQDRFHVSPDPSVTLENLLTWQARQRTRRHLHDNVQLITGVDFTGTTVGFARVSAMCSHSSGAVNQDHSKNPVGVACTMAHEMGHNLGMDHDENVQGCRCQERFEAGRCIMAGSIGSSFPRMFSDCSQAYLESFLERPQSVCLANAPDLSHLVGGPVCGNLFVERGEQCDCGPPEDCRNRCCNSTTCQLAEGAQCAHGTCCQECKVKPAGELCRPKKDMCDLEEFCDGRHPECPEDAFQENGTPCSGGYCYNGACPTLAQQCQAFWGPGGQAAEESCFSYDILPGCKASRYRADMCGVLQCKGGQQPLGRAICIVDVCHALTTEDGTAYEPVPEGTRCGPEKVCWKGRCQDLHVYRSSNCSAQCHNHGVCNHKQECHCHAGWAPPHCAKLLTEVHAASGSLPVFVVVVLVLLAVVLVTLAGIIVYRKARSRILSRNVAPKTTMGRSNPLFHQAASRVPAKGGAPAPSRGPQELVPTTHPGQPARHPASSVALKRPPPAPPVTVSSPPFPVPVYTRQAPKQVIKPTFAPPVPPVKPGAGAANPGPAEGAVGPKVALKPPIQRKQGAGAPTAP

SEQ ID NO: 280 - protein, 819 aa, unidentified
MGSGARFPSGTLRVRWLLLLGLVGPVLGAARPGFQQTSHLSSYEIITPWRLTRERREAPRPYSKQVSYVIQAEGKEHIIHLERNKDLLPEDFVVYTYNKEGTLITDHPNIQNHCHYRGYVEGVHNSSIALSDCFGLRGLLHLENASYGIEPLQNSSHFEHIIYRMDDVYKEPLKCGVSNKDIEKETAKDEEEEPPSMTQLLRRRRAVLPQTRYVELFIVVDKERYDMMGRNQTAVREEMILLANYLDSMYIMLNIRIVLVGLEIWTNGNLINIVGGAGDVLGNFVQWREKFLITRRRHDSAQLVLKKGFGGTAGMAFVGTVCSRSHAGGINVFGQITVETFASIVAHELGHNLGMNHDDGRDCSCGAKSCIMNSGASGSRNFSSCSAEDFEKLTLNKGGNCLLNIPKPDEAYSAPSCGNKLVDAGEECDCGTPKECELDPCCEGSTCKLKSFAECAYGDCCKDCRFLPGGTLCRGKTSECDVPEYCNGSSQFCQPDVFIQNGYPCQNNKAYCYNGMCQYYDAQCQVIFGSKAKAAPKDCFIEVNSKGDRFGNCGFSGNEYKKCATGNALCGKLQCENVQEIPVFGIVPAIIQTPSRGTKCWGVDFQLGSDVPDPGMVNEGTKCGAGKICRNFQCVDASVLNYDCDVQKKCHGHGVCNSNKNCHCENGWAPPNCETKGYGGSVDSGPTYNEMNTALRDGLLVFFFLIVPLIVCAIFIFIKRDQLWRSYFRKKRSQTYESDGKNQANPSRQPGSVPRHVSPVTPPREVPIYANRFAVPTYAAKQPQQFPSRPPPPQPKVSSQGNLIPARPAPAPPLYSSLT

SEQ ID NO: 281 - protein, 967 aa, unidentified
MQRAVPEGFGRRKLGSDMGNAERAPGSRSFGPVPTLLLLAAALLAVSDALGRPSEEDEELVVPELERAPGHGTTRLRLHAFDQQLDLELRPDSSFLAPGFTLQNVGRKSGSETPLPETDLAHCFYSGTVNGDPSSAAALSLCEGVRGAFYLLGEAYFIQPLPAASERLATAAPGEKPPAPLQFHLLRRNRQGDVGGTCGVVDDEPRPTGKAETEDEDEGTEGEDEGAQWSPQDPALQGVGQPTGTGSIRKKRFVSSHRYVETMLVADQSMAEFHGSGLKHYLLTLFSVAARLYKHPSIRNSVSLVVVKILVIHDEQKGPEVTSNAALTLRNFCNWQKQHNPPSDRDAEHYDTAILFTRQDLCGSQTCDTLGMADVGTVCDPSRSCSVIEDDGLQAAFTTAHELGHVFNMPHDDAKQCASLNGVNQDSHMMASMLSNLDHSQPWSPCSAYMITSFLDNGHGECLMDKPQNPIQLPGDLPGTSYDANRQCQFTFGEDSKHCPDAASTCSTLWCTGTSGGVLVCQTKHFPWADGTSCGEGKWCINGKCVNKTDRKHFDTPFHGSWGMWGPWGDCSRTCGGGVQYTMRECDNPVPKNGGKYCEGKRVRYRSCNLEDCPDNNGKTFREEQCEAHNEFSKASFGSGPAVEWIPKYAGVSPKDRCKLICQAKGIGYFFVLQPKVVDGTPCSPDSTSVCVQGQCVKAGCDRIIDSKKKFDKCGVCGGNGSTCKKISGSVTSAKPGYHDIITIPTGATNIEVKQRNQRGSRNNGSFLAIKAADGTYILNGDYTLSTLEQDIMYKGVVLRYSGSSAALERIRSFSPLKEPLTIQVLTVGNALRPKIKYTYFVKKKKESFNAIPTFSAWVIEEWGECSKSCELGWQRRLVECRDINGQPASECAKEVKPASTRPCADHPCPQWQLGEWSSCSKTCGKGYKKRSLKCLSHDGGVLSHESCDPLKKPKHFIDFCTMAECS

SEQ ID NO: 282 - protein, 837 aa, unidentified
MSQTGSHPGRGLAGRWLWGAQPCLLLPIVPLSWLVWLLLLLLASLLPSARLASPLPREEEIVFPEKLNGSVLPGSGAPARLLCRLQAFGETLLLELEQDSGVQVEGLTVQYLGQAPELLGGAEPGTYLTGTINGDPESVASLHWDGGALLGVLQYRGAELHLQPLEGGTPNSAGGPGAHILRRKSPASGQGPMCNVKAPLGSPSPRPRRAKRFASLSRFVETLVVADDKMAAFHGAGLKRYLLTVMAAAAKAFKHPSIRNPVSLVVTRLVILGSGEEGPQVGPSAAQTLRSFCAWQRGLNTPEDSDPDHFDTAILFTRQDLCGVSTCDTLGMADVGTVCDPARSCAIVEDDGLQSAFTAAHELGHVFNMLHDNSKPCISLNGPLSTSRHVMAPVMAHVDPEEPWSPCSARFITDFLDNGYGHCLLDKPEAPLHLPVTFPGKDYDADRQCQLTFGPDSRHCPQLPPPCAALWCSGHLNGHAMCQTKHSPWADGTPCGPAQACMGGRCLHMDQLQDFNIPQAGGWGPWGPWGDCSRTCGGGVQFSSRDCTRPVPRNGGKYCEGRRTRFRSCNTEDCPTGSALTFREEQCAAYNHRTDLFKSFPGPMDWVPRYTGVAPQDQCKLTCQAQALGYYYVLEPRVVDGTPCSPDSSSVCVQGRCIHAGCDRIIGSKKKFDKCMVCGGDGSGCSKQSGSFRKFRYGYNNVVTIPAGATHILVRQQGNPGHRSIYLALKLPDGSYALNGEYTLMPSPTDVVLPGAVSLRYSGATAASETLSGHGPLAQPLTLQVLVAGNPQDTRLRYSFFVPRPTPSTPRPTPQDWLHRRAQILEILRRRPWAGRK

SEQ ID NO: 283 - protein, 626 aa, unidentified
MVAPWRVSVRVCLSHLRCFELRQGLSLLRPSECPRDARLCWLLLGTLPKVVSLCGDVGEGAPDVLSRRRVRCSGAAGAGPAESLPRAGPLGGVFLHLRLWLRAGALLVKFFPLLLLYPLTYLAPSVSTLWLHLLLKATETSGPTYIKLGQWASTRRDLFSEAFCAQFSKLHVRVTPHPWTHTERFLRQAFGDDWGSILSFENREPVGSGCVAQVYKAYANTAFLETDSVQRLGRASCLPPFSHTGAVGGLRELFGYLGNGRKPPENLADQSFLERLLLPKADLVGSNAGVSRAQVPGHQPEATNLISVAVKVLHPGLLAQVHMDLLLMKIGSRVLGVLPGIKWLSLPEIVEEFEKLMVQQIDLRYEAQNLEHFQVNFRNVKAVKFPTPLRPFVTREVLVETYEESVPVSSYQQAGIPVDLKRKIARLGINMLLKMIFVDNFVHADLHPGNILVQGANGLSSSQEAQLQQADICDTLVVAVPSSLCPLRLVLLDAGIVAELQAPDLRNFRAVFMAVVMGQGQRVAELILHHARASECRDVEGFKTEMAMLVTQARKNTITLEKLHVSSLLSSVFKLLMTHKVKLESNFASIVFAIMVLEGLGRSLDPKLDILEAARPFLLTGPVCPP

SEQ ID NO: 284 - protein, 580 aa, unidentified
MWRPVQLCHFHSALLHSRQKPWPSPAVFFRRNVRGLPPRFSSPTPLWRKVLSTAVVGAPLLLGARYVMAEAREKRRMRLVVDGMGRFGRSLKVGLQISLDYWWCTNVVLRGVEENSPGYLEVMSACHQRAADALVAGAISNGGLYVKLGQGLCSFNHLLPPEYTRTLRVLEDRALKRGFQEVDELFLEDFQALPHELFQEFDYQPIAAASLAQVHRAKLHDGTSVAVKVQYIDLRDRFDGDIHTLELLLRLVEVMHPSFGFSWVLQDLKGTLAQELDFENEGRNAERCARELAHFPYVVVPRVHWDKSSKRVLTADFCAGCKVNDVEAIRSQGLAVHDIAEKLIKAFAEQIFYTGFIHSDPHPGNVLVRKGPDGKAELVLLDHGLYQFLEEKDRAALCQLWRAIILRDDAAMRAHAAALGVQDYLLFAEMLMQRPVRLGQLWGSHLLSREEAAYMVDMARERFEAVMAVLRELPRPMLLVLRNINTVRAINVALGAPVDRYFLMAKRAVRGWSRLAGATYRGVYGTSLLRHAKVVWEMLKFEVALRLETLAMRLTALLARALVHLSLVPPAEELYQYLET

SEQ ID NO: 285 - protein, 338 aa, unidentified
MYGVFVRILTERSQRKAFLQARSCIEDRLRLEDENEKQERLLMSLLPRNVAMEMKEDFLKPPERIFHKIYIQRHDNVSILFADIVGFTGLASQCTAQELVKLLNELFGKFDELATENHCRRIKILGDCYYCVSGLTQPKTDHAHCCVEMGLDMIDTITSVAEATEVDLNMRVGLHTGRVLCGVLGLRKWQYDVWSNDVTLANVMEAAGLPGKVHITKTTLACLNGDYEVEPGYGHERNSFLKTHNIETFFIVPSHRRKIFPGLILSDIKPAKRMKFKTVCYLLVQLMHCRKMFKAEIPFSNVMTCEDDDKVQIHPSLSGLDVLLGFWSPTLQRGRLCT

SEQ ID NO: 286 - protein, 1610 aa, unidentified
MNTPKEEFQDWPIVRIAAHLPDLIVYGHFSPERPFMDYFDGVLMFVDISGFTAMTEKFSSAMYMDRGAEQLVEILNYHISAIVEKVLIFGGDILKFAGDALLALWRVERKQLKNIITVVIKCSLEIHGLFETQEWEEGLDIRVKIGLAAGHISMLVFGDETHSHFLVIGQAVDDVRLAQNMAQMNDVILSPNCWQLCDRSMIEIESVPDQRAVKVNFLKPPPNFNFDEFFTKCTTFMHYYPSGEHKNLLRLACTLKPDPELEMSLQKYVMESILKQIDNKQLQGYLSELRPVTIVFVNLMFEDQDKAEEIGPAIQDAYMHITSVLKIFQGQINKVFMFDKGCSFLCVFGFPGEKVPDELTHALECAMDIFDFCSQVHKIQTVSIGVASGIVFCGIVGHTVRHEYTVIGQKVNLAARMMMYYPGIVTCDSVTYNGSNLPAYFFKELPKKVMKGVADSGPLYQYWGRTEKVMFGMACLICNRKEDYPLLGRNKEINYFMYTMKKFLISNSSQVLMYEGLPGYGKSQILMKIEYLAQGKNHRIIAISLNKISFHQTFYTIQMFMANVLGLDTCKHYKERQTNLRNKVMTLLDEKFYCLLNDIFHVQFPISREISRMSTLKKQKQLEILFMKILKLIVKEERIIFIIDEAQFVDSTSWRFMEKLIRTLPIFIIMSLCPFVNIPCAAARAVIKNRNTTYIVIGAVQPNDISNKICLDLNVSCISKELDSYLGEGSCGIPFYCEELLKNLEHHEVLVFQQTESEEKTNRTWNNLFKYSIKLTEKLNMVTLHSDKESEEVCHLTSGVRLKNLSPPTSLKEISLIQLDSMRLSHQMLVRCAAIIGLTFTTELLFEILPCWNMKMMIKTLATLVESNIFYCFRNGKELQKALKQNDPSFEVHYRSLSLKPSEGMDHGEEEQLRELENEVIECHRIRFCNPMMQKTAYELWLKDQRKAMHLKCARFLEEDAHRCDHCRGRDFIPYHHFTVNIRLNALDMDAIKKMAMSHGFKTEEKLILSNSEIPETSAFFPENRSPEEIREKILNFFDHVLTKMKTSDEDIIPLESCQCEEILEIVILPLAHHFLALGENDKALYYFLEIASAYLIFCDNYMAYMYLNEGQKLLKTLKKDKSWSQTFESATFYSLKGEVCFNMGQIVLAKKMLRKALKLLNRIFPYNLISLFLHIHVEKNRHFHYVNRQAQESPPPGKKRLAQLYRQTVCLSLLWRIYSYSYLFHCKYYAHLAVMMQMNTALETQNCFQIIKAYLDYSLYHHLAGYKGVWFKYEVMAMEHIFNLPLKGEGIEIVAYVAETLVFNKLIMGHLDLAIELGSRALQMWALLQNPNRHYQSLCRLSRCLLLNSRYPQLIQVLGRLWELSVTQEHIFSKAFFYFVCLDILLYSGFVYRTFEECLEFIHQYENNRILKFHSGLLLGLYSSVAIWYARLQEWDNFYKFSNRAKNLLPRRTMTLTYYDGISRYMEGQVLHLQKQIKEQSENAQASGEELLKNLENLVAQNTTGPVFCPRLYHLMAYVCILMGDGQKCGLFLNTALRLSETQGNILEKCWLNMNKESWYSTSELKEDQWLQTILSLPSWEKIVAGRVNIQDLQKNKFLMRANTVDNHF

SEQ ID NO: 287 - protein, 1091 aa, unidentified
MWQEAMRRRRYLRDRSEEAAGGGDGLPRSRDWLYESYYCMSQQHPLIVFLLLIVMGSCLALLAVFFALGLEVEDHVAFLITVPTALAIFFAIFILVCIESVFKKLLRLFSLVIWICLVAMGYLFMCFGGTVSPWDQVSFFLFIIFVVYTMLPFNMRDAIIASVLTSSSHTIVLSVCLSATPGGKEHLVWQILANVIIFICGNLAGAYHKHLMELALQQTYQDTCNCIKSRIKLEFEKRQQERLLLSLLPAHIAMEMKAEIIQRLQGPKAGQMENTNNFHNLYVKRHTNVSILYADIVGFTRLASDCSPGELVHMLNELFGKFDQIAKENECMRIKILGDCYYCVSGLPISLPNHAKNCVKMGLDMCEAIKKVRDATGVDINMRVGVHSGNVLCGVIGLQKWQYDVWSHDVTLANHMEAGGVPGRVHISSVTLEHLNGAYKVEEGDGDIRDPYLKQHLVKTYFVINPKGERRSPQHLFRPRHTLDGAKMRASVRMTRYLESWGAAKPFAHLHHRDSMTTENGKISTTDVPMGQHNFQNRTLRTKSQKKRFEEELNERMIQAIDGINAQKQWLKSEDIQRISLLFYNKVLEKEYRATALPAFKYYVTCACLIFFCIFIVQILVLPKTSVLGISFGAAFLLLAFILFVCFAGQLLQCSKKASPLLMWLLKSSGIIANRPWPRISLTIITTAIILMMAVFNMFFLSDSEETIPPTANTTNTSFSASNNQVAILRAQNLFFLPYFIYSCILGLISCSVFLRVNYELKMLIMMVALVGYNTILLHTHAHVLGDYSQVLFERPGIWKDLKTMGSVSLSIFFITLLVLGRQNEYYCRLDFLWKNKFKKEREEIETMENLNRVLLENVLPAHVAEHFLARSLKNEELYHQSYDCVCVMFASIPDFKEFYTESDVNKEGLECLRLLNEIIADFDDLLSKPKFSGVEKIKTIGSTYMAATGLSAVPSQEHSQEPERQYMHIGTMVEFAFALVGKLDAINKHSFNDFKLRVGINHGPVIAGVIGAQKPQYDIWGNTVNVASRMDSTGVLDKIQVTEETSLVLQTLGYTCTCRGIINVKGKGDLKTYFVNTEMSRSLSQSNVAS

SEQ ID NO: 288 - protein, 1144 aa, unidentified
MPRNQGFSEPEYSAEYSAEYSVSLPSDPDRGVGRTHEISVRNSGSCLCLPRFMRLTFVPESLENLYQTYFKRQRHETLLVLVVFAALFDCYVVVMCAVVFSSDKLASLAVAGIGLVLDIILFVLCKKGLLPDRVTRRVLPYVLWLLITAQIFSYLGLNFARAHAASDTVGWQVFFVFSFFITLPLSLSPIVIISVVSCVVHTLVLGVTVAQQQQEELKGMQLLREILANVFLYLCAIAVGIMSYYMADRKHRKAFLEARQSLEVKMNLEEQSQQQENLMLSILPKHVADEMLKDMKKDESQKDQQQFNTMYMYRHENVSILFADIVGFTQLSSACSAQELVKLLNELFARFDKLAAKYHQLRIKILGDCYYCICGLPDYREDHAVCSILMGLAMVEAISYVREKTKTGVDMRVGVHTGTVLGGVLGQKRWQYDVWSTDVTVANKMEAGGIPGRVHISQSTMDCLKGEFDVEPGDGGSRCDYLEEKGIETYLIIASKPEVKKTATQNGLNGSALPNGAPASSKSSSPALIETKEPNGSAHSSGSTSEKPEEQDAQADNPSFPNPRRRLRLQDLADRVVDASEDEHELNQLLNEALLERESAQVVKKRNTFLLSMRFMDPEMETRYSVEKEKQSGAAFSCSCVVLLCTALVEILIDPWLMTNYVTFMVGEILLLILTICSLAAIFPRAFPKKLVAFSTWIDRTRWARNTWAMLAIFILVMANVVDMLSCLQYYTGPSNATAGMETEGSCLENPKYYNYVAVLSLIATIMLVQVSHMVKLTLMLLVAGAVATINLYAWRPVFDEYDHKRFREHDLPMVALEQMQGFNPGLNGTDRLPLVPSKYSMTVMVFLMMLSFYYFSRHVEKLARTLFLWKIEVHDQKERVYEMRRWNEALVTNMLPEHVARHFLGSKKRDEELYSQTYDEIGVMFASLPNFADFYTEESINNGGIECLRFLNEIISDFDSLLDNPKFRVITKIKTIGSTYMAASGVTPDVNTNGFASSNKEDKSERERWQHLADLADFALAMKDTLTNINNQSFNNFMLRIGMNKGGVLAGVIGARKPHYDIWGNTVNVASRMESTGVMGNIQVVEETQVILREYGFRFVRRGPIFVKGKGELLTFFLKGRDKLATFPNGPSVTLPHQVVDNS

SEQ ID NO: 289 - protein, 1077 aa, unidentified
MARLFSPRPPPSEDLFYETYYSLSQQYPLLLLLLGIVLCALAALLAVAWASGRELTSDPSFLTTVLCALGGFSLLLGLASREQRLQRWTRPLSGLVWVALLALGHAFLFTGGVVSAWDQVSYFLFVIFTAYAMLPLGMRDAAVAGLASSLSHLLVLGLYLGPQPDSRPALLPQLAANAVLFLCGNVAGVYHKALMERALRATFREALSSLHSRRRLDTEKKHQEHLLLSILPAYLAREMKAEIMARLQAGQGSRPESTNNFHSLYVKRHQGVSVLYADIVGFTRLASECSPKELVLMLNELFGKFDQIAKEHECMRIKILGDCYYCVSGLPLSLPDHAINCVRMGLDMCRAIRKLRAATGVDINMRVGVHSGSVLCGVIGLQKWQYDVWSHDVTLANHMEAGGVPGRVHITGATLALLAGAYAVEDAGMEHRDPYLRELGEPTYLVIDPRAEEEDEKGTAGGLLSSLEGLKMRPSLLMTRYLESWGAAKPFAHLSHGDSPVSTSTPLPEKTLASFSTQWSLDRSRTPRGLDDELDTGDAKFFQVIEQLNSQKQWKQSKDFNPLTLYFREKEMEKEYRLSAIPAFKYYEACTFLVFLSNFIIQMLVTNRPPALAITYSITFLLFLLILFVCFSEDLMRCVLKGPKMLHWLPALSGLVATRPGLRIALGTATILLVFAMAITSLFFFPTSSDCPFQAPNVSSMISNLSWELPGSLPLISVPYSMHCCTLGFLSCSLFLHMSFELKLLLLLLWLAASCSLFLHSHAWLSECLIVRLYLGPLDSRPGVLKEPKLMGAISFFIFFFTLLVLARQNEYYCRLDFLWKKKLRQEREETETMENLTRLLLENVLPAHVAPQFIGQNRRNEDLYHQSYECVCVLFASVPDFKEFYSESNINHEGLECLRLLNEIIADFDELLSKPKFSGVEKIKTIGSTYMAATGLNATSGQDAQQDAERSCSHLGTMVEFAVALGSKLDVINKHSFNNFRLRVGLNHGPVVAGVIGAQKPQYDIWGNTVNVASRMESTGVLGKIQVTEETAWALQSLGYTCYSRGVIKVKGKGQLCTYFLNTDLTRTGPPSATLG

SEQ ID NO: 290 - protein, 1261 aa, unidentified
MSGSKSVSPPGYAAQKTAAPAPRGGPEHRSAWGEADSRANGYPHAPGGSARGSTKKPGGAVTPQQQQRLASRWRSDDDDDPPLSGDDPLAGGFGFSFRSKSAWQERGGDDCGRGSRRQRRGAASGGSTRAPPAGGGGGSAAAAASAGGTEVRPRSVEVGLEERRGKGRAADELEAGAVEGGEGSGDGGSSADSGSGAGPGAVLSLGACCLALLQIFRSKKFPSDKLERLYQRYFFRLNQSSLTMLMAVLVLVCLVMLAFHAARPPLQLPYLAVLAAAVGVILIMAVLCNRAAFHQDHMGLACYALIAVVLAVQVVGLLLPQPRSASEGIWWTVFFIYTIYTLLPVRMRAAVLSGVLLSALHLAIALRTNAQDQFLLKQLVSNVLIFSCTNIVGVCTHYPAEVSQRQAFQETRECIQARLHSQRENQQQERLLLSVLPRHVAMEMKADINAKQEDMMFHKIYIQKHDNVSILFADIEGFTSLASQCTAQELVMTLNELFARFDKLAAENHCLRIKILGDCYYCVSGLPEARADHAHCCVEMGMDMIEAISLVREVTGVNVNMRVGIHSGRVHCGVLGLRKWQFDVWSNDVTLANHMEAGGKAGRIHITKATLNYLNGDYEVEPGCGGERNAYLKEHSIETFLILRCTQKRKEEKAMIAKMNRQRTNSIGHNPPHWGAERPFYNHLGGNQVSKEMKRMGFEDPKDKNAQESANPEDEVDEFLGRAIDARSIDRLRSEHVRKFLLTFREPDLEKKYSKQVDDRFGAYVACASLVFLFICFVQITIVPHSIFMLSFYLTCSLLLTLVVFVSVIYSCVKLFPSPLQTLSRKIVRSKMNSTLVGVFTITLVFLAAFVNMFTCNSRDLLGCLAQEHNISASQVNACHVAESAVNYSLGDEQGFCGSPWPNCNFPEYFTYSVLLSLLACSVFLQISCIGKLVLMLAIELIYVLIVEVPGVTLFDNADLLVTANAIDFFNNGTSQCPEHATKVALKVVTPIIISVFVLALYLHAQQVESTARLDFLWKLQATEEKEEMEELQAYNRRLLHNILPKDVAAHFLARERRNDELYYQSCECVAVMFASIANFSEFYVELEANNEGVECLRLLNEIIADFDEIISEDRFRQLEKIKTIGSTYMAASGLNDSTYDKVGKTHIKALADFAMKLMDQMKYINEHSFNNFQMKIGLNIGPVVAGVIGARKPQYDIWGNTVNVASRMDSTGVPDRIQVTTDMYQVLAANTYQLECRGVVKVKGKGEMMTYFLNGGPPLS

SEQ ID NO: 291 - protein, 1168 aa, unidentified
MSWFSGLLVPKVDERKTAWGERNGQKRSRRRGTRAGGFCTPRYMSCLRDAEPPSPTPAGPPRCPWQDDAFIRRGGPGKGKELGLRAVALGFEDTEVTTTAGGTAEVAPDAVPRSGRSCWRRLVQVFQSKQFRSAKLERLYQRYFFQMNQSSLTLLMAVLVLLTAVLLAFHAAPARPQPAYVALLACAAALFVGLMVVCNRHSFRQDSMWVVSYVVLGILAAVQVGGALAADPRSPSAGLWCPVFFVYIAYTLLPIRMRAAVLSGLGLSTLHLILAWQLNRGDAFLWKQLGANVLLFLCTNVIGICTHYPAEVSQRQAFQETRGYIQARLHLQHENRQQERLLLSVLPQHVAMEMKEDINTKKEDMMFHKIYIQKHDNVSILFADIEGFTSLASQCTAQELVMTLNELFARFDKLAAENHCLRIKILGDCYYCVSGLPEARADHAHCCVEMGVDMIEAISLVREVTGVNVNMRVGIHSGRVHCGVLGLRKWQFDVWSNDVTLANHMEAGGRAGRIHITRATLQYLNGDYEVEPGRGGERNAYLKEQHIETFLILGASQKRKEEKAMLAKLQRTRANSMEGLMPRWVPDRAFSRTKDSKAFRQMGIDDSSKDNRGTQDALNPEDEVDEFLSRAIDARSIDQLRKDHVRRFLLTFQREDLEKKYSRKVDPRFGAYVACALLVFCFICFIQLLIFPHSTLMLGIYASIFLLLLITVLICAVYSCGSLFPKALQRLSRSIVRSRAHSTAVGIFSVLLVFTSAIANMFTCNHTPIRSCAARMLNLTPADITACHLQQLNYSLGLDAPLCEGTMPTCSFPEYFIGNMLLSLLASSVFLHISSIGKLAMIFVLGLIYLVLLLLGPPATIFDNYDLLLGVHGLASSNETFDGLDCPAAGRVALKYMTPVILLVFALALYLHAQQVESTARLDFLWKLQATGEKEEMEELQAYNRRLLHNILPKDVAAHFLARERRNDELYYQSCECVAVMFASIANFSEFYVELEANNEGVECLRLLNEIIADFDEIISEERFRQLEKIKTIGSTYMAASGLNASTYDQVGRSHITALADYAMRLMEQMKHINEHSFNNFQMKIGLNMGPVVAGVIGARKPQYDIWGNTVNVSSRMDSTGVPDRIQVTTDLYQVLAAKGYQLECRGVVKVKGKGEMTTYFLNGGPSS

SEQ ID NO: 292 - protein, 1080 aa, unidentified
MPAKGRYFLNEGEEGPDQDALYEKYQLTSQHGPLLLTLLLVAATACVALIIIAFSQGDPSRHQAILGMAFLVLAVFAALSVLMYVECLLRRWLRALALLTWACLVALGYVLVFDAWTKAACAWEQVPFFLFIVFVVYTLLPFSMRGAVAVGAVSTASHLLVLGSLMGGFTTPSVRVGLQLLANAVIFLCGNLTGAFHKHQMQDASRDLFTYTVKCIQIRRKLRIEKRQQENLLLSVLPAHISMGMKLAIIERLKEHGDRRCMPDNNFHSLYVKRHQNVSILYADIVGFTQLASDCSPKELVVVLNELFGKFDQIAKANECMRIKILGDCYYCVSGLPVSLPTHARNCVKMGLDMCQAIKQVREATGVDINMRVGIHSGNVLCGVIGLRKWQYDVWSHDVSLANRMEAAGVPGRVHITEATLKHLDKAYEVEDGHGQQRDPYLKEMNIRTYLVIDPRSQQPPPPSQHLPRPKGDAALKMRASVRMTRYLESWGAARPFAHLNHRESVSSGETHVPNGRRPKSVPQRHRRTPDRSMSPKGRSEDDSYDDEMLSAIEGLSSTRPCCSKSDDFYTFGSIFLEKGFEREYRLAPIPRARHDFACASLIFVCILLVHVLLMPRTAALGVSFGLVACVLGLVLGLCFATKFSRCCPARGTLCTISERVETQPLLRLTLAVLTIGSLLTVAIINLPLMPFQVPELPVGNETGLLAASSKTRALCEPLPYYTCSCVLGFIACSVFLRMSLEPKVVLLTVALVAYLVLFNLSPCWQWDCCGQGLGNLTKPNGTTSGTPSCSWKDLKTMTNFYLVLFYITLLTLSRQIDYYCRLDCLWKKKFKKEHEEFETMENVNRLLLENVLPAHVAAHFIGDKLNEDWYHQSYDCVCVMFASVPDFKVFYTECDVNKEGLECLRLLNEIIADFDELLLKPKFSGVEKIKTIGSTYMAAAGLSVASGHENQELERQHAHIGVMVEFSIALMSKLDGINRHSFNSFRLRVGINHGPVIAGVIGARKPQYDIWGNTVNVASRMESTGELGKIQVTEETCTILQGLGYSCECRGLINVKGKGELRTYFVCTDTAKFQGLGLN

SEQ ID NO: 293 - protein, 1251 aa, unidentified
MELSDVRCLTGSEELYTIHPTPPAGDGRSASRPQRLLWQTAVRHITEQRFIHGHRGGSGSGSGGSGKASDPAGGGPNHHAPQLSGDSALPLYSLGPGERAHSTCGTKVFPERSGSGSASGSGGGGDLGFLHLDCAPSNSDFFLNGGYSYRGVIFPTLRNSFKSRDLERLYQRYFLGQRRKSEVVMNVLDVLTKLTLLVLHLSLASAPMDPLKGILLGFFTGIEVVICALVVVRKDTTSHTYLQYSGVVTWVAMTTQILAAGLGYGLLGDGIGYVLFTLFATYSMLPLPLTWAILAGLGTSLLQVILQVVIPRLAVISINQVVAQAVLFMCMNTAGIFISYLSDRAQRQAFLETRRCVEARLRLETENQRQERLVLSVLPRFVVLEMINDMTNVEDEHLQHQFHRIYIHRYENVSILFADVKGFTNLSTTLSAQELVRMLNELFARFDRLAHEHHCLRIKILGDCYYCVSGLPEPRQDHAHCCVEMGLSMIKTIRYVRSRTKHDVDMRIGIHSGSVLCGVLGLRKWQFDVWSWDVDIANKLESGGIPGRIHISKATLDCLNGDYNVEEGHGKERNEFLRKHNIETYLIKQPEDSLLSLPEDIVKESVSSSDRRNSGATFTEGSWSPELPFDNIVGKQNTLAALTRNSINLLPNHLAQALHVQSGPEEINKRIEHTIDLRSGDKLRREHIKPFSLMFKDSSLEHKYSQMRDEVFKSNLVCAFIVLLFITAIQSLLPSSRVMPMTIQFSILIMLHSALVLITTAEDYKCLPLILRKTCCWINETYLARNVIIFASILINFLGAILNILWCDFDKSIPLKNLTFNSSAVFTDICSYPEYFVFTGVLAMVTCAVFLRLNSVLKLAVLLIMIAIYALLTETVYAGLFLRYDNLNHSGEDFLGTKEVSLLLMAMFLLAVFYHGQQLEYTARLDFLWRVQAKEEINEMKELREHNENMLRNILPSHVARHFLEKDRDNEELYSQSYDAVGVMFASIPGFADFYSQTEMNNQGVECLRLLNEIIADFDELLGEDRFQDIEKIKTIGSTYMAVSGLSPEKQQCEDKWGHLCALADFSLALTESIQEINKHSFNNFELRIGISHGSVVAGVIGAKKPQYDIWGKTVNLASRMDSTGVSGRIQVPEETYLILKDQGFAFDYRGEIYVKGISEQEGKIKTYFLLGRVQPNPFILPPRRLPGQYSLAAVVLGLVQSLNRQRQKQLLNENNNTGIIKGHYNRRTLLSPSGTEPGAQAEGTDKSDLP

SEQ ID NO: 294 - protein, 1353 aa, unidentified
MASPPHQQLLHHHSTEVSCDSSGDSNSVRVKINPKQLSSNSHPKHCKYSISSSCSSSGDSGGVPRRVGGGGRLRRQKKLPQLFERASSRWWDPKFDSVNLEEACLERCFPQTQRRFRYALFYIGFACLLWSIYFAVHMRSRLIVMVAPALCFLLVCVGFFLFTFTKLYARHYAWTSLALTLLVFALTLAAQFQVLTPVSGRGDSSNLTATARPTDTCLSQVGSFSMCIEVLFLLYTVMHLPLYLSLCLGVAYSVLFETFGYHFRDEACFPSPGAGALHWELLSRGLLHGCIHAIGVHLFVMSQVRSRSTFLKVGQSIMHGKDLEVEKALKERMIHSVMPRIIADDLMKQGDEESENSVKRHATSSPKNRKKKSSIQKAPIAFRPFKMQQIEEVSILFADIVGFTKMSANKSAHALVGLLNDLFGRFDRLCEETKCEKISTLGDCYYCVAGCPEPRADHAYCCIEMGLGMIKAIEQFCQEKKEMVNMRVGVHTGTVLCGILGMRRFKFDVWSNDVNLANLMEQLGVAGKVHISEATAKYLDDRYEMEDGKVIERLGQSVVADQLKGLKTYLISGQRAKESRCSCAEALLSGFEVIDGSQVSSGPRGQGTASSGNVSDLAQTVKTFDNLKTCPSCGITFAPKSEAGAEGGAPQNGCQDEHKNSTKASGGPNPKTQNGLLSPPQEEKLTNSQTSLCEILQEKGRWAGVSLDQSALLPLRFKNIREKTDAHFVDVIKEDSLMKDYFFKPPINQFSLNFLDQELERSYRTSYQEEVIKNSPVKTFASPTFSSLLDVFLSTTVFLTLSTTCFLKYEAATVPPPPAALAVFSAALLLEVLSLAVSIRMVFFLEDVMACTKRLLEWIAGWLPRHCIGAILVSLPALAVYSHVTSEYETNIHFPVFTGSAALIAVVHYCNFCQLSSWMRSSLATVVGAGPLLLLYVSLCPDSSVLTSPLDAVQNFSSERNPCNSSVPRDLRRPASLIGQEVVLVFFLLLLLVWFLNREFEVSYRLHYHGDVEADLHRTKIQSMRDQADWLLRNIIPYHVAEQLKVSQTYSKNHDSGGVIFASIVNFSEFYEENYEGGKECYRVLNELIGDFDELLSKPDYSSIEKIKTIGATYMAASGLNTAQAQDGSHPQEHLQILFEFAKEMMRVVDDFNNNMLWFNFKLRVGFNHGPLTAGVIGTTKLLYDIWGDTVNIASRMDTTGVECRIQVSEESYRVLSKMGYDFDYRGTVNVKGKGQMKTYLYPKCTDHRVIPQHQLSISPDIRVQVDGSIGRSPTDEIANLVPSVQYVDKTSLGSDSSTQAKDAHLSPKRPWKEPVKAEERGRFGKAIEKDDCDETGIEEANELTKLNVSKSV

SEQ ID NO: 295 - protein, 468 aa, unidentified
MAGVVHVSLAALLLLPMAPAMHSDCIFKKEQAMCLEKIQRANELMGFNDSSPGCPGMWDNITCWKPAHVGEMVLVSCPELFRIFNPDQVWETETIGESDFGDSNSLDLSDMGVVSRNCTEDGWSEPFPHYFDACGFDEYESETGDQDYYYLSVKALYTVGYSTSLVTLTTAMVILCRFRKLHCTRNFIHMNLFVSFMLRAISVFIKDWILYAEQDSNHCFISTVECKAVMVFFHYCVVSNYFWLFIEGLYLFTLLVETFFPERRYFYWYTIIGWGTPTVCVTVWATLRLYFDDTGCWDMNDSTALWWVIKGPVVGSIMVNFVLFIGIIVILVQKLQSPDMGGNESSIYLRLARSTLLLIPLFGIHYTVFAFSPENVSKRERLVFELGLGSFQGFVVAVLYCFLNGEVQAEIKRKWRSWKVNRYFAVDFKHRHPSLASSGVNGGTQLSILSKSSSQIRMSGLPADNLAT

SEQ ID NO: 296 - protein, 560 aa, unidentified
MDLKTVLSLPRYPGEFLHPVVYACTAVMLLCLLASFVTYIVHQSAIRISRKGRHTLLNFCFHAALTFTVFAGGINRTKYPILCQAVGIVLHYSTLSTMLWIGVTARNIYKQVTKKAPLCLDTDQPPYPRQPLLRFYLVSGGVPFIICGVTAATNIRNYGTEDEDTAYCWMAWEPSLGAFYGPAAIITLVTCVYFLGTYVQLRRHPGRRYELRTQPEEQRRLATPEGGRGIRPGTPPAHDAPGASVLQNEHSFQAQLRAAAFTLFLFTATWAFGALAVSQGHFLDMVFSCLYGAFCVTLGLFVLIHHCAKREDVWQCWWACCPPRKDAHPALDANGAALGRAACLHSPGLGQPRGFAHPPGPCKMTNLQAAQGHASCLSPATPCCAKMHCEPLTADEAHVHLQEEGAFGHDPHLHGCLQGRTKPPYFSRHPAEEPEYAYHIPSSLDGSPRSSRTDSPPSSLDGPAGTHTLACCTQGDPFPMVTQPEGSDGSPALYSCPTQPGREAALGPGHLEMLRRTQSLPFGGPSQNGLPKGKLLEGLPFGTDGTGNIRTGPWKNETTV

SEQ ID NO: 297 - protein, 1338 aa, unidentified
MGAGGRRMRGAPARLLLPLLPWLLLLLAPEARGAPGCPLSIRSCKCSGERPKGLSGGVPGPARRRVVCSGGDLPEPPEPGLLPNGTVTLLLSNNKITGLRNGSFLGLSLLEKLDLRNNIISTVQPGAFLGLGELKRLDLSNNRIGCLTSETFQGLPRLLRLNISGNIFSSLQPGVFDELPALKVVDLGTEFLTCDCHLRWLLPWAQNRSLQLSEHTLCAYPSALHAQALGSLQEAQLCCEGALELHTHHLIPSLRQVVFQGDRLPFQCSASYLGNDTRIRWYHNRAPVEGDEQAGILLAESLIHDCTFITSELTLSHIGVWASGEWECTVSMAQGNASKKVEIVVLETSASYCPAERVANNRGDFRWPRTLAGITAYQSCLQYPFTSVPLGGGAPGTRASRRCDRAGRWEPGDYSHCLYTNDITRVLYTFVLMPINASNALTLAHQLRVYTAEAASFSDMMDVVYVAQMIQKFLGYVDQIKELVEVMVDMASNLMLVDEHLLWLAQREDKACSRIVGALERIGGAALSPHAQHISVNARNVALEAYLIKPHSYVGLTCTAFQRREGGVPGTRPGSPGQNPPPEPEPPADQQLRFRCTTGRPNVSLSSFHIKNSVALASIQLPPSLFSSLPAALAPPVPPDCTLQLLVFRNGRLFHSHSNTSRPGAAGPGKRRGVATPVIFAGTSGCGVGNLTEPVAVSLRHWAEGAEPVAAWWSQEGPGEAGGWTSEGCQLRSSQPNVSALHCQHLGNVAVLMELSAFPREVGGAGAGLHPVVYPCTALLLLCLFATIITYILNHSSIRVSRKGWHMLLNLCFHIAMTSAVFAGGITLTNYQMVCQAVGITLHYSSLSTLLWMGVKARVLHKELTWRAPPPQEGDPALPTPSPMLRFYLIAGGIPLIICGITAAVNIHNYRDHSPYCWLVWRPSLGAFYIPVALILLITWIYFLCAGLRLRGPLAQNPKAGNSRASLEAGEELRGSTRLRGSGPLLSDSGSLLATGSARVGTPGPPEDGDSLYSPGVQLGALVTTHFLYLAMWACGALAVSQRWLPRVVCSCLYGVAASALGLFVFTHHCARRRDVRASWRACCPPASPAAPHAPPRALPAAAEDGSPVFGEGPPSLKSSPSGSSGHPLALGPCKLTNLQLAQSQVCEAGAAAGGEGEPEPAGTRGNLAHRHPNNVHHGRRAHKSRAKGHRAGEACGKNRLKALRGGAAGALELLSSESGSLHNSPTDSYLGSSRNSPGAGLQLEGEPMLTPSEGSDTSAAPLSEAGRAGQRRSASRDSLKGGGALEKESHRRSYPLNAASLNGAPKGGKYDDVTLMGAEVASGGCMKTGLWKSETTV

SEQ ID NO: 298 - protein, 1321 aa, unidentified
MEPPGRRRGRAQPPLLLPLSLLALLALLGGGGGGGAAALPAGCKHDGRPRGAGRAAGAAEGKVVCSSLELAQVLPPDTLPNRTVTLILSNNKISELKNGSFSGLSLLERLDLRNNLISSIDPGAFWGLSSLKRLDLTNNRIGCLNADIFRGLTNLVRLNLSGNLFSSLSQGTFDYLASLRSLEFQTEYLLCDCNILWMHRWVKEKNITVRDTRCVYPKSLQAQPVTGVKQELLTCDPPLELPSFYMTPSHRQVVFEGDSLPFQCMASYIDQDMQVLWYQDGRIVETDESQGIFVEKNMIHNCSLIASALTISNIQAGSTGNWGCHVQTKRGNNTRTVDIVVLESSAQYCPPERVVNNKGDFRWPRTLAGITAYLQCTRNTHGSGIYPGNPQDERKAWRRCDRGGFWADDDYSRCQYANDVTRVLYMFNQMPLNLTNAVATARQLLAYTVEAANFSDKMDVIFVAEMIEKFGRFTKEEKSKELGDVMVDIASNIMLADERVLWLAQREAKACSRIVQCLQRIATYRLAGGAHVYSTYSPNIALEAYVIKSTGFTGMTCTVFQKVAASDRTGLSDYGRRDPEGNLDKQLSFKCNVSNTFSSLALKNTIVEASIQLPPSLFSPKQKRELRPTDDSLYKLQLIAFRNGKLFPATGNSTNLADDGKRRTVVTPVILTKIDGVNVDTHHIPVNVTLRRIAHGADAVAARWDFDLLNGQGGWKSDGCHILYSDENITTIQCYSLSNYAVLMDLTGSELYTQAASLLHPVVYTTAIILLLCLLAVIVSYIYHHSLIRISLKSWHMLVNLCFHIFLTCVVFVGGITQTRNASICQAVGIILHYSTLATVLWVGVTARNIYKQVTKKAKRCQDPDEPPPPPRPMLRFYLIGGGIPIIVCGITAAANIKNYGSRPNAPYCWMAWEPSLGAFYGPASFITFVNCMYFLSIFIQLKRHPERKYELKEPTEEQQRLAANENGEINHQDSMSLSLISTSALENEHTFHSQLLGASLTLLLYVALWMFGALAVSLYYPLDLVFSFVFGATSLSFSAFFVVHHCVNREDVRLAWIMTCCPGRSSYSVQVNVQPPNSNGTNGEAPKCPNSSAESSCTNKSASSFKNSSQGCKLTNLQAAAAQCHANSLPLNSTPQLDNSLTEHSMDNDIKMHVAPLEVQFRTNVHSSRHHKNRSKGHRASRLTVLREYAYDVPTSVEGSVQNGLPKSRLGNNEGHSRSRRAYLAYRERQYNPPQQDSSDACSTLPKSSRNFEKPVSTTSKKDALRKPAVVELENQQKSYGLNLAIQNGPIKSNGQEGPLLGTDSTGNVRTGLWKHETTV

SEQ ID NO: 299 - protein, 1584 aa, unidentified
MRGQAAAPGPVWILAPLLLLLLLLGRRARAAAGADAGPGPEPCATLVQGKFFGYFSAAAVFPANASRCSWTLRNPDPRRYTLYMKVAKAPVPCSGPGRVRTYQFDSFLESTRTYLGVESFDEVLRLCDPSAPLAFLQASKQFLQMRRQQPPQHDGLRPRAGPPGPTDDFSVEYLVVGNRNPSRAACQMLCRWLDACLAGSRSSHPCGIMQTPCACLGGEAGGPAAGPLAPRGDVCLRDAVAGGPENCLTSLTQDRGGHGATGGWKLWSLWGECTRDCGGGLQTRTRTCLPAPGVEGGGCEGVLEEGRQCNREACGPAGRTSSRSQSLRSTDARRREELGDELQQFGFPAPQTGDPAAEEWSPWSVCSSTCGEGWQTRTRFCVSSSYSTQCSGPLREQRLCNNSAVCPVHGAWDEWSPWSLCSSTCGRGFRDRTRTCRPPQFGGNPCEGPEKQTKFCNIALCPGRAVDGNWNEWSSWSACSASCSQGRQQRTRECNGPSYGGAECQGHWVETRDCFLQQCPVDGKWQAWASWGSCSVTCGAGSQRRERVCSGPFFGGAACQGPQDEYRQCGTQRCPEPHEICDEDNFGAVIWKETPAGEVAAVRCPRNATGLILRRCELDEEGIAYWEPPTYIRCVSIDYRNIQMMTREHLAKAQRGLPGEGVSEVIQTLVEISQDGTSYSGDLLSTIDVLRNMTEIFRRAYYSPTPGDVQNFVQILSNLLAEENRDKWEEAQLAGPNAKELFRLVEDFVDVIGFRMKDLRDAYQVTDNLVLSIHKLPASGATDISFPMKGWRATGDWAKVPEDRVTVSKSVFSTGLTEADEASVFVVGTVLYRNLGSFLALQRNTTVLNSKVISVTVKPPPRSLRTPLEIEFAHMYNGTTNQTCILWDETDVPSSSAPPQLGPWSWRGCRTVPLDALRTRCLCDRLSTFAILAQLSADANMEKATLPSVTLIVGCGVSSLTLLMLVIIYVSVWRYIRSERSVILINFCLSIISSNALILIGQTQTRNKVVCTLVAAFLHFFFLSSFCWVLTEAWQSYMAVTGHLRNRLIRKRFLCLGWGLPALVVAISVGFTKAKGYSTMNYCWLSLEGGLLYAFVGPAAAVVLVNMVIGILVFNKLVSKDGITDKKLKERAGASLWSSCVVLPLLALTWMSAVLAVTDRRSALFQILFAVFDSLEGFVIVMVHCILRREVQDAVKCRVVDRQEEGNGDSGGSFQNGHAQLMTDFEKDVDLACRSVLNKDIAACRTATITGTLKRPSLPEEEKLKLAHAKGPPTNFNSLPANVSKLHLHGSPRYPGGPLPDFPNHSLTLKRDKAPKSSFVGDGDIFKKLDSELSRAQEKALDTSYVILPTATATLRPKPKEEPKYSIHIDQMPQTRLIHLSTAPEASLPARSPPSRQPPSGGPPEAPPAQPPPPPPPPPPPPQQPLPPPPNLEPAPPSLGDPGEPAAHPGPSTGPSTKNENVATLSVSSLERRKSRYAELDFEKIMHTRKRHQDMFQDLNRKLQHAAEKDKEVLGPDSKPEKQQTPNKRPWESLRKAHGTPTWVKKELEPLQPSPLELRSVEWERSGATIPLVGQDIIDLQTEV

SEQ ID NO: 300 - protein, 1585 aa, unidentified
MENTGWMGKGHRMTPACPLLLSVILSLRLATAFDPAPSACSALASGVLYGAFSLQDLFPTIASGCSWTLENPDPTKYSLYLRFNRQEQVCAHFAPRLLPLDHYLVNFTCLRPSPEEAVAQAESEVGRPEEEEAEAAAGLELCSGSGPFTFLHFDKNFVQLCLSAEPSEAPRLLAPAALAFRFVEVLLINNNNSSQFTCGVLCRWSEECGRAAGRACGFAQPGCSCPGEAGAGSTTTTSPGPPAAHTLSNALVPGGPAPPAEADLHSGSSNDLFTTEMRYGEEPEEEPKVKTQWPRSADEPGLYMAQTGDPAAEEWSPWSVCSLTCGQGLQVRTRSCVSSPYGTLCSGPLRETRPCNNSATCPVHGVWEEWGSWSLCSRSCGRGSRSRMRTCVPPQHGGKACEGPELQTKLCSMAACPVEGQWLEWGPWGPCSTSCANGTQQRSRKCSVAGPAWATCTGALTDTRECSNLECPATDSKWGPWNAWSLCSKTCDTGWQRRFRMCQATGTQGYPCEGTGEEVKPCSEKRCPAFHEMCRDEYVMLMTWKKAAAGEIIYNKCPPNASGSASRRCLLSAQGVAYWGLPSFARCISHEYRYLYLSLREHLAKGQRMLAGEGMSQVVRSLQELLARRTYYSGDLLFSVDILRNVTDTFKRATYVPSADDVQRFFQVVSFMVDAENKEKWDDAQQVSPGSVHLLRVVEDFIHLVGDALKAFQSSLIVTDNLVISIQREPVSAVSSDITFPMRGRRGMKDWVRHSEDRLFLPKEVLSLSSPGKPATSGAAGSPGRGRGPGTVPPGPGHSHQRLLPADPDESSYFVIGAVLYRTLGLILPPPRPPLAVTSRVMTVTVRPPTQPPAEPLITVELSYIINGTTDPHCASWDYSRADASSGDWDTENCQTLETQAAHTRCQCQHLSTFAVLAQPPKDLTLELAGSPSVPLVIGCAVSCMALLTLLAIYAAFWRFIKSERSIILLNFCLSILASNILILVGQSRVLSKGVCTMTAAFLHFFFLSSFCWVLTEAWQSYLAVIGRMRTRLVRKRFLCLGWGLPALVVAVSVGFTRTKGYGTSSYCWLSLEGGLLYAFVGPAAVIVLVNMLIGIIVFNKLMARDGISDKSKKQRAGSERCPWASLLLPCSACGAVPSPLLSSASARNAMASLWSSCVVLPLLALTWMSAVLAMTDRRSVLFQALFAVFNSAQGFVITAVHCFLRREVQDVVKCQMGVCRADESEDSPDSCKNGQLQILSDFEKDVDLACQTVLFKEVNTCNPSTITGTLSRLSLDEDEEPKSCLVGPEGSLSFSPLPGNILVPMAASPGLGEPPPPQEANPVYMCGEGGLRQLDLTWLRPTEPGSEGDYMVLPRRTLSLQPGGGGGGGEDAPRARPEGTPRRAAKTVAHTEGYPSFLSVDHSGLGLGPAYGSLQNPYGMTFQPPPPTPSARQVPEPGERSRTMPRTVPGSTMKMGSLERKKLRYSDLDFEKVMHTRKRHSELYHELNQKFHTFDRYRSQSTAKREKRWSVSSGGAAERSVCTDKPSPGERPSLSQHRRHQSWSTFKSMTLGSLPPKPRERLTLHRAAAWEPTEPPDGDFQTEV

SEQ ID NO: 301 - protein, 1522 aa, unidentified
MKAVRNLLIYIFSTYLLVMFGFNAAQDFWCSTLVKGVIYGSYSVSEMFPKNFTNCTWTLENPDPTKYSIYLKFSKKDLSCSNFSLLAYQFDHFSHEKIKDLLRKNHSIMQLCNSKNAFVFLQYDKNFIQIRRVFPTNFPGLQKKGEEDQKSFFEFLVLNKVSPSQFGCHVLCTWLESCLKSENGRTESCGIMYTKCTCPQHLGEWGIDDQSLILLNNVVLPLNEQTEGCLTQELQTTQVCNLTREAKRPPKEEFGMMGDHTIKSQRPRSVHEKRVPQEQADAAKFMAQTGESGVEEWSQWSTCSVTCGQGSQVRTRTCVSPYGTHCSGPLRESRVCNNTALCPVHGVWEEWSPWSLCSFTCGRGQRTRTRSCTPPQYGGRPCEGPETHHKPCNIALCPVDGQWQEWSSWSQCSVTCSNGTQQRSRQCTAAAHGGSECRGPWAESRECYNPECTANGQWNQWGHWSGCSKSCDGGWERRIRTCQGAVITGQQCEGTGEEVRRCNEQRCPAPYEICPEDYLMSMVWKRTPAGDLAFNQCPLNATGTTSRRCSLSLHGVAFWEQPSFARCISNEYRHLQHSIKEHLAKGQRMLAGDGMSQVTKTLLDLTQRKNFYAGDLLMSVEILRNVTDTFKRASYIPASDGVQNFFQIVSNLLDEENKEKWEDAQQIYPGSIELMQVIEDFIHIVGMGMMDFQNSYLMTGNVVASIQKLPAASVLTDINFPMKGRKGMVDWARNSEDRVVIPKSIFTPVSSKELDESSVFVLGAVLYKNLDLILPTLRNYTVINSKIIVVTIRPEPKTTDSFLEIELAHLANGTLNPYCVLWDDSKTNESLGTWSTQGCKTVLTDASHTKCLCDRLSTFAILAQQPREIIMESSGTPSVTLIVGSGLSCLALITLAVVYAALWRYIRSERSIILINFCLSIISSNILILVGQTQTHNKSICTTTTAFLHFFFLASFCWVLTEAWQSYMAVTGKIRTRLIRKRFLCLGWGLPALVVATSVGFTRTKGYGTDHYCWLSLEGGLLYAFVGPAAAVVLVNMVIGILVFNKLVSRDGILDKKLKHRAGQMSEPHSGLTLKCAKCGVVSTTALSATTASNAMASLWSSCVVLPLLALTWMSAVLAMTDKRSILFQILFAVFDSLQGFVIVMVHCILRREVQDAFRCRLRNCQDPINADSSSSFPNGHAQIMTDFEKDVDIACRSVLHKDIGPCRAATITGTLSRISLNDDEEEKGTNPEGLSYSTLPGNVISKVIIQQPTGLHMPMSMNELSNPCLKKENSELRRTVYLCTDDNLRGADMDIVHPQERMMESDYIVMPRSSVNNQPSMKEESKMNIGMETLPHERLLHYKVNPEFNMNPPVMDQFNMNLEQHLAPQEHMQNLPFEPRTAVKNFMASELDDNAGLSRSETGSTISMSSLERRKSRYSDLDFEKVMHTRKRHMELFQELNQKFQTLDRFRDIPNTSSMENPAPNKNPWDTFKNPSEYPHYTTINVLDTEAKDALELRPAEWEKCLNLPLDVQEGDFQTEV

SEQ ID NO: 302 - protein, 874 aa, unidentified
MEKLLRLCCWYSWLLLFYYNFQVRGVYSRSQDHPGFQVLASASHYWPLENVDGIHELQDTTGDIVEGKVNKGIYLKEEKGVTLLYYGRYNSSCISKPEQCGPEGVTFSFFWKTQGEQSRPIPSAYGGQVISNGFKVCSSGGRGSVELYTRDNSMTWEASFSPPGPYWTHVLFTWKSKEGLKVYVNGTLSTSDPSGKVSRDYGESNVNLVIGSEQDQAKCYENGAFDEFIIWERALTPDEIAMYFTAAIGKHALLSSTLPSLFMTSTASPVMPTDAYHPIITNLTEERKTFQSPGVILSYLQNVSLSLPSKSLSEQTALNLTKTFLKAVGEILLLPGWIALSEDSAVVLSLIDTIDTVMGHVSSNLHGSTPQVTVEGSSAMAEFSVAKILPKTVNSSHYRFPAHGQSFIQIPHEAFHRHAWSTVVGLLYHSMHYYLNNIWPAHTKIAEAMHHQDCLLFATSHLISLEVSPPPTLSQNLSGSPLITVHLKHRLTRKQHSEATNSSNRVFVYCAFLDFSSGEGVWSNHGCALTRGNLTYSVCRCTHLTNFAILMQVVPLELARGHQVALSSISYVGCSLSVLCLVATLVTFAVLSSVSTIRNQRYHIHANLSFAVLVAQVLLLISFRLEPGTTPCQVMAVLLHYFFLSAFAWMLVEGLHLYSMVIKVFGSEDSKHRYYYGMGWGFPLLICIISLSFAMDSYGTSNNCWLSLASGAIWAFVAPALFVIVVNIGILIAVTRVISQISADNYKIHGDPSAFKLTAKAVAVLLPILGTSWVFGVLAVNGCAVVFQYMFATLNSLQGLFIFLFHCLLNSEVRAAFKHKTKVWSLTSSSARTSNAKPFHSDLMNGTRPGMASTKLSPWDKSSHSAHRVDLSAV

SEQ ID NO: 303 - protein, 886 aa, unidentified
MRGFNLLLFWGCCVMHSWEGHIRPTRKPNTKGNNCRDSTLCPAYATCTNTVDSYYCACKQGFLSSNGQNHFKDPGVRCKDIDECSQSPQPCGPNSSCKNLSGRYKCSCLDGFSSPTGNDWVPGKPGNFSCTDINECLTSSVCPEHSDCVNSMGSYSCSCQVGFISRNSTCEDVDECADPRACPEHATCNNTVGNYSCFCNPGFESSSGHLSFQGLKASCEDIDECTEMCPINSTCTNTPGSYFCTCHPGFAPSNGQLNFTDQGVECRDIDECRQDPSTCGPNSICTNALGSYSCGCIAGFHPNPEGSQKDGNFSCQRVLFKCKEDVIPDNKQIQQCQEGTAVKPAYVSFCAQINNIFSVLDKVCENKTTVVSLKNTTESFVPVLKQISTWTKFTKEETSSLATVFLESVESMTLASFWKPSANITPAVRTEYLDIESKVINKECSEENVTLDLVAKGDKMKIGCSTIEESESTETTGVAFVSFVGMESVLNERFFKDHQAPLTTSEIKLKMNSRVVGGIMTGEKKDGFSDPIIYTLENIQPKQKFERPICVSWSTDVKGGRWTSFGCVILEASETYTICSCNQMANLAVIMASGELTMDFSLYIISHVGIIISLVCLVLAIATFLLCRSIRNHNTYLHLHLCVCLLLAKTLFLAGIHKTDNKMGCAIIAGFLHYLFLACFFWMLVEAVILFLMVRNLKVVNYFSSRNIKMLHICAFGYGLPMLVVVISASVQPQGYGMHNRCWLNTETGFIWSFLGPVCTVIVINSLLLTWTLWILRQRLSSVNAEVSTLKDTRLLTFKAFAQLFILGCSWVLGIFQIGPVAGVMAYLFTIINSLQGAFIFLIHCLLNGQVREEYKRWITGKTKPSSQSQTSRILLSSMPSASKTG

SEQ ID NO: 304 - protein, 823 aa, unidentified
MGGRVFLVFLAFCVWLTLPGAETQDSRGCARWCPQDSSCVNATACRCNPGFSSFSEIITTPMETCDDINECATLSKVSCGKFSDCWNTEGSYDCVCSPGYEPVSGAKTFKNESENTCQDVDECQQNPRLCKSYGTCVNTLGSYTCQCLPGFKLKPEDPKLCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDYKPGLANNTIQSILQALDELLEAPGDLETLPRLQQHCVASHLLDGLEDVLRGLSKNLSNGLLNFSYPAGTELSLEVQKQVDRSVTLRQNQAVMQLDWNQAQKSGDPGPSVVGLVSIPGMGKLLAEAPLVLEPEKQMLLHETHQGLLQDGSPILLSDVISAFLSNNDTQNLSSPVTFTFSHRSVIPRQKVLCVFWEHGQNGCGHWATTGCSTIGTRDTSTICRCTHLSSFAVLMAHYDVQEEDPVLTVITYMGLSVSLLCLLLAALTFLLCKAIQNTSTSLHLQLSLCLFLAHLLFLVAIDQTGHKVLCSIIAGTLHYLYLATLTWMLLEALYLFLTARNLTVVNYSSINRFMKKLMFPVGYGVPAVTVAISAASRPHLYGTPSRCWLQPEKGFIWGFLGPVCAIFSVNLVLFLVTLWILKNRLSSLNSEVSTLRNTRMLAFKATAQLFILGCTWCLGILQVGPAARVMAYLFTIINSLQGVFIFLVYCLLSQQVREQYGKWSKGIRKLKTESEMHTLSSSAKADTSKPSTVN

SEQ ID NO: 305 - protein, 652 aa, unidentified
MQGPLLLPGLCFLLSLFGAVTQKTKTSCAKCPPNASCVNNTHCTCNHGYTSGSGQKLFTFPLETCNDINECTPPYSVYCGFNAVCYNVEGSFYCQCVPGYRLHSGNEQFSNSNENTCQDTTSSKTTEGRKELQKIVDKFESLLTNQTLWRTEGRQEISSTATTILRDVESKVLETALKDPEQKVLKIQNDSVAIETQAITDNCSEERKTFNLNVQMNSMDIRCSDIIQGDTQGPSAIAFISYSSLGNIINATFFEEMDKKDQVYLNSQVVSAAIGPKRNVSLSKSVTLTFQHVKMTPSTKKVFCVYWKSTGQGSQWSRDGCFLIHVNKSHTMCNCSHLSSFAVLMALTSQEEDPVLTVITYVGLSVSLLCLLLAALTFLLCKAIRNTSTSLHLQLSLCLFLAHLLFLVGIDRTEPKVLCSIIAGALHYLYLAAFTWMLLEGVHLFLTARNLTVVNYSSINRLMKWIMFPVGYGVPAVTVAISAASWPHLYGTADRCWLHLDQGFMWSFLGPVCAIFSANLVLFILVFWILKRKLSSLNSEVSTIQNTRMLAFKATAQLFILGCTWCLGLLQVGPAAQVMAYLFTIINSLQGFFIFLVYCLLSQQVQKQYQKWFREIVKSKSESETYTLSSKMGPDSKPSEGDVFPGQVKRKY

SEQ ID NO: 306 - protein, 835 aa, unidentified
MGGRVFLAFCVWLTLPGAETQDSRGCARWCPQNSSCVNATACRCNPGFSSFSEIITTPTETCDDINECATPSKVSCGKFSDCWNTEGSYDCVCSPGYEPVSGAKTFKNESENTCQDVDECQQNPRLCKSYGTCVNTLGSYTCQCLPGFKFIPEDPKVCTDVNECTSGQNPCHSSTHCLNNVGSYQCRCRPGWQPIPGSPNGPNNTVCEDVDECSSGQHQCDSSTVCFNTVGSYSCRCRPGWKPRHGIPNNQKDTVCEDMTFSTWTPPPGVHSQTLSRFFDKVQDLGRDSKTSSAEVTIQNVIKLVDELMEAPGDVEALAPPVRHLIATQLLSNLEDIMRILAKSLPKGPFTYISPSNTELTLMIQERGDKNVTMGQSSARMKLNWAVAAGAEDPGPAVAGILSIQNMTTLLANASLNLHSKKQAELEEIYESSIRGVQLRRLSAVNSIFLSHNNTKELNSPILFAFSHLESSDGEAGRDPPAKDVMPGPRQELLCAFWKSDSDRGGHWATEGCQVLGSKNGSTTCQCSHLSSFAILMAHYDVEDWKLTLITRVGLALSLFCLLLCILTFLLVRPIQGSRTTIHLHLCICLFVGSTIFLAGIENEGGQVGLRCRLVAGLLHYCFLAAFCWMSLEGLELYFLVVRVFQGQGLSTRWLCLIGYGVPLLIVGVSAAIYSKGYGRPRYCWLDFEQGFLWSFLGPVTFIILCNAVIFVTTVWKLTQKFSEINPDMKKLKKARALTITAIAQLFLLGCTWVFGLFIFDDRSLVLTYVFTILNCLQGAFLYLLHCLLNKKVREEYRKWACLVAGGSKYSEFTSTTSGTGHNQTRALRASESGI

SEQ ID NO: 307 - protein, 910 aa, unidentified
MKVGVLWLISFFTFTDGHGGFLGKNDGIKTKKELIVNKKKHLGPVEEYQLLLQVTYRDSKEKRDLRNFLKLLKPPLLWSHGLIRIIRAKATTDCNSLNGVLQCTCEDSYTWFPPSCLDPQNCYLHTAGALPSCECHLNNLSQSVNFCERTKIWGTFKINERFTNDLLNSSSAIYSKYANGIEIQLKKAYERIQGFESVQVTQFRNGSIVAGYEVVGSSSASELLSAIEHVAEKAKTALHKLFPLEDGSFRVFGKAQCNDIVFGFGSKDDEYTLPCSSGYRGNITAKCESSGWQVIRETCVLSLLEELNKNFSMIVGNATEAAVSSFVQNLSVIIRQNPSTTVGNLASVVSILSNISSLSLASHFRVSNSTMEDVISIADNILNSASVTNWTVLLREEKYASSRLLETLENISTLVPPTALPLNFSRKFIDWKGIPVNKSQLKRGYSYQIKMCPQNTSIPIRGRVLIGSDQFQRSLPETIISMASLTLGNILPVSKNGNAQVNGPVISTVIQNYSINEVFLFFSKIESNLSQPHCVFWDFSHLQWNDAGCHLVNETQDIVTCQCTHLTSFSILMSPFVPSTIFPVVKWITYVGLGISIGSLILCLIIEALFWKQIKKSQTSHTRRICMVNIALSLLIADVWFIVGATVDTTVNPSGVCTAAVFFTHFFYLSLFFWMLMLGILLAYRIILVFHHMAQHLMMAVGFCLGYGCPLIISVITIAVTQPSNTYKRKDVCWLNWSNGSKPLLAFVVPALAIVAVNFVVVLLVLTKLWRPTVGERLSRDDKATIIRVGKSLLILTPLLGLTWGFGIGTIVDSQNLAWHVIFALLNAFQGFFILCFGILLDSKLRQLLFNKLSALSSWKQTEKQNSSDLSAKPKFSKPFNPLQNKGHYAFSHTGDSSDNIMLTQFVSNE

SEQ ID NO: 308 - protein, 708 aa, unidentified
MGLTAYGNRRVQPGELPFGANLTLIHTRAQPVICSKLLLTKRVSPISFFLSKFQNSWGEDGWVQLDQLPSPNAVSSDQVHCSAGCTHRKCGWAASKSKEKVPARPHGVCDGVCTDYSQCTQPCPPDTQGNMGFSCRQKTWHKITDTCQTLNALNIFEEDSRLVQPFEDNIKISVYTGKSETITDMLLQKCPTDLSCVIRNIQQSPWIPGNIAVIVQLLHNISTAIWTGVDEAKMQSYSTIANHILNSKSISNWTFIPDRNSSYILLHSVNSFARRLFIDKHPVDISDVFIHTMGTTISGDNIGKNFTFSMRINDTSNEVTGRVLISRDELRKVPSPSQVISIAFPTIGAILEASLLENVTVNGLVLSAILPKELKRISLIFEKISKSEERRTQCVGWHSVENRWDQQACKMIQENSQQAVCKCRPSKLFTSFSILMSPHILESLILTYITYVGLGISICSLILCLSIEVLVWSQVTKTEITYLRHVCIVNIAATLLMADVWFIVASFLSGPITHHKGCVAATFFVHFFYLSVFFWMLAKALLILYGIMIVFHTLPKSVLVASLFSVGYGCPLAIAAITVAATEPGKGYLRPEICWLNWDMTKALLAFVIPALAIVVVNLITVTLVIVKTQRAAIGNSMFQEVRAIVRISKNIAILTPLLGLTWGFGVATVIDDRSLAFHIIFSLLNAFQVSPDASDQVQSERIHEDVL

SEQ ID NO: 309 - protein, 1079 aa, unidentified
MVCSAAPLLLLATTLPLLGSPVAQASQPVSETGVRPREGLQRRQWGPLIGRDKAWNERIDRPFPACPIPLSSSFGRWPKGQTMWAQTSTLTLTEEELGQSQAGGESGSGQLLDQENGAGESALVSVYVHLDFPDKTWPPELSRTLTLPAASASSSPRPLLTGLRLTTECNVNHKGNFYCACLSGYQWNTSICLHYPPCQSLHNHQPCGCLVFSHPEPGYCQLLPPGSPVTCLPAVPGILNLNSQLQMPGDTLSLTLHLSQEATNLSWFLRHPGSPSPILLQPGTQVSVTSSHGQAALSVSNMSHHWAGEYMSCFEAQGFKWNLYEVVRVPLKATDVARLPYQLSISCATSPGFQLSCCIPSTNLAYTAAWSPGEGSKASSFNESGSQCFVLAVQRCPMADTTYACDLQSLGLAPLRVPISITIIQDGDITCPEDASVLTWNVTKAGHVAQAPCPESKRGIVRRLCGADGVWGPVHSSCTDARLLALFTRTKLLQAGQGSPAEEVPQILAQLPGQAAEASSPSDLLTLLSTMKYVAKVVAEARIQLDRRALKNLLIATDKVLDMDTRSLWTLAQARKPWAGSTLLLAVETLACSLCPQDHPFAFSLPNVLLQSQLFGPTFPADYSISFPTRPPLQAQIPRHSLAPLVRNGTEISITSLVLRKLDHLLPSNYGQGLGDSLYATPGLVLVISIMAGDRAFSQGEVIMDFGNTDGSPHCVFWDHSLFQGRGGWSKEGCQAQVASASPTAQCLCQHLTAFSVLMSPHTVPEEPALALLTQVGLGASILALLVCLGVYWLVWRVVVRNKISYFRHAALLNMVFCLLAADTCFLGAPFLSPGPRSPLCLAAAFLCHFLYLATFFWMLAQALVLAHQLLFVFHQLAKHRVLPLMVLLGYLCPLGLAGVTLGLYLPQGQYLREGECWLDGKGGALYTFVGPVLAIIGVNGLVLAMAMLKLLRPSLSEGPPAEKRQALLGVIKALLILTPIFGLTWGLGLATLLEEVSTVPHYIFTILNTLQGVFILLFGCLMDRKIQEALRKRFCRAQAPSSTISLVSCCLQILSCASKSMSEGIPWPSSEDMGTARS

SEQ ID NO: 310 - protein, 695 aa, unidentified
MKMKSQATMICCLVFFLSTECSHYRSKIHLKAGDKLQSPEGKPKTGRIQEKCEGPCISSSNCSQPCAKDFHGEIGFTCNQKKWQKSAETCTSLSVEKLFKDSTGASRLSVAAPSIPLHILDFRAPETIESVAQGIRKNCPFDYACITDMVKSSETTSGNIAFIVELLKNISTDLSDNVTREKMKSYSEVANHILDTAAISNWAFIPNKNASSDLLQSVNLFARQLHIHNNSENIVNELFIQTKGFHINHNTSEKSLNFSMSMNNTTEDILGMVQIPRQELRKLWPNASQAISIAFPTLGAILREAHLQNVSLPRQVNGLVLSVVLPERLQEIILTFEKINKTRNARAQCVGWHSKKRRWDEKACQMMLDIRNEVKCRCNYTSVVMSFSILMSSKSMTDKVLDYITCIGLSVSILSLVLCLIIEATVWSRVVVTEISYMRHVCIVNIAVSLLTANVWFIIGSHFNIKAQDYNMCVAVTFFSHFFYLSLFFWMLFKALLIIYGILVIFRRMMKSRMMVIGFAIGYGCPLIIAVTTVAITEPEKGYMRPEACWLNWDNTKALLAFAIPAFVIVAVNLIVVLVVAVNTQRPSIGSSKSQDVVIIMRISKNVAILTPLLGLTWGFGIATLIEGTSLTFHIIFALLNAFQGFFILLFGTIMDHKIRDALRMRMSSLKGKSRAAENASLGPTNGSKLMNRQG

SEQ ID NO: 311 - protein, 1346 aa, unidentified
MKSPRRTTLCLMFIVIYSSKAALNWNYESTIHPLSLHEHEPAGEEALRQKRAVATKSPTAEEYTVNIEISFENASFLDPIKAYLNSLSFPIHGNNTDQITDILSINVTTVCRPAGNEIWCSCETGYGWPRERCLHNLICQERDVFLPGHHCSCLKELPPNGPFCLLQEDVTLNMRVRLNVGFQEDLMNTSSALYRSYKTDLETAFRKGYGILPGFKGVTVTGFKSGSVVVTYEVKTTPPSLELIHKANEQVVQSLNQTYKMDYNSFQAVTINESNFFVTPEIIFEGDTVSLVCEKEVLSSNVSWRYEEQQLEIQNSSRFSIYTALFNNMTSVSKLTIHNITPGDAGEYVCKLILDIFEYECKKKIDVMPIQILANEEMKVMCDNNPVSLNCCSQGNVNWSKVEWKQEGKINIPGTPETDIDSSCSRYTLKADGTQCPSGSSGTTVIYTCEFISAYGARGSANIKVTFISVANLTITPDPISVSEGQNFSIKCISDVSNYDEVYWNTSAGIKIYQRFYTTRRYLDGAESVLTVKTSTREWNGTYHCIFRYKNSYSIATKDVIVHPLPLKLNIMVDPLEATVSCSGSHHIKCCIEEDGDYKVTFHTGSSSLPAAKEVNKKQVCYKHNFNASSVSWCSKTVDVCCHFTNAANNSVWSPSMKLNLVPGENITCQDPVIGVGEPGKVIQKLCRFSNVPSSPESPIGGTITYKCVGSQWEEKRNDCISAPINSLLQMAKALIKSPSQDEMLPTYLKDLSISIDKAEHEISSSPGSLGAIINILDLLSTVPTQVNSEMMTHVLSTVNVILGKPVLNTWKVLQQQWTNQSSQLLHSVERFSQALQSGDSPPLSFSQTNVQMSSMVIKSSHPETYQQRFVFPYFDLWGNVVIDKSYLENLQSDSSIVTMAFPTLQAILAQDIQENNFAESLVMTTTVSHNTTMPFRISMTFKNNSPSGGETKCVFWNFRLANNTGGWDSSGCYVEEGDGDNVTCICDHLTSFSILMSPDSPDPSSLLGILLDIISYVGVGFSILSLAACLVVEAVVWKSVTKNRTSYMRHTCIVNIAASLLVANTWFIVVAAIQDNRYILCKTACVAATFFIHFFYLSVFFWMLTLGLMLFYRLVFILHETSRSTQKAIAFCLGYGCPLAISVITLGATQPREVYTRKNVCWLNWEDTKALLAFAIPALIIVVVNITITIVVITKILRPSIGDKPCKQEKSSLFQISKSIGVLTPLLGLTWGFGLTTVFPGTNLVFHIIFAILNVFQGLFILLFGCLWDLKVQEALLNKFSLSRWSSQHSKSTSLGSSTPVFSMSSPISRRFNNLFGKTGTYNVSTPEATSSSLENSSSASSLLN

SEQ ID NO: 312 - protein, 693 aa, unidentified
MTPQSLLQTTLFLLSLLFLVQGAHGRGHREDFRFCSQRNQTHRSSLHYKPTPDLRISIENSEEALTVHAPFPAAHPASRSFPDPRGLYHFCLYWNRHAGRLHLLYGKRDFLLSDKASSLLCFQHQEESLAQGPPLLATSVTSWWSPQNISLPSAASFTFSFHSPPHTAAHNASVDMCELKRDLQLLSQFLKHPQKASRRPSAAPASQQLQSLESKLTSVRFMGDMVSFEEDRINATVWKLQPTAGLQDLHIHSRQEEEQSEIMEYSVLLPRTLFQRTKGRSGEAEKRLLLVDFSSQALFQDKNSSQVLGEKVLGIVVQNTKVANLTEPVVLTFQHQLQPKNVTLQCVFWVEDPTLSSPGHWSSAGCETVRRETQTSCFCNHLTYFAVLMVSSVEVDAVHKHYLSLLSYVGCVVSALACLVTIAAYLCSRVPLPCRRKPRDYTIKVHMNLLLAVFLLDTSFLLSEPVALTGSEAGCRASAIFLHFSLLTCLSWMGLEGYNLYRLVVEVFGTYVPGYLLKLSAMGWGFPIFLVTLVALVDVDNYGPIILAVHRTPEGVIYPSMCWIRDSLVSYITNLGLFSLVFLFNMAMLATMVVQILRLRPHTQKWSHVLTLLGLSLVLGLPWALIFFSFASGTFQLVVLYLFSIITSFQGFLIFIWYWSMRLQARGGPSPLKSNSDSARLPISSGSTSSSRI

SEQ ID NO: 313 - protein, 1017 aa, unidentified
MVFSVRQCGHVGRTEEVLLTFKIFLVIICLHVVLVTSLEEDTDNSSLSPPPAKLSVVSFAPSSNGTPEVETTSLNDVTLSLLPSNETEKTKITIVKTFNASGVKPQRNICNLSSICNDSAFFRGEIMFQYDKESTVPQNQHITNGTLTGVLSLSELKRSELNKTLQTLSETYFIMCATAEAQSTLNCTFTIKLNNTMNACAVIAALERVKIRPMEHCCCSVRIPCPSSPEELEKLQCDLQDPIVCLADHPRGPPFSSSQSIPVVPRATVLSQVPKATSFAEPPDYSPVTHNVPSPIGEIQPLSPQPSAPIASSPAIDMPPQSETISSPMPQTHVSGTPPPVKASFSSPTVSAPANVNTTSAPPVQTDIVNTSSISDLENQVLQMEKALSLGSLEPNLAGEMINQVSRLLHSPPDMLAPLAQRLLKVVDDIGLQLNFSNTTISLTSPSLALAVIRVNASSFNTTTFVAQDPANLQVSLETQAPENSIGTITLPSSLMNNLPAHDMELASRVQFNFFETPALFQDPSLENLSLISYVISSSVANLTVRNLTRNVTVTLKHINPSQDELTVRCVFWDLGRNGGRGGWSDNGCSVKDRRLNETICTCSHLTSFGVLLDLSRTSVLPAQMMALTFITYIGCGLSSIFLSVTLVTYIAFEKIRRDYPSKILIQLCAALLLLNLVFLLDSWIALYKMQGLCISVAVFLHYFLLVSFTWMGLEAFHMYLALVKVFNTYIRKYILKFCIVGWGVPAVVVTIILTISPDNYGLGSYGKFPNGSPDDFCWINNNAVFYITVVGYFCVIFLLNVSMFIVVLVQLCRIKKKKQLGAQRKTSIQDLRSIAGLTFLLGITWGFAFFAWGPVNVTFMYLFAIFNTLQGFFIFIFYCVAKENVRKQWRRYLCCGKLRLAENSDWSKTATNGLKKQTVNQGVSSSSNSLQSSSNSTNSTTLLVNNDCSVHASGNGNASTERNGVSFSVQNGDVCLHDFTGKQHMFNEKEDSCNGKGRMALRRTSKRGSLHFIEQM

SEQ ID NO: 314 - protein, 549 aa, unidentified
MATPRGLGALLLLLLLPTSGQEKPTEGPRNTCLGSNNMYDIFNLNDKALCFTKCRQSGSDSCNVENLQRYWLNYEAHLMKEGLTQKVNTPFLKALVQNLSTNTAEDFYFSLEPSQVPRQVMKDEDKPPDRVRLPKSLFRSLPGNRSVVRLAVTILDIGPGTLFKGPRLGLGDGSGVLNNRLVGLSVGQMHVTKLAEPLEIVFSHQRPPPNMTLTCVFWDVTKGTTGDWSSEGCSTEVRPEGTVCCCDHLTFFALLLRPTLDQSTVHILTRISQAGCGVSMIFLAFTIILYAFLRLSRERFKSEDAPKIHVALGGSLFLLNLAFLVNVGSGSKGSDAACWARGAVFHYFLLCAFTWMGLEAFHLYLLAVRVFNTYFGHYFLKLSLVGWGLPALMVIGTGSANSYGLYTIRDRENRTSLELCWFREGTTMYALYITVHGYFLITFLFGMVVLALVVWKIFTLSRATAVKERGKNRKKVLTLLGLSSLVGVTWGLAIFTPLGLSTVYIFALFNSLQGVFICCWFTILYLPSQSTTVSSSTARLDQAHSASQE

SEQ ID NO: 315 - protein, 3080 aa, unidentified
MKEHIIYQKLYGLILMSSFIFLSDTLSLKGKKLDFFGRGDTYVSLIDTIPELSRFTACIDLVFMDDNSRYWMAFSYITNNALLGREDIDLGLAGDHQQLILYRLGKTFSIRHHLASFQWHTICLIWDGVKGKLELFLNKERILEVTDQPHNLTPHGTLFLGHFLKNESSEVKSMMRSFPGSLYYFQLWDHILENEEFMKCLDGNIVSWEEDVWLVNKIIPTVDRTLRCFVPENMTIQEKSTTVSQQIDMTTPSQITGVKPQNTAHSSTLLSQSIPIFATDYTTISYSNTTSPPLETMTAQKILKTLVDETATFAVDVLSTSSAISLPTQSISIDNTTNSMKKTKSPSSESTKTTKMVEAMATEIFQPPTPSNFLSTSRFTKNSVVSTTSAIKSQSAVTKTTSLFSTIESTSMSTTPCLKQKSTNTGALPISTAGQEFIESTAAGTVPWFTVEKTSPASTHVGTASSFPPEPVLISTAAPVDSVFPRNQTAFPLATTDMKIAFTVHSLTLPTRLIETTPAPRTAETELTSTNFQDVSLPRVEDAMSTSMSKETSSKTFSFLTSFSFTGTESVQTVIDAEATRTALTPEITLASTVAETMLSSTITGRVYTQNTPTADGHLLTLMSTRSASTSKAPESGPTSTTDEAAHLFSSNETIWTSRPDQALLASMNTTTILTFVPNENFTSAFHENTTYTEYLSATTNITPLKASPEGKGTTANDATTARYTTAVSKLTSPWFANFSIVSGTTSITNMPEFKLTTLLLKTIPMSTKPANELPLTPRETVVPSVDIISTLACIQPNFSTEESASETTQTEINGAIVFGGTTTPVPKSATTQRLNATVTRKEATSHYLMRKSTIAAVAEVSPFSTMLEVTDESAQRVTASVTVSSFPDIEKLSTPLDNKTATTEVRESWLLTKLVKTTPRSSYNEMTEMFNFNHTYVAHWTSETSEGISAGSPTSGSTHIFGEPLGASTTRISETSFSTTPTDRTATSLSDGILPPQPTAAHSSATPVPVTHMFSLPVNGSSVVAEETEVTMSEPSTLARAFSTSVLSDVSNLSSTTMTTALVPPLDQTASTTIVIVPTHGDLIRTTSEATVISVRKTSMAVPSLTETPFHSLRLSTPVTAKAETTLFSTSVDTVTPSTHTLVCSKPPPDNIPPASSTHVISTTSTPEATQPISQVEETSTYALSFPYTFSGGGVVASLATGTTETSVVDETTPSHISANKLTTSVNSHISSSATYRVHTPVSIQLVTSTSVLSSDKDQMTISLGKTPRTMEVTEMSPSKNSFISYSRGTPSLEMTDTGFPETTKISSHQTHSPSEIPLGTPSDGNLASSPTSGSTQITPTLTSSNTVGVHIPEMSTSLGKTALPSQALTITTFLCPEKESTSALPAYTPRTVEMIVNSTYVTHSVSYGQDTSFVDTTTSSSTRISNPMDINTTFSHLHSLRTQPEVTSVASFISESTQTFPESLSLSTAGLYNDGFTVLSDRITTAFSVPNVPTMLPRESSMATSTPIYQMSSLPVNVTAFTSKKVSDTPPIVITKSSKTMHPGCLKSPCTATSGPMSEMSSIPVNNSAFTPATVSSDTSTRVGLFSTLLSSVTPRTTMTMQTSTLDVTPVIYAGATSKNKMVSSAFTTEMIEAPSRITPTTFLSPTEPTLPFVKTVPTTIMAGIVTPFVGTTAFSPLSSKSTGAISSIPKTTFSPFLSATQQSSQADEATTLGILSGITNRSLSTVNSGTGVALTDTYSRITVPENMLSPTHADSLHTSFNIQVSPSLTSFKSASGPTKNVKTTTNCFSSNTRKMTSLLEKTSLTNYATSLNTPVSYPPWTPSSATLPSLTSFVYSPHSTEAEISTPKTSPPPTSQMVEFPVLGTRMTSSNTQPLLMTSWNIPTAEGSQFPISTTINVPTSNEMETETLHLVPGPLSTFTASQTGLVSKDVMAMSSIPMSGILPNHGLSENPSLSTSLRAITSTLADVKHTFEKMTTSVTPGTTLPSILSGATSGSVISKSPILTWLLSSLPSGSPPATVSNAPHVMTSSTVEVSKSTFLTSDMISAHPFTNLTTLPSATMSTILTRTIPTPTLGGITTGFPTSLPMSINVTDDIVYISTHPEASSRTTITANPRTVSHPSSFSRKTMSPSTTDHTLSVGAMPLPSSTITSSWNRIPTASSPSTLIIPKPTLDSLLNIMTTTSTVPGASFPLISTGVTYPFTATVSSPISSFFETTWLDSTPSFLSTEASTSPTATKSTVSFYNVEMSFSVFVEEPRIPITSVINEFTENSLNSIFQNSEFSLATLETQIKSRDISEEEMVMDRAILEQREGQEMATISYVPYSCVCQVIIKASSSLASSELMRKIKSKIHGNFTHGNFTQDQLTLLVNCEHVAVKKLEPGNCKADETASKYKGTYKWLLTNPTETAQTRCIKNEDGNATRFCSISINTGKSQWEKPKFKQCKLLQELPDKIVDLANITISDENAEDVAEHILNLINESPALGKEETKIIVSKISDISQCDEISMNLTHVMLQIINVVLEKQNNSASDLHEISNEILRIIERTGHKMEFSGQIANLTVAGLALAVLRGDHTFDGMAFSIHSYEEGTDPEIFLGNVPVGGILASIYLPKSLTERIPLSNLQTILFNFFGQTSLFKTKNVTKALTTYVVSASISDDMFIQNLADPVVITLQHIGGNQNYGQVHCAFWDFENNNGLGGWNSSGCKVKETNVNYTICQCDHLTHFGVLMDLSRSTVDSVNEQILALITYTGCGISSIFLGVAVVTYIAFHKLRKDYPAKILINLCTALLMLNLVFLINSWLSSFQKVGVCITAAVALHYFLLVSFTWMGLEAVHMYLALVKVFNIYIPNYILKFCLVGWGIPAIMVAITVSVKKDLYGTLSPTTPFCWIKDDSIFYISVVAYFCLIFLMNLSMFCTVLVQLNSVKSQIQKTRRKMILHDLKGTMSLTFLLGLTWGFAFFAWGPMRNFFLYLFAIFNTLQGFFIFVFHCVMKESVREQWQIHLCCGWLRLDNSSDGSSRCQIKVGYKQEGLKKIFEHKLLTPSLKSTATSSTFKSLGSAQGTPSEISFPNDDFDKDPYCSSP

SEQ ID NO: 316 - protein, 528 aa, unidentified
MDHCGALFLCLCLLTLQNATTETWEELLSYMENMQVSRGRSSVFSSRQLHQLEQMLLNTSFPGYNLTLQTPTIQSLAFKLSCDFSGLSLTSATLKRVPQAGGQHARGQHAMQFPAELTRDACKTRPRELRLICIYFSNTHFFKDENNSSLLNNYVLGAQLSHGHVNNLRDPVNISFWHNQSLEGYTLTCVFWKEGARKQPWGGWSPEGCRTEQPSHSQVLCRCNHLTYFAVLMQLSPALVPAELLAPLTYISLVGCSISIVASLITVLLHFHFRKQSDSLTRIHMNLHASVLLLNIAFLLSPAFAMSPVPGSACTALAAALHYALLSCLTWMAIEGFNLYLLLGRVYNIYIRRYVFKLGVLGWGAPALLVLLSLSVKSSVYGPCTIPVFDSWENGTGFQNMSICWVRSPVVHSVLVMGYGGLTSLFNLVVLAWALWTLRRLRERADAPSVRACHDTVTVLGLTVLLGTTWALAFFSFGVFLLPQLFLFTILNSLYGFFLFLWFCSQRCRSEAEAKAQIEAFSSSQTTQ

SEQ ID NO: 317 - protein, 1221 aa, unidentified
MMFRSDRMWSCHWKWKPSPLLFLFALYIMCVPHSVWGCANCRVVLSNPSGTFTSPCYPNDYPNSQACMWTLRAPTGYIIQITFNDFDIEEAPNCIYDSLSLDNGESQTKFCGATAKGLSFNSSANEMHVSFSSDFSIQKKGFNASYIRVAVSLRNQKVILPQTSDAYQVSVAKSISIPELSAFTLCFEATKVGHEDSDWTAFSYSNASFTQLLSFGKAKSGYFLSISDSKCLLNNALPVKEKEDIFAESFEQLCLVWNNSLGSIGVNFKRNYETVPCDSTISKVIPGNGKLLLGSNQNEIVSLKGDIYNFRLWNFTMNAKILSNLSCNVKGNVVDWQNDFWNIPNLALKAESNLSCGSYLIPLPAAELASCADLGTLCQATVNSPSTTPPTVTTNMPVTNRIDKQRNDGIIYRISVVIQNILRHPEVKVQSKVAEWLNSTFQNWNYTVYVVNISFHLSAGEDKIKVKRSLEDEPRLVLWALLVYNATNNTNLEGKIIQQKLLKNNESLDEGLRLHTVNVRQLGHCLAMEEPKGYYWPSIQPSEYVLPCPDKPGFSASRICFYNATNPLVTYWGPVDISNCLKEANEVANQILNLTADGQNLTSANITNIVEQVKRIVNKEENIDITLGSTLMNIFSNILSSSDSDLLESSSEALKTIDELAFKIDLNSTSHVNITTRNLALSVSSLLPGTNAISNFSIGLPSNNESYFQMDFESGQVDPLASVILPPNLLENLSPEDSVLVRRAQFTFFNKTGLFQDVGPQRKTLVSYVMACSIGNITIQNLKDPVQIKIKHTRTQEVHHPICAFWDLNKNKSFGGWNTSGCVAHRDSDASETVCLCNHFTHFGVLMDLPRSASQLDARNTKVLTFISYIGCGISAIFSAATLLTYVAFEKLRRDYPSKILMNLSTALLFLNLLFLLDGWITSFNVDGLCIAVAVLLHFFLLATFTWMGLEAIHMYIALVKVFNTYIRRYILKFCIIGWGLPALVVSVVLASRNNNEVYGKESYGKEKGDEFCWIQDPVIFYVTCAGYFGVMFFLNIAMFIVVMVQICGRNGKRSNRTLREEVLRNLRSVVSLTFLLGMTWGFAFFAWGPLNIPFMYLFSIFNSLQGLFIFIFHCAMKENVQKQWRQHLCCGRFRLADNSDWSKTATNIIKKSSDNLGKSLSSSSIGSNSTYLTSKSKSSSTTYFKRNSHTDNVSYEHSFNKSGSLRQCFHGQVLVKTGPC

SEQ ID NO: 318 - protein, 797 aa, unidentified
MASCRAWNLRVLVAVVCGLLTGIILGLGIWRIVIRIQRGKSTSSSSTPTEFCRNGGTWENGRCICTEEWKGLRCTIANFCENSTYMGFTFARIPVGRYGPSLQTCGKDTPNAGNPMAVRLCSLSLYGEIELQKVTIGNCNENLETLEKQVKDVTAPLNNISSEVQILTSDANKLTAENITSATRVVGQIFNTSRNASPEAKKVAIVTVSQLLDASEDAFQRVAATANDDALTTLIEQMETYSLSLGNQSVVEPNIAIQSANFSSENAVGPSNVRFSVQKGASSSLVSSSTFIHTNVDGLNPDAQTELQVLLNMTKNYTKTCGFVVYQNDKLFQSKTFTAKSDFSQKIISSKTDENEQDQSASVDMVFSPKYNQKEFQLYSYACVYWNLSAKDWDTYGCQKDKGTDGFLRCRCNHTTNFAVLMTFKKDYQYPKSLDILSNVGCALSVTGLALTVIFQIVTRKVRKTSVTWVLVNLCISMLIFNLLFVFGIENSNKNLQTSDGDINNIDFDNNDIPRTDTINIPNPMCTAIAALLHYFLLVTFTWNALSAAQLYYLLIRTMKPLPRHFILFISLIGWGVPAIVVAITVGVIYSQNGNNPQWELDYRQEKICWLAIPEPNGVIKSPLLWSFIVPVTIILISNVVMFITISIKVLWKNNQNLTSTKKVSSMKKIVSTLSVAVVFGITWILAYLMLVNDDSIRIVFSYIFCLFNTTQGLQIFILYTVRTKVFQSEASKVLMLLSSIGRRKSLPSVTRPRLRVKMYNFLRSLPTLHERFRLLETSPSTEEITLSESDNAKESI

SEQ ID NO: 319 - protein, 1474 aa, unidentified
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYHDTSPYRWGGKTDIDLAVDENGLWVIYATEGNNGRLVVSQLNPYTLRFEGTWETGYDKRSASNAFMVCGVLYVLRSVYVDDDSEAAGNRVDYAFNTNANREEPVSLTFPNPYQFISSVDYNPRDNQLYVWNNYFVVRYSLEFGPPDPSAGPATSPPLSTTTTARPTPLTSTASPAATTPLRRAPLTTHPVGAINQLGPDLPPATAPVPSTRRPPAPNLHVSPELFCEPREVRRVQWPATQQGMLVERPCPKGTRGIASFQCLPALGLWNPRGPDLSNCTSPWVNQVAQKIKSGENAANIASELARHTRGSIYAGDVSSSVKLMEQLLDILDAQLQALRPIERESAGKNYNKMHKRERTCKDYIKAVVETVDNLLRPEALESWKDMNATEQVHTATMLLDVLEEGAFLLADNVREPARFLAAKENVVLEVTVLNTEGQVQELVFPQEEYPRKNSIQLSAKTIKQNSRNGVVKVVFILYNNLGLFLSTENATVKLAGEAGPGGPGGASLVVNSQVIAASINKESSRVFLMDPVIFTVAHLEDKNHFNANCSFWNYSERSMLGYWSTQGCRLVESNKTHTTCACSHLTNFAVLMAHREIYQGRINELLLSVITWVGIVISLVCLAICISTFCFLRGLQTDRNTIHKNLCINLFLAELLFLVGIDKTQYEIACPIFAGLLHYFFLAAFSWLCLEGVHLYLLLVEVFESEYSRTKYYYLGGYCFPALVVGIAAAIDYRSYGTEKACWLRVDNYFIWSFIGPVSFVIVVNLVFLMVTLHKMIRSSSVLKPDSSRLDNIKSWALGAIALLFLLGLTWAFGLLFINKESVVMAYLFTTFNAFQGVFIFVFHCALQKKVHKEYSKCLRHSYCCIRSPPGGTHGSLKTSAMRSNTRYYTGTQSRIRRMWNDTVRKQTESSFMAGDINSTPTLNRGTMGNHLLTNPVLQPRGGTSPYNTLIAESVGFNPSSPPVFNSPGSYREPKHPLGGREACGMDTLPLNGNFNNSYSLRSGDFPPGDGGPEPPRGRNLADAAAFEKMIISELVHNNLRGSSSAAKGPPPPEPPVPPVPGGGGEEEAGGPGGADRAEIELLYKALEEPLLLPRAQSVLYQSDLDESESCTAEDGATSRPLSSPPGRDSLYASGANLRDSPSYPDSSPEGPSEALPPPPPAPPGPPEIYYTSRPPALVARNPLQGYYQVRRPSHEGYLAAPGLEGPGPDGDGQMQLVTSL

SEQ ID NO: 320 - protein, 1459 aa, unidentified
MVSSGCRMRSLWFIIVISFLPNTEGFSRAALPFGLVRRELSCEGYSIDLRCPGSDVIMIESANYGRTDDKICDADPFQMENTDCYLPDAFKIMTQRCNNRTQCIVVTGSDVFPDPCPGTYKYLEVQYECVPYIFVCPGTLKAIVDSPCIYEAEQKAGAWCKDPLQAADKIYFMPWTPYRTDTLIEYASLEDFQNSRQTTTYKLPNRVDGTGFVVYDGAVFFNKERTRNIVKFDLRTRIKSGEAIINYANYHDTSPYRWGGKTDIDLAVDENGLWVIYATEQNNGMIVISQLNPYTLRFEATWETVYDKRAASNAFMICGVLYVVRSVYQDNESETGKNSIDYIYNTRLNRGEYVDVPFPNQYQYIAAVDYNPRDNQLYVWNNNFILRYSLEFGPPDPAQVPTTAVTITSSAELFKTIISTTSTTSQKGPMSTTVAGSQEGSKGTKPPPAVSTTKIPPITNIFPLPERFCEALDSKGIKWPQTQRGMMVERPCPKGTRGTASYLCMISTGTWNPKGPDLSNCTSHWVNQLAQKIRSGENAASLANELAKHTKGPVFAGDVSSSVRLMEQLVDILDAQLQELKPSEKDSAGRSYNKLQKREKTCRAYLKAIVDTVDNLLRPEALESWKHMNSSEQAHTATMLLDTLEEGAFVLADNLLEPTRVSMPTENIVLEVAVLSTEGQIQDFKFPLGIKGAGSSIQLSANTVKQNSRNGLAKLVFIIYRSLGQFLSTENATIKLGADFIGRNSTIAVNSHVISVSINKESSRVYLTDPVLFTLPHIDPDNYFNANCSFWNYSERTMMGYWSTQGCKLVDTNKTRTTCACSHLTNFAILMAHREIAYKDGVHELLLTVITWVGIVISLVCLAICIFTFCFFRGLQSDRNTIHKNLCINLFIAEFIFLIGIDKTKYAIACPIFAGLLHFFFLAAFAWMCLEGVQLYLMLVEVFESEYSRKKYYYVAGYLFPATVVGVSAAIDYKSYGTEKACWLHVDNYFIWSFIGPVTFIILLNIIFLVITLCKMVKHSNTLKPDSSRLENIKSWVLGAFALLCLLGLTWSFGLLFINEETIVMAYLFTIFNAFQGVFIFIFHCALQKKVRKEYGKCFRHSYCCGGLPTESPHSSVKASTTRTSARYSSGTQSRIRRMWNDTVRKQSESSFISGDINSTSTLNQGMTGNYLLTNPLLRPHGTNNPYNTLLAETVVCNAPSAPVFNSPGHSLNNARDTSAMDTLPLNGNFNNSYSLHKGDYNDSVQVVDCGLSLNDTAFEKMIISELVHNNLRGSSKTHNLELTLPVKPVIGGSSSEDDAIVADASSLMHSDNPGLELHHKELEAPLIPQRTHSLLYQPQKKVKSEGTDSYVSQLTAEAEDHLQSPNRDSLYTSMPNLRDSPYPESSPDMEEDLSPSRRSENEDIYYKSMPNLGAGHQLQMCYQISRGNSDGYIIPINKEGCIPEGDVREGQMQLVTSL

SEQ ID NO: 321 - protein, 1447 aa, unidentified
MWPSQLLIFMMLLAPIIHAFSRAPIPMAVVRRELSCESYPIELRCPGTDVIMIESANYGRTDDKICDSDPAQMENIRCYLPDAYKIMSQRCNNRTQCAVVAGPDVFPDPCPGTYKYLEVQYECVPYKVEQKVFLCPGLLKGVYQSEHLFESDHQSGAWCKDPLQASDKIYYMPWTPYRTDTLTEYSSKDDFIAGRPTTTYKLPHRVDGTGFVVYDGALFFNKERTRNIVKFDLRTRIKSGEAIIANANYHDTSPYRWGGKSDIDLAVDENGLWVIYATEQNNGKIVISQLNPYTLRIEGTWDTAYDKRSASNAFMICGILYVVKSVYEDDDNEATGNKIDYIYNTDQSKDSLVDVPFPNSYQYIAAVDYNPRDNLLYVWNNYHVVKYSLDFGPLDSRSGQAHHGQVSYISPPIHLDSELERPSVKDISTTGPLGMGSTTTSTTLRTTTLSPGRSTTPSVSGRRNRSTSTPSPAVEVLDDMTTHLPSASSQIPALEESCEAVEAREIMWFKTRQGQIAKQPCPAGTIGVSTYLCLAPDGIWDPQGPDLSNCSSPWVNHITQKLKSGETAANIARELAEQTRNHLNAGDITYSVRAMDQLVGLLDVQLRNLTPGGKDSAARSLNKAMVETVNNLLQPQALNAWRDLTTSDQLRAATMLLHTVEESAFVLADNLLKTDIVRENTDNIKLEVARLSTEGNLEDLKFPENMGHGSTIQLSANTLKQNGRNGEIRVAFVLYNNLGPYLSTENASMKLGTEALSTNHSVIVNSPVITAAINKEFSNKVYLADPVVFTVKHIKQSEENFNPNCSFWSYSKRTMTGYWSTQGCRLLTTNKTHTTCSCNHLTNFAVLMAHVEVKHSDAVHDLLLDVITWVGILLSLVCLLICIFTFCFFRGLQSDRNTIHKNLCISLFVAELLFLIGINRTDQPIACAVFAALLHFFFLAAFTWMFLEGVQLYIMLVEVFESEHSRRKYFYLVGYGMPALIVAVSAAVDYRSYGTDKVCWLRLDTYFIWSFIGPATLIIMLNVIFLGIALYKMFHHTAILKPESGCLDNIKSWVIGAIALLCLLGLTWAFGLMYINESTVIMAYLFTIFNSLQGMFIFIFHCVLQKKVRKEYGKCLRTHCCSGKSTESSIGSGKTSGSRTPGRYSTGSQSRIRRMWNDTVRKQSESSFITGDINSSASLNREGLLNNARDTSVMDTLPLNGNHGNSYSIASGEYLSNCVQIIDRGYNHNETALEKKILKELTSNYIPSYLNNHERSSEQNRNLMNKLVNNLGSGREDDAIVLDDATSFNHEESLGLELIHEESDAPLLPPRVYSTENHQPHHYTRRRIPQDHSESFFPLLTNEHTEDLQSPHRDSLYTSMPTLAGVAATESVTTSTQTEPPPAKCGDAEDVYYKSMPNLGSRNHVHQLHTYYQLGRGSSDGFIVPPNKDGTPPEGSSKGPAHLVTSL

SEQ ID NO: 322 - protein, 690 aa, unidentified
MKRLPLLVVFSTLLNCSYTQNCTKTPCLPNAKCEIRNGIEACYCNMGFSGNGVTICEDDNECGNLTQSCGENANCTNTEGSYYCMCVPGFRSSSNQDRFITNDGTVCIENVNANCHLDNVCIAANINKTLTKIRSIKEPVALLQEVYRNSVTDLSPTDIITYIEILAESSSLLGYKNNTISAKDTLSNSTLTEFVKTVNNFVQRDTFVVWDKLSVNHRRTHLTKLMHTVEQATLRISQSFQKTTEFDTNSTDIALKVFFFDSYNMKHIHPHMNMDGDYINIFPKRKAAYDSNGNVAVAFVYYKSIGPLLSSSDNFLLKPQNYDNSEEEERVISSVISVSMSSNPPTLYELEKITFTLSHRKVTDRYRSLCAFWNYSPDTMNGSWSSEGCELTYSNETHTSCRCNHLTHFAILMSSGPSIGIKDYNILTRITQLGIIISLICLAICIFTFWFFSEIQSTRTTIHKNLCCSLFLAELVFLVGINTNTNKLFCSIIAGLLHYFFLAAFAWMCIEGIHLYLIVVGVIYNKGFLHKNFYIFGYLSPAVVVGFSAALGYRYYGTTKVCWLSTENNFIWSFIGPACLIILVNLLAFGVIIYKVFRHTAGLKPEVSCFENIRSCARGALALLFLLGTTWIFGVLHVVHASVVTAYLFTVSNAFQGMFIFLFLCVLSRKIQEEYYRLFKNVPCCFGCLR

SEQ ID NO: 323 - protein, 6306 aa, unidentified
MSVFLGPGMPSASLLVNLLSALLILFVFGETEIRFTGQTEFVVNETSTTVIRLIIERIGEPANVTAIVSLYGEDAGDFFDTYAAAFIPAGETNRTVYIAVCDDDLPEPDETFIFHLTLQKPSANVKLGWPRTVTVTILSNDNAFGIISFNMLPSIAVSEPKGRNESMPLTLIREKGTYGMVMVTFEVEGGPNPPDEDLSPVKGNITFPPGRATVIYNLTVLDDEVPENDEIFLIQLKSVEGGAEINTSRNSIEIIIKKNDSPVRFLQSIYLVPEEDHILIIPVVRGKDNNGNLIGSDEYEVSISYAVTTGNSTAHAQQNLDFIDLQPNTTVVFPPFIHESHLKFQIVDDTIPEIAESFHIMLLKDTLQGDAVLISPSVVQVTIKPNDKPYGVLSFNSVLFERTVIIDEDRISRYEEITVVRNGGTHGNVSANWVLTRNSTDPSPVTADIRPSSGVLHFAQGQMLATIPLTVVDDDLPEEAEAYLLQILPHTIRGGAEVSEPAELLFYIQDSDDVYGLITFFPMENQKIESSPGERYLSLSFTRLGGTKGDVRLLYSVLYIPAGAVDPLQAKEGILNISRRNDLIFPEQKTQVTTKLPIRNDAFLQNGAHFLVQLETVELLNIIPLIPPISPRFGEICNISLLVTPAIANGEIGFLSNLPIILHEPEDFAAEVVYIPLHRDGTDGQATVYWSLKPSGFNSKAVTPDDIGPFNGSVLFLSGQSDTTINITIKGDDIPEMNETVTLSLDRVNVENQVLKSGYTSRDLIILENDDPGGVFEFSPASRGPYVIKEGESVELHIIRSRGSLVKQFLHYRVEPRDSNEFYGNTGVLEFKPGEREIVITLLARLDGIPELDEHYWVVLSSHGERESKLGSATIVNITILKNDDPHGIIEFVSDGLIVMINESKGDAIYSAVYDVVRNRGNFGDVSVSWVVSPDFTQDVFPVQGTVVFGDQEFSKNITIYSLPDEIPEEMEEFTVILLNGTGGAKVGNRTTATLRIRRNDDPIYFAEPRVVRVQEGETANFTVLRNGSVDVTCMVQYATKDGKATARERDFIPVEKGETLIFEVGSRQQSISIFVNEDGIPETDEPFYIILLNSTGDTVVYQYGVATVIIEANDDPNGIFSLEPIDKAVEEGKTNAFWILRHRGYFGSVSVSWQLFQNDSALQPGQEFYETSGTVNFMDGEEAKPIILHAFPDKIPEFNEFYFLKLVNISGGSPGPGGQLAETNLQVTVMVPFNDDPFGVFILDPECLEREVAEDVLSEDDMSYITNFTILRQQGVFGDVQLGWEILSSEFPAGLPPMIDFLLVGIFPTTVHLQQHMRRHHSGTDALYFTGLEGAFGTVNPKYHPSRNNTIANFTFSAWVMPNANTNGFIIAKDDGNGSIYYGVKIQTNESHVTLSLHYKTLGSNATYIAKTTVMKYLEESVWLHLLIILEDGIIEFYLDGNAMPRGIKSLKGEAITDGPGILRIGAGINGNDRFTGLMQDVRSYERKLTLEEIYELHAMPAKSDLHPISGYLEFRQGETNKSFIISARDDNDEEGEELFILKLVSVYGGARISEENTTARLTIQKSDNANGLFGFTGACIPEIAEEGSTISCVVERTRGALDYVHVFYTISQIETDGINYLVDDFANASGTITFLPWQRSEVLNIYVLDDDIPELNEYFRVTLVSAIPGDGKLGSTPTSGASIDPEKETTDITIKASDHPYGLLQFSTGLPPQPKDAMTLPASSVPHITVEEEDGEIRLLVIRAQGLLGRVTAEFRTVSLTAFSPEDYQNVAGTLEFQPGERYKYIFINITDNSIPELEKSFKVELLNLEGGVAELFRVDGSGSGDGDMEFFLPTIHKRASLGVASQILVTIAASDHAHGVFEFSPESLFVSGTEPEDGYSTVTLNVIRHHGTLSPVTLHWNIDSDPDGDLAFTSGNITFEIGQTSANITVEILPDEDPELDKAFSVSVLSVSSGSLGAHINATLTVLASDDPYGIFIFSEKNRPVKVEEATQNITLSIIRLKGLMGKVLVSYATLDDMEKPPYFPPNLARATQGRDYIPASGFALFGANQSEATIAISILDDDEPERSESVFIELLNSTLVAKVQSRSIPNSPRLGPKVETIAQLIIIANDDAFGTLQLSAPIVRVAENHVGPIINVTRTGGAFADVSVKFKAVPITAIAGEDYSIASSDVVLLEGETSKAVPIYVINDIYPELEESFLVQLMNETTGGARLGALTEAVIIIEASDDPYGLFGFQITKLIVEEPEFNSVKVNLPIIRNSGTLGNVTVQWVATINGQLATGDLRVVSGNVTFAPGETIQTLLLEVLADDVPEIEEVIQVQLTDASGGGTIGLDRIANIIIPANDDPYGTVAFAQMVYRVQEPLERSSCANITVRRSGGHFGRLLLFYSTSDIDVVALAMEEGQDLLSYYESPIQGVPDPLWRTWMNVSAVGEPLYTCATLCLKEQACSAFSFFSASEGPQCFWMTSWISPAVNNSDFWTYRKNMTRVASLFSGQAVAGSDYEPVTRQWAIMQEGDEFANLTVSILPDDFPEMDESFLISLLEVHLMNISASLKNQPTIGQPNISTVVIALNGDAFGVFVIYNISPNTSEDGLFVEVQEQPQTLVELMIHRTGGSLGQVAVEWRVVGGTATEGLDFIGAGEILTFAEGETKKTVILTILDDSEPEDDESIIVSLVYTEGGSRILPSSDTVRVNILANDNVAGIVSFQTASRSVIGHEGEILQFHVIRTFPGRGNVTVNWKIIGQNLELNFANFSGQLFFPEGSLNTTLFVHLLDDNIPEEKEVYQVILYDVRTQGVPPAGIALLDAQGYAAVLTVEASDEPHGVLNFALSSRFVLLQEANITIQLFINREFGSLGAINVTYTTVPGMLSLKNQTVGNLAEPEVDFVPIIGFLILEEGETAAAINITILEDDVPELEEYFLVNLTYVGLTMAASTSFPPRLDSEGLTAQVIIDANDGARGVIEWQQSRFEVNETHGSLTLVAQRSREPLGHVSLFVYAQNLEAQVGLDYIFTPMILHFADGERYKNVNIMILDDDIPEGDEKFQLILTNPSPGLELGKNTIALIIVLANDDGPGVLSFNNSEHFFLREPTALYVQESVAVLYIVREPAQGLFGTVTVQFIVTEVNSSNESKDLTPSKGYIVLEEGVRFKALQISAILDTEPEMDEYFVCTLFNPTGGARLGVHVQTLITVLQNQAPLGLFSISAVENRATSIDIEEANRTVYLNVSRTNGIDLAVSVQWETVSETAFGMRGMDVVFSVFQSFLDESASGWCFFTLENLIYGIMLRKSSVTVYRWQGIFIPVEDLNIENPKTCEAFNIGFSPYFVITHEERNEEKPSLNSVFTFTSGFKLFLVQTIIILESSQVRYFTSDSQDYLIIASQRDDSELTQVFRWNGGSFVLHQKLPVRGVLTVALFNKGGSVFLAISQANARLNSLLFRWSGSGFINFQEVPVSGTTEVEALSSANDIYLIFAENVFLGDQNSIDIFIWEMGQSSFRYFQSVDFAAVNRIHSFTPASGIAHILLIGQDMSALYCWNSERNQFSFVLEVPSAYDVASVTVKSLNSSKNLIALVGAHSHIYELAYISSHSDFIPSSGELIFEPGEREATIAVNILDDTVPEKEESFKVQLKNPKGGAEIGINDSVTITILSNDDAYGIVAFAQNSLYKQVEEMEQDSLVTLNVERLKGTYGRITIAWEADGSISDIFPTSGVILFTEGQVLSTITLTILADNIPELSEVVIVTLTRITTEGVEDSYKGATIDQDRSKSVITTLPNDSPFGLVGWRAASVFIRVAEPKENTTTLQLQIARDKGLLGDIAIHLRAQPNFLLHVDNQATENEDYVLQETIIIMKENIKEAHAEVSILPDDLPELEEGFIVTITEVNLVNSDFSTGQPSVRRPGMEIAEIMIEENDDPRGIFMFHVTRGAGEVITAYEVPPPLNVLQVPVVRLAGSFGAVNVYWKASPDSAGLEDFKPSHGILEFADKQVTAMIEITIIDDAEFELTETFNISLISVAGGGRLGDDVVVTVVIPQNDSPFGVFGFEEKTVMIDESLSSDDPDSYVTLTVVRSPGGKGTVRLEWTIDEKAKHNLSPLNGTLHFDETESQKTIVLHTLQDTVLEEDRRFTIQLISIDEVEISPVKGSASIIIRGDKRASGEVGIAPSSRHILIGEPSAKYNGTAIISLVRGPGILGEVTVFWRIFPPSVGEFAETSGKLTMRDEQSAVIVVIQALNDDIPEEKSFYEFQLTAVSEGGVLSESSSTANITVVASDSPYGRFAFSHEQLRVSEAQRVNITIIRSSGDFGHVRLWYKTMSGTAEAGLDFVPAAGELLFEAGEMRKSLHVEILDDDYPEGPEEFSLTITKVELQGRGYDFTIQENGLQIDQPPEIGNISIVRIIIMKNDNAEGIIEFDPKYTAFEVEEDVGLIMIPVVRLHGTYGYVTADFISQSSSASPGGVDYILHGSTVTFQHGQNLSFINISIIDDNESEFEEPIEILLTGATGGAVLGRHLVSRIIIAKSDSPFGVIRFLNQSKISIANPNSTMILSLVLERTGGLLGEIQVNWETVGPNSQEALLPQNRDIADPVSGLFYFGEGEGGVRTIILTIYPHEEIEVEETFIIKLHLVKGEAKLDSRAKDVTLTIQEFGDPNGVVQFAPETLSKKTYSEPLALEGPLLITFFVRRVKGTFGEIMVYWELSSEFDITEDFLSTSGFFTIADGESEASFDVHLLPDEVPEIEEDYVIQLVSVEGGAELDLEKSITWFSVYANDDPHGVFALYSDRQSILIGQNLIRSIQINITRLAGTFGDVAVGLRISSDHKEQPIVTENAERQLVVKDGATYKVDVVPIKNQVFLSLGSNFTLQLVTVMLVGGRFYGMPTILQEAKSAVLPVSEKAANSQVGFESTAFQLMNITAGTSHVMISRRGTYGALSVAWTTGYAPGLEIPEFIVVGNMTPTLGSLSFSHGEQRKGVFLWTFPSPGWPEAFVLHLSGVQSSAPGGAQLRSGFIVAEIEPMGVFQFSTSSRNIIVSEDTQMIRLHVQRLFGFHSDLIKVSYQTTAGSAKPLEDFEPVQNGELFFQKFQTEVDFEITIINDQLSEIEEFFYINLTSVEIRGLQKFDVNWSPRLNLDFSVAVITILDNDDLAGMDISFPETTVAVAVDTTLIPVETESTTYLSTSKTTTILQPTNVVAIVTEATGVSAIPEKLVTLHGTPAVSEKPDVATVTANVSIHGTFSLGPSIVYIEEEMKNGTFNTAEVLIRRTGGFTGNVSITVKTFGERCAQMEPNALPFRGIYGISNLTWAVEEEDFEEQTLTLIFLDGERERKVSVQILDDDEPEGQEFFYVFLTNPQGGAQIVEEKDDTGFAAFAMVIITGSDLHNGIIGFSEESQSGLELREGAVMRRLHLIVTRQPNRAFEDVKVFWRVTLNKTVVVLQKDGVNLVEELQSVSGTTTCTMGQTKCFISIELKPEKVPQVEVYFFVELYEATAGAAINNSARFAQIKILESDESQSLVYFSVGSRLAVAHKKATLISLQVARDSGTGLMMSVNFSTQELRSAETIGRTIISPAISGKDFVITEGTLVFEPGQRSTVLDVILTPETGSLNSFPKRFQIVLFDPKGGARIDKVYGTANITLVSDADSQAIWGLADQLHQPVNDDILNRVLHTISMKVATENTDEQLSAMMHLIEKITTEGKIQAFSVASRTLFYEILCSLINPKRKDTRGFSHFAEVTENFAFSLLTNVTCGSPGEKSKTILDSCPYLSILALHWYPQQINGHKFEGKEGDYIRIPERLLDVQDAEIMAGKSTCKLVQFTEYSSQQWFISGNNLPTLKNKVLSLSVKGQSSQLLTNDNEVLYRIYAAEPRIIPQTSLCLLWNQAAASWLSDSQFCKVVEETADYVECACSHMSVYAVYARTDNLSSYNEAFFTSGFICISGLCLAVLSHIFCARYSMFAAKLLTHMMAASLGTQILFLASAYASPQLAEESCSAMAAVTHYLYLCQFSWMLIQSVNFWYVLVMNDEHTERRYLLFFLLSWGLPAFVVILLIVILKGIYHQSMSQIYGLIHGDLCFIPNVYAALFTAALVPLTCLVVVFVVFIHAYQVKPQWKAYDDVFRGRTNAAEIPLILYLFALISVTWLWGGLHMAYRHFWMLVLFVIFNSLQGLYVFMVYFILHNQMCCPMKASYTVEMNGHPGPSTAFFTPGSGMPPAGGEISKSTQNLIGAMEEVPPDWERASFQQGSQASPDLKPSPQNGATFPSSGGYGQGSLIADEESQEFDDLIFALKTGAGLSVSDNESGQGSQEGGTLTDSQIVELRRIPIADTHL

SEQ ID NO: 324 - protein, 80 aa, unidentified
MKYPLMPLVNDLTFSFLVFWFCLPVGLLLLLIIWLRFLLSQDSEENDSSVCLDWEPWSKGPAEFCWKGTLHGQEKERPCW

SEQ ID NO: 325 - protein, 375 aa, unidentified
MSSHKGSVVAQGNGAPASNREADTVELAELGPLLEEKGKRVIANPPKAEEEQTCPVPQEEEEEVRVLTLPLQAHHAMEKMEEFVYKVWEGRWRVIPYDVLPDWLKDNDYLLHGHRPPMPSFRACFKSIFRIHTETGNIWTHLLGFVLFLFLGILTMLRPNMYFMAPLQEKVVFGMFFLGAVLCLSFSWLFHTVYCHSEKVSRTFSKLDYSGIALLIMGSFVPWLYYSFYCSPQPRLIYLSIVCVLGISAIIVAQWDRFATPKHRQTRAGVFLGLGLSGVVPTMHFTIAEGFVKATTVGQMGWFFLMAVMYITGAGLYAARIPERFFPGKFDIWFQSHQIFHVLVVAAAFVHFYGVSNLQEFRYGLEGGCTDDTLL

SEQ ID NO: 326 - protein, 386 aa, unidentified
MNEPTENRLGCSRTPEPDIRLRKGHQLDGTRRGDNDSHQGDLEPILEASVLSSHHKKSSEEHEYSDEAPQEDEGFMGMSPLLQAHHAMEKMEEFVCKVWEGRWRVIPHDVLPDWLKDNDFLLHGHRPPMPSFRACFKSIFRIHTETGNIWTHLLGCVFFLCLGIFYMFRPNISFVAPLQEKVVFGLFFLGAILCLSFSWLFHTVYCHSEGVSRLFSKLDYSGIALLIMGSFVPWLYYSFYCNPQPCFIYLIVICVLGIAAIIVSQWDMFATPQYRGVRAGVFLGLGLSGIIPTLHYVISEGFLKAATIGQIGWLMLMASLYITGAALYAARIPERFFPGKCDIWFHSHQLFHIFVVAGAFVHFHGVSNLQEFRFMIGGGCSEEDAL

SEQ ID NO: 327 - protein, 326 aa, unidentified
MPPSISAFQAAYIGIEVLIALVSVPGNVLVIWAVKVNQALRDATFCFIVSLAVADVAVGALVIPLAILINIGPQTYFHTCLMVACPVLILTQSSILALLAIAVDRYLRVKIPLRYKMVVTPRRAAVAIAGCWILSFVVGLTPMFGWNNLSAVERAWAANGSMGEPVIKCEFEKVISMEYMVYFNFFVWVLPPLLLMVLIYLEVFYLIRKQLNKKVSASSGDPQKYYGKELKIAKSLALILFLFALSWLPLHILNCITLFCPSCHKPSILTYIAIFLTHGNSAMNPIVYAFRIQKFRVTFLKIWNDHFRCQPAPPIDEDLPEERPDD

SEQ ID NO: 328 - protein, 412 aa, unidentified
MPIMGSSVYITVELAIAVLAILGNVLVCWAVWLNSNLQNVTNYFVVSLAAADIAVGVLAIPFAITISTGFCAACHGCLFIACFVLVLTQSSIFSLLAIAIDRYIAIRIPLRYNGLVTGTRAKGIIAICWVLSFAIGLTPMLGWNNCGQPKEGKNHSQGCGEGQVACLFEDVVPMNYMVYFNFFACVLVPLLLMLGVYLRIFLAARRQLKQMESQPLPGERARSTLQKEVHAAKSLAIIVGLFALCWLPLHIINCFTFFCPDCSHAPLWLMYLAIVLSHTNSVVNPFIYAYRIREFRQTFRKIIRSHVLRQQEPFKAAGTSARVLAAHGSDGEQVSLRLNGHPPGVWANGSAPHPERRPNGYALGLVSGGSAQESQGNTGLPDVELLSHELKGVCPEPPGLDDPLAQDGAGVS

SEQ ID NO: 329 - protein, 332 aa, unidentified
MLLETQDALYVALELVIAALSVAGNVLVCAAVGTANTLQTPTNYFLVSLAAADVAVGLFAIPFAITISLGFCTDFYGCLFLACFVLVLTQSSIFSLLAVAVDRYLAICVPLRYKSLVTGTRARGVIAVLWVLAFGIGLTPFLGWNSKDSATNNCTEPWDGTTNESCCLVKCLFENVVPMSYMVYFNFFGCVLPPLLIMLVIYIKIFLVACRQLQRTELMDHSRTTLQREIHAAKSLAMIVGIFALCWLPVHAVNCVTLFQPAQGKNKPKWAMNMAILLSHANSVVNPIVYAYRNRDFRYTFHKIISRYLLCQADVKSGNGQAGVQPALGVGL

SEQ ID NO: 330 - protein, 342 aa, unidentified
MDDKPNPEALSDSSERLFSFGVIADVQFADLEDGFNFQGTRRRYYRHSLLHLQGAIEDWNNESSMPCCVLQLGDIIDGYNAQYNASKKSLELVMDMFKRLKVPVHHTWGNHEFYNFSREYLTHSKLNTKFLEDQIVHHPETMPSEDYYAYHFVPFPKFRFILLDAYDLSVLGVDQSSPKYEQCMKILREHNPNTELNSPQGLSEPQFVQFNGGFSQEQLNWLNEVLTFSDTNQEKVVIVSHLPIYPDASDNVCLAWNYRDALAVIWSHECVVCFFAGHTHDGGYSEDPFGVYHVNLEGVIETAPDSQAFGTVHVYPDKMMLKGRGRVPDRIMNYKKERAFHC

SEQ ID NO: 331 - protein, 466 aa, unidentified
MVFLSGNASDSSNCTQPPAPVNISKAILLGVILGGLILFGVLGNILVILSVACHRHLHSVTHYYIVNLAVADLLLTSTVLPFSAIFEVLGYWAFGRVFCNIWAAVDVLCCTASIMGLCIISIDRYIGVSYPLRYPTIVTQRRGLMALLCVWALSLVISIGPLFGWRQPAPEDETICQINEEPGYVLFSALGSFYLPLAIILVMYCRVYVVAKRESRGLKSGLKTDKSDSEQVTLRIHRKNAPAGGSGMASAKTKTHFSVRLLKFSREKKAAKTLGIVVGCFVLCWLPFFLVMPIGSFFPDFKPSETVFKIVFWLGYLNSCINPIIYPCSSQEFKKAFQNVLRIQCLCRKQSSKHALGYTLHPPSQAVEGQHKDMVRIPVGSRETFYRISKTDGVCEWKFFSSMPRGSARITVSKDQSSCTTARVRSKSFLQVCCCVGPSTPSLDKNHQVPTIKVHTISLSENGEEV

SEQ ID NO: 332 - protein, 520 aa, unidentified
MNPDLDTGHNTSAPAHWGELKNANFTGPNQTSSNSTLPQLDITRAISVGLVLGAFILFAIVGNILVILSVACNRHLRTPTNYFIVNLAMADLLLSFTVLPFSAALEVLGYWVLGRIFCDIWAAVDVLCCTASILSLCAISIDRYIGVRYSLQYPTLVTRRKAILALLSVWVLSTVISIGPLLGWKEPAPNDDKECGVTEEPFYALFSSLGSFYIPLAVILVMYCRVYIVAKRTTKNLEAGVMKEMSNSKELTLRIHSKNFHEDTLSSTKAKGHNPRSSIAVKLFKFSREKKAAKTLGIVVGMFILCWLPFFIALPLGSLFSTLKPPDAVFKVVFWLGYFNSCLNPIIYPCSSKEFKRAFVRILGCQCRGRGRRRRRRRRRLGGCAYTYRPWTRGGSLERSQSRKDSLDDSGSCLSGSQRTLPSASPSPGYLGRGAPPPVELCAFPEWKAPGALLSLPAPEPPGRRGRHDSGPLFTFKLLTEPESPGTDGGASNGGCEAAADVANGQPGFKSNMPLAPGQF

SEQ ID NO: 333 - protein, 572 aa, unidentified
MTFRDLLSVSFEGPRPDSSAGGSSAGGGGGSAGGAAPSEGPAVGGVPGGAGGGGGVVGAGSGEDNRSSAGEPGSAGAGGDVNGTAAVGGLVVSAQGVGVGVFLAAFILMAVAGNLLVILSVACNRHLQTVTNYFIVNLAVADLLLSATVLPFSATMEVLGFWAFGRAFCDVWAAVDVLCCTASILSLCTISVDRYVGVRHSLKYPAIMTERKAAAILALLWVVALVVSVGPLLGWKEPVPPDERFCGITEEAGYAVFSSVCSFYLPMAVIVVMYCRVYVVARSTTRSLEAGVKRERGKASEVVLRIHCRGAATGADGAHGMRSAKGHTFRSSLSVRLLKFSREKKAAKTLAIVVGVFVLCWFPFFFVLPLGSLFPQLKPSEGVFKVIFWLGYFNSCVNPLIYPCSSREFKRAFLRLLRCQCRRRRRRRPLWRVYGHHWRASTSGLRQDCAPSSGDAPPGAPLALTALPDPDPEPPGTPEMQAPVASRRKPPSAFREWRLLGPFRRPTTQLRAKVSSLSHKIRAGGAQRAEAACAQRSEVEAVSLGVPHEVAEGATCQAYELADYSNLRETDI

SEQ ID NO: 334 - protein, 465 aa, unidentified
MFRQEQPLAEGSFAPMGSLQPDAGNASWNGTEAPGGGARATPYSLQVTLTLVCLAGLLMLLTVFGNVLVIIAVFTSRALKAPQNLFLVSLASADILVATLVIPFSLANEVMGYWYFGKAWCEIYLALDVLFCTSSIVHLCAISLDRYWSITQAIEYNLKRTPRRIKAIIITVWVISAVISFPPLISIEKKGGGGGPQPAEPRCEINDQKWYVISSCIGSFFAPCLIMILVYVRIYQIAKRRTRVPPSRRGPDAVAAPPGGTERRPNGLGPERSAGPGGAEAEPLPTQLNGAPGEPAPAGPRDTDALDLEESSSSDHAERPPGPRRPERGPRGKGKARASQVKPGDSLPRRGPGATGIGTPAAGPGEERVGAAKASRWRGRQNREKRFTFVLAVVIGVFVVCWFPFFFTYTLTAVGCSVPRTLFKFFFWFGYCNSSLNPVIYTIFNHDFRRAFKKILCRGDRKRIV

SEQ ID NO: 335 - protein, 462 aa, unidentified
MASPALAAALAVAAAAGPNASGAGERGSGGVANASGASWGPPRGQYSAGAVAGLAAVVGFLIVFTVVGNVLVVIAVLTSRALRAPQNLFLVSLASADILVATLVMPFSLANELMAYWYFGQVWCGVYLALDVLFCTSSIVHLCAISLDRYWSVTQAVEYNLKRTPRRVKATIVAVWLISAVISFPPLVSLYRQPDGAAYPQCGLNDETWYILSSCIGSFFAPCLIMGLVYARIYRVAKLRTRTLSEKRAPVGPDGASPTTENGLGAAAGAGENGHCAPPPADVEPDESSAAAERRRRRGALRRGGRRRAGAEGGAGGADGQGAGPGAAESGALTASRSPGPGGRLSRASSRSVEFFLSRRRRARSSVCRRKVAQAREKRFTFVLAVVMGVFVLCWFPFFFSYSLYGICREACQVPGPLFKFFFWIGYCNSSLNPVIYTVFNQDFRRSFKHILFRRRRRGFRQ

SEQ ID NO: 336 - protein, 477 aa, unidentified
MGAGVLVLGASEPGNLSSAAPLPDGAATAARLLVPASPPASLLPPASESPEPLSQQWTAGMGLLMALIVLLIVAGNVLVIVAIAKTPRLQTLTNLFIMSLASADLVMGLLVVPFGATIVVWGRWEYGSFFCELWTSVDVLCVTASIETLCVIALDRYLAITSPFRYQSLLTRARARGLVCTVWAISALVSFLPILMHWWRAESDEARRCYNDPKCCDFVTNRAYAIASSVVSFYVPLCIMAFVYLRVFREAQKQVKKIDSCERRFLGGPARPPSPSPSPVPAPAPPPGPPRPAAAAATAPLANGRAGKRRPSRLVALREQKALKTLGIIMGVFTLCWLPFFLANVVKAFHRELVPDRLFVFFNWLGYANSAFNPIIYCRSPDFRKAFQRLLCCARRAARRRHATHGDRPRASGCLARPGPPPSPGAASDDDDDDVVGATPPARLLEPWAGCNGGAAADSDSSLDEPCRPGFASESKV

SEQ ID NO: 337 - protein, 413 aa, unidentified [sequence omitted]

SEQ ID NO: 338 - protein, 408 aa, unidentified
MAPWPHENSSLAPWPDLPTLAPNTANTSGLPGVPWEAALAGALLALAVLATVGGNLLVIVAIAWTPRLQTMTNVFVTSLAAADLVMGLLVVPPAATLALTGHWPLGATGCELWTSVDVLCVTASIETLCALAVDRYLAVTNPLRYGALVTKRCARTAVVLVWVVSAAVSFAPIMSQWWRVGADAEAQRCHSNPRCCAFASNMPYVLLSSSVSFYLPLLVMLFVYARVFVVATRQLRLLRGELGRFPPEESPPAPSRSLAPAPVGTCAPPEGVPACGRRPARLLPLREHRALCTLGLIMGTFTLCWLPFFLANVLRALGGPSLVPGPAFLALNWLGYANSAFNPLIYCRSPDFRSAFRRLLCRCGRRLPPEPCAAARPALFPSGVPAARSSPAQPRLCQRLDGASWGVS

SEQ ID NO: 339 - protein, 230 aa, unidentified
MTKTSTCIYHFLVLSWYTFLNYYISQEGKDEVKPKILANGARWKYMTLLNLLLQTIFYGVTCLDDVLKRTKGGKDIKFLTAFRDLLFTTLAFPVSTFVFLAFWILFLYNRDLIYPKVLDTVIPVWLNHAMHTFIFPITLAEVVLRPHSYPSKKTGLTLLAAASIAYISRILWLYFETGTWVYPVFAKLSLLGLAAFFSLSYVFIASIYLLGEKLNHWKWGDMRQPRKKRK

SEQ ID NO: 340 - protein, 797 aa, unidentified
MAHRCLRLWGRGGCWPRGLQQLLVPGGVGPGEQPCLRTLYRFVTTQARASRNSLLTDIIAAYQRFCSRPPKGFEKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLLSMLPTVLIIAFLLYTIRRGPAGIGRTGRGMGGLFSVGETTAKVLKDEIDVKFKDVAGCEEAKLEIMEFVNFLKNPKQYQDLGAKIPKGAILTGPPGTGKTLLAKATAGEANVPFITVSGSEFLEMFVGVGPARVRDLFALARKNAPCILFIDEIDAVGRKRGRGNFGGQSEQENTLNQLLVEMDGFNTTTNVVILAGTNRPDILDPALLRPGRFDRQIFIGPPDIKGRASIFKVHLRPLKLDSTLEKDKLARKLASLTPGFSGADVANVCNEAALIAARHLSDSINQKHFEQAIERVIGGLEKKTQVLQPEEKKTVAYHEAGHAVAGWYLEHADPLLKVSIIPRGKGLGYAQYLPKEQYLYTKEQLLDRMCMTLGGRVSEEIFFGRITTGAQDDLRKVTQSAYAQIVQFGMNEKVGQISFDLPRQGDMVLEKPYSEATARLIDDEVRILINDAYKRTVALLTEKKADVEKVALLLLEKEVLDKNDMVELLGPRPFAEKSTYEEFVEGTGSLDEDTSLPEGLKDWNKEREKEKEEPPGEKVAN

SEQ ID NO: 341 - protein, 404 aa, unidentified
MAAGTAVGAWVLVLSLWGAVVGAQNITARIGEPLVLKCKGAPKKPPQRLEWKLNTGRTEAWKVLSPQGGGPWDSVARVLPNGSLFLPAVGIQDEGIFRCQAMNRNGKETKSNYRVRVYQIPGKPEIVDSASELTAGVPNKVGTCVSEGSYPAGTLSWHLDGKPLVPNEKGVSVKEQTRRHPETGLFTLQSELMVTPARGGDPRPTFSCSFSPGLPRHRALRTAPIQPRVWEPVPLEEVQLVVEPEGGAVAPGGTVTLTCEVPAQPSPQIHWMKDGVPLPLPPSPVLILPEIGPQDQGTYSCVATHSSHGPQESRAVSISIIEPGEEGPTAGSVGGSGLGTLALALGILGGLGTAALLIGVILWQRRQRRGEERKAPENQEEEEERAELNQSEEPEAGESSTGGP

SEQ ID NO: 342 - protein, 1532 aa, unidentified
MGHSKQIRILLLNEMEKLEKTLFRLEQGYELQFRLGPTLQGKAVTVYTNYPFPGETFNREKFRSLDWENPTEREDDSDKYCKLNLQQSGSFQYYFLQGNEKSGGGYIVVDPILRVGADNHVLPLDCVTLQTFLAKCLGPFDEWESRLRVAKESGYNMIHFTPLQTLGLSRSCYSLANQLELNPDFSRPNRKYTWNDVGQLVEKLKKEWNVICITDVVYNHTAANSKWIQEHPECAYNLVNSPHLKPAWVLDRALWRFSCDVAEGKYKEKGIPALIENDHHMNSIRKIIWEDIFPKLKLWEFFQVDVNKAVEQFRRLLTQENRRVTKSDPNQHLTIIQDPEYRRFGCTVDMNIALTTFIPHDKGPAAIEECCNWFHKRMEELNSEKHRLINYHQEQAVNCLLGNVFYERLAGHGPKLGPVTRKHPLVTRYFTFPFEEIDFSMEESMIHLPNKACFLMAHNGWVMGDDPLRNFAEPGSEVYLRRELICWGDSVKLRYGNKPEDCPYLWAHMKKYTEITATYFQGVRLDNCHSTPLHVAEYMLDAARNLQPNLYVVAELFTGSEDLDNVFVTRLGISSLIREAMSAYNSHEEGRLVYRYGGEPVGSFVQPCLRPLMPAIAHALFMDITHDNECPIVHRSAYDALPSTTIVSMACCASGSTRGYDELVPHQISVVSEERFYTKWNPEALPSNTGEVNFQSGIIAARCAISKLHQELGAKGFIQVYVDQVDEDIVAVTRHSPSIHQSVVAVSRTAFRNPKTSFYSKEVPQMCIPGKIEEVVLEARTIERNTKPYRKDENSINGTPDITVEIREHIQLNESKIVKQAGVATKGPNEYIQEIEFENLSPGSVIIFRVSLDPHAQVAVGILRNHLTQFSPHFKSGSLAVDNADPILKIPFASLASRLTLAELNQILYRCESEEKEDGGGCYDIPNWSALKYAGLQGLMSVLAEIRPKNDLGHPFCNNLRSGDWMIDYVSNRLISRSGTIAEVGKWLQAMFFYLKQIPRYLIPCYFDAILIGAYTTLLDTAWKQMSSFVQNGSTFVKHLSLGSVQLCGVGKFPSLPILSPALMDVPYRLNEITKEKEQCCVSLAAGLPHFSSGIFRCWGRDTFIALRGILLITGRYVEARNIILAFAGTLRHGLIPNLLGEGIYARYNCRDAVWWWLQCIQDYCKMVPNGLDILKCPVSRMYPTDDSAPLPAGTLDQPLFEVIQEAMQKHMQGIQFRERNAGPQIDRNMKDEGFNITAGVDEETGFVYGGNRFNCGTWMDKMGESDRARNRGIPATPRDGSAVEIVGLSKSAVRWLLELSKKNIFPYHEVTVKRHGKAIKVSYDEWNRKIQDNFEKLFHVSEDPSDLNEKHPNLVHKRGIYKDSYGASSPWCDYQLRPNFTIAMVVAPELFTTEKAWKALEIAEKKLLGPLGMKTLDPDDMVYCGIYDNALDNDNYNLAKGFNYHQGPEWLWPIGYFLRAKLYFSRLMGPETTAKTIVLVKNVLSRHYVHLERSPWKGLPELTNENAQYCPFSCETQAWSIATILETLYDL

SEQ ID NO: 343 - protein, 445 aa, unidentified
MKNPEAQQDVSVSQGFRMLFYTMKPSETSFQTLEEVPDYVKKATPFFISLMLLELVVSWILKGKPPGRLDDALTSISAGVLSRLPSLFFRSIELTSYIYIWENYRLFNLPWDSPWTWYSAFLGVDFGYYWFHRMAHEVNIMWAGHQTHHSSEDYNLSTALRQSVLQIYTSWIFYSPLALFIPPSVYAVHLQFNLLYQFWIHTEVINNLGPLELILNTPSHHRVHHGRNRYCIDKNYAGVLIIWDKIFGTFEAENEKVVYGLTHPINTFEPIKVQFHHLFSIWTTFWATPGFFNKFSVIFKGPGWGPGKPRLGLSEEIPEVTGKEVPFSSSSSQLLKIYTVVQFALMLAFYEETFADTAALSQVTLLLRVCFIILTLTSIGFLLDQRPKAAIMETLRCLMFLMLYRFGHLKPLVPSLSSAFEIVFSICIAFWGVRSMKQLTSHPWK

SEQ ID NO: 344 - protein, 283 aa, unidentified
MDLWPGAWMLLLLLFLLLLFLLPTLWFCSPSAKYFFKMAFYNGWILFLAVLAIPVCAVRGRNVENMKILRLMLLHIKYLYGIRVEVRGAHHFPPSQPYVVVSNHQSSLDLLGMMEVLPGRCVPIAKRELLWAGSAGLACWLAGVIFIDRKRTGDAISVMSEVAQTLLTQDVRVWVFPEGTRNHNGSMLPFKRGAFHLAVQAQVPIVPIVMSSYQDFYCKKERRFTSGQCQVRVLPPVPTEGLTPDDVPALADRVRHSMLTVFREISTDGRGGGDYLKKPGGGG

SEQ ID NO: 345 - protein, 278 aa, unidentified
MELWPCLAAALLLLLLLVQLSRAAEFYAKVALYCALCFTVSAVASLVCLLRHGGRTVENMSIIGWFVRSFKYFYGLRFEVRDPRRLQEARPCVIVSNHQSILDMMGLMEVLPERCVQIAKRELLFLGPVGLIMYLGGVFFINRQRSSTAMTVMADLGERMVRENLKVWIYPEGTRNDNGDLLPFKKGAFYLAVQAQVPIVPVVYSSFSSFYNTKKKFFTSGTVTVQVLEAIPTSGLTAADVPALVDTCHRAMRTTFLHISKTPQENGATAGSGVQPAQ

SEQ ID NO: 346 - protein, 376 aa, unidentified
MGLLAFLKTQFVLHLLVGFVFVVSGLVINFVQLCTLALWPVSKQLYRRLNCRLAYSLWSQLVMLLEWWSCTECTLFTDQATVERFGKEHAVIILNHNFEIDFLCGWTMCERFGVLGSSKVLAKKELLYVPLIGWTWYFLEIVFCKRKWEEDRDTVVEGLRRLSDYPEYMWFLLYCEGTRFTETKHRVSMEVAAAKGLPVLKYHLLPRTKGFTTAVKCLRGTVAAVYDVTLNFRGNKNPSLLGILYGKKYEADMCVRRFPLEDIPLDEKEAAQWLHKLYQEKDALQEIYNQKGMFPGEQFKPARRPWTLLNFLSWATILLSPLFSFVLGVFASGSPLLILTFLGFVGAASFGVRRLIGVTEIEKGSSYGNQEFKKKE

SEQ ID NO: 347 - protein, 378 aa, unidentified
MDLAGLLKSQFLCHLVFCYVFIASGLIINTIQLFTLLLWPINKQLFRKINCRLSYCISSQLVMLLEWWSGTECTIFTDPRAYLKYGKENAIVVLNHKFEIDFLCGWSLSERFGLLGGSKVLAKKELAYVPIIGWMWYFTEMVFCSRKWEQDRKTVATSLQHLRDYPEKYFFLIHCEGTRFTEKKHEISMQVARAKGLPRLKHHLLPRTKGFAITVRSLRNVVSAVYDCTLNFRNNENPTLLGVLNGKKYHADLYVRRIPLEDIPEDDDECSAWLHKLYQEKDAFQEEYYRTGTFPETPMVPPRRPWTLVNWLFWASLVLYPFFQFLVSMIRSGSSLTLASFILVFFVASVGVRWMIGVTEIDKGSAYGNSDSKQKLND

SEQ ID NO: 348 - protein, 364 aa, unidentified [sequence omitted]

SEQ ID NO: 349 - protein, 2068 aa, unidentified
MAGRSHPGPLRPLLPLLVVAACVLPGAGGTCPERALERREEEANVVLTGTVEEILNVDPVQHTYSCKVRVWRYLKGKDLVARESLLDGGNKVVISGFGDPLICDNQVSTGDTRIFFVNPAPPYLWPAHKNELMLNSSLMRITLRNLEEVEFCVEDKPGTHFTPVPPTPPDACRGMLCGFGAVCEPNAEGPGRASCVCKKSPCPSVVAPVCGSDASTYSNECELQRAQCSQQRRIRLLSRGPCGSRDPCSNVTCSFGSTCARSADGLTASCLCPATCRGAPEGTVCGSDGADYPGECQLLRRACARQENVFKKFDGPCDPCQGALPDPSRSCRVNPRTRRPEMLLRPESCPARQAPVCGDDGVTYENDCVMGRSGAARGLLLQKVRSGQCQGRDQCPEPCRFNAVCLSRRGRPRCSCDRVTCDGAYRPVCAQDGRTYDSDCWRQQAECRQQRAIPSKHQGPCDQAPSPCLGVQCAFGATCAVKNGQAACECLQACSSLYDPVCGSDGVTYGSACELEATACTLGREIQVARKGPCDRCGQCRFGALCEAETGRCVCPSECVALAQPVCGSDGHTYPSECMLHVHACTHQISLHVASAGPCETCGDAVCAFGAVCSAGQCVCPRCEHPPPGPVCGSDGVTYGSACELREAACLQQTQIEEARAGPCEQAECGSGGSGSGEDGDCEQELCRQRGGIWDEDSEDGPCVCDFSCQSVPGSPVCGSDGVTYSTECELKKARCESQRGLYVAAQGACRGPTFAPLPPVAPLHCAQTPYGCCQDNITAARGVGLAGCPSACQCNPHGSYGGTCDPATGQCSCRPGVGGLRCDRCEPGFWNFRGIVTDGRSGCTPCSCDPQGAVRDDCEQMTGLCSCKPGVAGPKCGQCPDGRALGPAGCEADASAPATCAEMRCEFGARCVEESGSAHCVCPMLTCPEANATKVCGSDGVTYGNECQLKTIACRQGLQISIQSLGPCQEAVAPSTHPTSASVTVTTPGLLLSQALPAPPGALPLAPSSTAHSQTTPPPSSRPRTTASVPRTTVWPVLTVPPTAPSPAPSLVASAFGESGSTDGSSDEELSGDQEASGGGSGGLEPLEGSSVATPGPPVERASCYNSALGCCSDGKTPSLDAEGSNCPATKVFQGVLELEGVEGQELFYTPEMADPKSELFGETARSIESTLDDLFRNSDVKKDFRSVRLRDLGPGKSVRAIVDVHFDPTTAFRAPDVARALLRQIQVSRRRSLGVRRPLQEHVRFMDFDWFPAFITGATSGAIAAGATARATTASRLPSSAVTPRAPHPSHTSQPVAKTTAAPTTRRPPTTAPSRVPGRRPPAPQQPPKPCDSQPCFHGGTCQDWALGGGFTCSCPAGRGGAVCEKVLGAPVPAFEGRSFLAFPTLRAYHTLRLALEFRALEPQGLLLYNGNARGKDFLALALLDGRVQLRFDTGSGPAVLTSAVPVEPGQWHRLELSRHWRRGTLSVDGETPVLGESPSGTDGLNLDTDLFVGGVPEDQAAVALERTFVGAGLRGCIRLLDVNNQRLELGIGPGAATRGSGVGECGDHPCLPNPCHGGAPCQNLEAGRFHCQCPPGRVGPTCADEKSPCQPNPCHGAAPCRVLPEGGAQCECPLGREGTFCQTASGQDGSGPFLADFNGFSHLELRGLHTFARDLGEKMALEVVFLARGPSGLLLYNGQKTDGKGDFVSLALRDRRLEFRYDLGKGAAVIRSREPVTLGAWTRVSLERNGRKGALRVGDGPRVLGESPKSRKVPHTVLNLKEPLYVGGAPDFSKLARAAAVSSGFDGAIQLVSLGGRQLLTPEHVLRQVDVTSFAGHPCTRASGHPCLNGASCVPREAAYVCLCPGGFSGPHCEKGLVEKSAGDVDTLAFDGRTFVEYLNAVTESELANEIPVPETLDSGALHSEKALQSNHFELSLRTEATQGLVLWSGKATERADYVALAIVDGHLQLSYNLGSQPVVLRSTVPVNTNRWLRVVAHREQREGSLQVGNEAPVTGSSPLGATQLDTDGALWLGGLPELPVGPALPKAYGTGFVGCLRDVVVGRHPLHLLEDAVTKPELRPCPTP

SEQ ID NO: 350 - protein, 359 aa, unidentified [sequence omitted]

SEQ ID NO: 351 - protein, 363 aa, unidentified
MKGNSTLATTSKNITSGLHFGLVNISGNNESTLNCSQKPSDKHLDAIPILYYIIFVIGFLVNIVVVTLFCCQKGPKKVSSIYIFNLAVADLLLLATLPLWATYYSYRYDWLFGPVMCKVFGSFLTLNMFASIFFITCMSVDRYQSVIYPFLSQRRNPWQASYIVPLVWCMACLSSLPTFYFRDVRTIEYLGVNACIMAFPPEKYAQWSAGIALMKNILGFIIPLIFIATCYFGIRKHLLKTNSYGKNRITRDQVLKMAAAVVLAFIICWLPFHVLTFLDALAWMGVINSCEVIAVIDLALPFAILLGFTNSCVNPFLYCFVGNRFQQKLRSVFRVPITWLQGKRESMSCRKSSSLREMETFVS

SEQ ID NO: 352 - protein, 159 aa, unidentified
MELPAVNLKVILLGHWLLTTWGCIVFSGSYAWANFTILALGVWAVAQRDSIDAISMFLGGLLATIFLDIVHISIFYPRVSLTDTGRFGVGMAILSLLLKPLSCCFVYHMYRERGGELLVHTGFLGSSQDRSAYQTIDSAEAPADPFAVPEGRSQDARGY

SEQ ID NO: 353 - protein, 613 aa, unidentified
MFRCGGLAAGALKQKLVPLVRTVCVRSPRQRNRLPGNLFQRWHVPLELQMTRQMASSGASGGKIDNSVLVLIVGLSTVGAGAYAYKTMKEDEKRYNERISGLGLTPEQKQKKAALSASEGEEVPQDKAPSHVPFLLIGGGTAAFAAARSIRARDPGARVLIVSEDPELPYMRPPLSKELWFSDDPNVTKTLRFKQWNGKERSIYFQPPSFYVSAQDLPHIENGGVAVLTGKKVVQLDVRDNMVKLNDGSQITYEKCLIATGGTPRSLSAIDRAGAEVKSRTTLFRKIGDFRSLEKISREVKSITIIGGGFLGSELACALGRKARALGTEVIQLFPEKGNMGKILPEYLSNWTMEKVRREGVKVMPNAIVQSVGVSSGKLLIKLKDGRKVETDHIVAAVGLEPNVELAKTGGLEIDSDFGGFRVNAELQARSNIWVAGDAACFYDIKLGRRRVEHHDHAVVSGRLAGENMTGAAKPYWHQSMFWSDLGPDVGYEAIGLVDSSLPTVGVFAKATAQDNPKSATEQSGTGIRSESETESEASEITIPPSTPAVPQAPVQGEDYGKGVIFYLRDKVVVGIVLWNIFNRMPIARKIIKDGEQHEDLNEVAKLFNIHED

SEQ ID NO: 354 - protein, 245 aa, unidentified
MALVPCQVLRMAILLSYCSILCNYKAIEMPSHQTYGGSWKFLTFIDLVIQAVFFGICVLTDLSSLLTRGSGNQEQERQLKKLISLRDWMLAVLAFPVGVFVVAVFWIIYAYDREMIYPKLLDNFIPGWLNHGMHTTVLPFILIEMRTSHHQYPSRSSGLTAICTFSVGYILWVCWVHHVTGMWVYPFLEHIGPGARIIFFGSTTILMNFLYLLGEVLNNYIWDTQKKPPSWQDMKIKFMYLGPSS

SEQ ID NO: 355 - protein, 411 aa, unidentified
MWIQQLLGLSSMSIRWPGRPLGSHAWILIAMFQLAVDLPACEALGPGPEFWLLPRSPPRPPRLWSFRSGQPARVPAPVWSPRPPRVERIHGQMQMPRARRAHRPRDQAAALVPKAGLAKPPAAAKSSPSLASSSSSSSSAVAGGAPEQQALLRRGKRHLQGDGLSSFDSRGSRPTTETEFIAWGPTGDEEALESNTFPGVYGPTTVSILQTRKTTVAATTTTTTTATPMTLQTKGFTESLDPRRRIPGGVSTTEPSTSPSNNGEVTQPPRILGEASGLAVHQIITITVSLIMVIAALITTLVLKNCCAQSGNTRRNSHQRKTNQQEESCQNLTDFPSARVPSSLDIFTAYNETLQCSHECVRASVPVYTDETLHSTTGEYKSTFNGNRPSSSDRHLIPVAFVSEKWFEISC

SEQ ID NO: 356 - protein, 903 aa, unidentified
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVGPVQEEEYVAEKLPSRFIESAHTELAKDDAAPAPPVADAKAQDRGVEGELGNEESLDRNEEGLDRNEEGLDRNEESLDRNEEGLDRNEEIKRAAFQIISQVISEATEQVLATTVGKVAGRVCQASQLQGQKEESCVPVHQKTVLGPDTAEPATAEAAVAPPDAGLPLPGLPAEGSPPPKTYVSCLKSLLSSPTKDSKPNISAHHISLASCLALTTPSEELPDRAGILVEDATCVTCMSDSSQSVPLVASPGHCSDSFSTSGLEDSCTETSSSPRDKAITPPLPESTVPFSNGVLKGELSDLGAEDGWTMDAEADHSGGSDRNSMDSVDSCCSLKKTESFQNAQAGSNPKKVDLIIWEIEVPKHLVGRLIGKQGRYVSFLKQTSGAKIYISTLPYTQSVQICHIEGSQHHVDKALNLIGKKFKELNLTNIYAPPLPSLALPSLPMTSWLMLPDGITVEVIVVNQVNAGHLFVQQHTHPTFHALRSLDQQMYLCYSQPGIPTLPTPVEITVICAAPGADGAWWRAQVVASYEETNEVEIRYVDYGGYKRVKVDVLRQIRSDFVTLPFQGAEVLLDSVMPLSDDDQFSPEADAAMSEMTGNTALLAQVTSYSPTGLPLIQLWSVVGDEVVLINRSLVERGLAQWVDSYYTSL

SEQ ID NO: 357 - protein, 2319 aa, unidentified
MLTMSVTLSPLRSQDLDPMATDASPMAINMTPTVEQGEGEEAMKDMDSDQQYEKPPPLHTGADWKIVLHLPEIETWLRMTSERVRDLTYSVQQDSDSKHVDVHLVQLKDICEDISDHVEQIHALLETEFSLKLLSYSVNVIVDIHAVQLLWHQLRVSVLVLRERILQGLQDANGNYTRQTDILQAFSEETKEGRLDSLTEVDDSGQLTIKCSQNYLSLDCGITAFELSDYSPSEDLLSGLGDMTSSQVKTKPFDSWSYSEMEKEFPELIRSVGLLTVAADSISTNGSEAVTEEVSQVSLSVDDKGGCEEDNASAVEEQPGLTLGVSSSSGEALTNAAQPSSETVQQESSSSSHHDAKNQQPVPCENATPKRTIRDCFNYNEDSPTQPTLPKRGLFLKEETFKNDLKGNGGKRQMVDLKPEMSRSTPSLVDPPDRSKLCLVLQSSYPNSPSAASQSYECLHKVGNGNLENTVKFHIKEISSSLGRLNDCYKEKSRLKKPHKTSEEVPPCRTPKRGTGSGKQAKNTKSSAVPNGELSYTSKAIEGPQTNSASTSSLEPCNQRSWNAKLQLQSETSSSPAFTQSSESSVGSDNIMSPVPLLSKHKSKKGQASSPSHVTRNGEVVEAWYGSDEYLALPSHLKQTEVLALKLENLTKLLPQKPRGETIQNIDDWELSEMNSDSEIYPTYHVKKKHTRLGRVSPSSSSDIASSLGESIESGPLSDILSDEESSMPLAGMKKYADEKSERASSSEKNESHSATKSALIQKLMQDIQHQDNYEAIWEKIEGFVNKLDEFIQWLNEAMETTENWTPPKAEMDDLKLYLETHLSFKLNVDSHCALKEAVEEEGHQLLELIASHKAGLKDMLRMIASQWKELQRQIKRQHSWILRALDTIKAEILATDVSVEDEEGTGSPKAEVQLCYLEAQRDAVEQMSLKLYSEQYTSSSKRKEEFADMSKVHSVGSNGLLDFDSEYQELWDWLIDMESLVMDSHDLMMSEEQQQHLYKRYSVEMSIRHLKKTELLSKVEALKKGGVLLPNDLLEKVDSINEKWELLGKTLGEKIQDTMAGHSGSSPRDLLSPESGSLVRQLEVRIKELKGWLRDTELFIFNSCLRQEKEGTMNTEKQLQYFKSLCREIKQRRRGVASILRLCQHLLDDRETCNLNADHQPMQLIIVNLERRWEAIVMQAVQWQTRLQKKMGKESETLNVIDPGLMDLNGMSEDALEWDEMDISNKLISLNEESNDLDQELQPVIPSLKLGETSNEDPGYDEEADNHGGSQYASNITAPSSPHIYQVYSLHNVELYEDNHMPFLKNNPKVTGMTQPNVLTKSLSKDSSFSSTKSLPDLLGGSNLVKPCACHGGDMSQNSGSESGIVSEGDTETTTNSEMCLLNAVDGSPSNLETEHLDPQMGDAVNVLKQKFTDEGESIKLPNSSQSSISPVGCVNGKVGDLNSITKHTPDCLGEELQGKHDVFTFYDYSYLQGSKLKLPMIMKQSQSEKAHVEDPLLRGFYFDKKSCKSKHQTTELQPDVPPHERILASASHEMDRISYKSGNIEKTFTGMQNAKQLSLLSHSSSIESLSPGGDLFGLGIFKNGSDSLQRSTSLESWLTSYKSNEDLFSCHSSGDISVSSGSVGELSKRTLDLLNRLENIQSPSEQKIKRSVSDITLQSSSQKMSFTGQMSLDIASSINEDSAASLTELSSSDELSLCSEDIVLHKNKIPESNASFRKRLTRSVADESDVNVSMIVNVSCTSACTDDEDDSDLLSSSTLTLTEEELCIKDEDDDSSIATDDEIYEDCTLMSGLDYIKNELQTWIRPKLSLTRDKKRCNVSDEMKGSKDISSSEMTNPSDTLNIETLLNGSVKRVSENNGNGKNSSHTHELGTKRENKKTIFKVNKDPYVADMENGNIEGIPERQKGKPNVTSKVSENLGSHGKEISESEHCKCKALMDSLDDSNTAGKEFVSQDVRHLPKKCPNHHHFENQSTASTPTEKSFSELALETRFNNRQDSDALKSSDDAPSMAGKSAGCCLALEQNGTEENASISNISCCNCEPDVFHQKDAEDCSVHNFVKEIIDMASTALKSKSQPENEVAAPTSLTQIKEKVLEHSHRPIQLRKGDFYSYLSLSSHDSDCGEVTNYIEEKSSTPLPLDTTDSGLDDKEDIECFFEACVEGDSDGEEPCFSSAPPNESAVPSEAAMPLQATACSSEFSDSSLSADDADTVALSSPSSQERAEVGKEVNGLPQTSSGCAENLEFTPSKLDSEKESSGKPGESGMPEEHNAASAKSKVQDLSLKANQPTDKAALHPSPKTLTCEENLLNLHEKRHRNMHR

SEQ ID NO: 358 - protein, 3907 aa, unidentified
MEDEERQKKLEAGKAKLAQFRQRKAQSDGQSPSKKQKKKRKTSSSKHDVSAHHDLNIDQSQCNEMYINSSQRVESTVIPESTIMRTLHSGEITSHEQGFSVELESEISTTADDCSSEVNGCSFVMRTGKPTNLLREEEFGVDDSYSEQGAQDSPTHLEMMESELAGKQHEIEELNRELEEMRVTYGTEGLQQLQEFEAAIKQRDGIITQLTANLQQARREKDETMREFLELTEQSQKLQIQFQQLQASETLRNSTHSSTAADLLQAKQQILTHQQQLEEQDHLLEDYQKKKEDFTMQISFLQEKIKVYEMEQDKKVENSNKEEIQEKETIIEELNTKIIEEEKKTLELKDKLTTADKLLGELQEQIVQKNQEIKNMKLELTNSKQKERQSSEEIKQLMGTVEELQKRNHKDSQFETDIVQRMEQETQRKLEQLRAELDEMYGQQIVQMKQELIRQHMAQMEEMKTRHKGEMENALRSYSNITVNEDQIKLMNVAINELNIKLQDTNSQKEKLKEELGLILEEKCALQRQLEDLVEELSFSREQIQRARQTIAEQESKLNEAHKSLSTVEDLKAEIVSASESRKELELKHEAEVTNYKIKLEMLEKEKNAVLDRMAESQEAELERLRTQLLFSHEEELSKLKEDLEIEHRINIEKLKDNLGIHYKQQIDGLQNEMSQKIETMQFEKDNLITKQNQLILEISKLKDLQQSLVNSKSEEMTLQINELQKEIEILRQEEKEKGTLEQEVQELQLKTELLEKQMKEKENDLQEKFAQLEAENSILKDEKKTLEDMLKIHTPVSQEERLIFLDSIKSKSKDSVWEKEIEILIEENEDLKQQCIQLNEEIEKQRNTFSFAEKNFEVNYQELQEEYACLLKVKDDLEDSKNKQELEYKSKLKALNEELHLQRINPTTVKMKSSVFDEDKTFVAETLEMGEVVEKDTTELMEKLEVTKREKLELSQRLSDLSEQLKQKHGEISFLNEEVKSLKQEKEQVSLRCRELEIIINHNRAENVQSCDTQVSSLLDGVVTMTSRGAEGSVSKVNKSFGEESKIMVEDKVSFENMTVGEESKQEQLILDHLPSVTKESSLRATQPSENDKLQKELNVLKSEQNDLRLQMEAQRICLSLVYSTHVDQVREYMENEKDKALCSLKEELIFAQEEKIKELQKIHQLELQTMKTQETGDEGKPLHLLIGKLQKAVSEECSYFLQTLCSVLGEYYTPALKCEVNAEDKENSGDYISENEDPELQDYRYEVQDFQENMHTLLNKVTEEYNKLLVLQTRLSKIWGQQTDGMKLEFGEENLPKEETEFLSIHSQMTNLEDIDVNHKSKLSSLQDLEKTKLEEQVQELESLISSLQQQLKETEQNYEAEIHCLQKRLQAVSESTVPPSLPVDSVVITESDAQRTMYPGSCVKKNIDGTIEFSGEFGVKEETNIVKLLEKQYQEQLEEEVAKVIVSMSIAFAQQTELSRISGGKENTASSKQAHAVCQQEQHYFNEMKLSQDQIGFQTFETVDVKFKEEFKPLSKELGEHGKEILLSNSDPHDIPESKDCVLTISEEMFSKDKTFIVRQSIHDEISVSSMDASRQLMLNEEQLEDMRQELVRQYQEHQQATELLRQAHMRQMERQREDQEQLQEEIKRLNRQLAQRSSIDNENLVSERERVLLEELEALKQLSLAGREKLCCELRNSSTQTQNGNENQGEVEEQTFKEKELDRKPEDVPPEILSNERYALQKANNRLLKILLEVVKTTAAVEETIGRHVLGILDRSSKSQSSASLIWRSEAEASVKSCVHEEHTRVTDESIPSYSGSDMPRNDINMWSKVTEEGTELSQRLVRSGFAGTEIDPENEELMLNISSRLQAAVEKLLEAISETSSQLEHAKVTQTELMRESFRQKQEATESLKCQEELRERLHEESRAREQLAVELSKAEGVIDGYADEKTLFERQIQEKTDIIDRLEQELLCASNRLQELEAEQQQIQEERELLSRQKEAMKAEAGPVEQQLLQETEKLMKEKLEVQCQAEKVRDDLQKQVKALEIDVEEQVSRFIELEQEKNTELMDLRQQNQALEKQLEKMRKFLDEQAIDREHERDVFQQEIQKLEQQLKVVPRFQPISEHQTREVEQLANHLKEKTDKCSELLLSKEQLQRDIQERNEEIEKLEFRVRELEQALLVSADTFQKVEDRKHFGAVEAKPELSLEVQLQAERDAIDRKEKEITNLEEQLEQFREELENKNEEVQQLHMQLEIQKKESTTRLQELEQENKLFKDDMEKLGLAIKESDAMSTQDQHVLFGKFAQIIQEKEVEIDQLNEQVTKLQQQLKITTDNKVIEEKNELIRDLETQIECLMSDQECVKRNREEEIEQLNEVIEKLQQELANIGQKTSMNAHSLSEEADSLKHQLDVVIAEKLALEQQVETANEEMTFMKNVLKETNFKMNQLTQELFSLKRERESVEKIQSIPENSVNVAIDHLSKDKPELEVVLTEDALKSLENQTYFKSFEENGKGSIINLETRLLQLESTVSAKDLELTQCYKQIKDMQEQGQFETEMLQKKIVNLQKIVEEKVAAALVSQIQLEAVQEYAKFCQDNQTISSEPERTNIQNLNQLREDELGSDISALTLRISELESQVVEMHTSLILEKEQVEIAEKNVLEKEKKLLELQKLLEGNEKKQREKEKKRSPQDVEVLKTTTELFHSNEESGFFNELEALRAESVATKAELASYKEKAEKLQEELLVKETNMTSLQKDLSQVRDHLAEAKEKLSILEKEDETEVQESKKACMFEPLPIKLSKSIASQTDGTLKISSSNQTPQILVKNAGIQINLQSECSSEEVTEIISQFTEKIEKMQELHAAEILDMESRHISETETLKREHYVAVQLLKEECGTLKAVIQCLRSKEGSSIPELAHSDAYQTREICSSDSGSDWGQGIYLTHSQGFDIASEGRGEESESATDSFPKKIKGLLRAVHNEGMQVLSLTESPYSDGEDHSIQQVSEPWLEERKAYINTISSLKDLITKMQLQREAEVYDSSQSHESFSDWRGELLLALQQVFLEERSVLLAAFRTELTALGTTDAVGLLNCLEQRIQEQGVEYQAAMECLQKADRRSLLSEIQALHAQMNGRKITLKREQESEKPSQELLEYNIQQKQSQMLEMQVELSSMKDRATELQEQLSSEKMVVAELKSELAQTKLELETTLKAQHKHLKELEAFRLEVKDKTDEVHLLNDTLASEQKKSRELQWALEKEKAKLGRSEERDKEELEDLKFSLESQKQRNLQLNLLLEQQKQLLNESQQKIESQRMLYDAQLSEEQGRNLELQVLLESEKVRIREMSSTLDRERELHAQLQSSDGTGQSRPPLPSEDLLKELQKQLEEKHSRIVELLNETEKYKLDSLQTRQQMEKDRQVHRKTLQTEQEANTEGQKKMHELQSKVEDLQRQLEEKRQQVYKLDLEGQRLQGIMQEFQKQELEREEKRESRRILYQNLNEPTTWSLTSDRTRNWVLQQKIEGETKESNYAKLIEMNGGGTGCNHELEMIRQKLQCVASKLQVLPQKASERLQFETADDEDFIWVQENIDEIILQLQKLTGQQGEEPSLVSPSTSCGSLTERLLRQNAELTGHISQLTEEKNDLRNMVMKLEEQIRWYRQTGAGRDNSSRFSLNGGANIEAIIASEKEVWNREKLTLQKSLKRAEAEVYKLKAELRNDSLLQTLSPDSEHVTLKRIYGKYLRAESFRKALIYQKKYLLLLLGGFQECEDATLALLARMGGQPAFTDLEVITNRPKGFTRFRSAVRVSIAISRMKFLVRRWHRVTGSVSININRDGFGLNQGAEKTDSFYHSSGGLELYGEPRHTTYRSRSDLDYIRSPLPFQNRYPGTPADFNPGSLACSQLQNYDPDRALTDYITRLEALQRRLGTIQSGSTTQFHAGMRR

SEQ ID NO: 359 - protein, 583 aa, unidentified
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLTDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 360 - protein, 802 aa, unidentified
MAATRAGPRAREIFTSLEYGPVPESHACALAWLDTQDRCLGHYVNGKWLKPEHRNSVPCQDPITGENLASCLQAQAEDVAAAVEAARMAFKGWSAHPGVVRAQHLTRLAEVIQKHQRLLWTLESLVTGRAVREVRDGDVQLAQQLLHYHAIQASTQEEALAGWEPMGVIGLILPPTFSFLEMMWRICPALAVGCTVVALVPPASPAPLLLAQLAGELGPFPGILNVLSGPASLVPILASQPGIRKVAFCGAPEEGRALRRSLAGECAELGLALGTESLLLLTDTADVDSAVEGVVDAAWSDRGPGGLRLLIQESVWDEAMRRLQERMGRLRSGRGLDGAVDMGARGAAACDLVQRFVREAQSQGAQVFQAGDVPSERPFYPPTLVSNLPPASPCAQVEVPWPVVVASPFRTAKEALLVANGTPRGGSASVWSERLGQALELGYGLQVGTVWINAHGLRDPSVPTGGCKESGCSWHGGPDGLYEYLRPSGTPARLSCLSKNLNYDTFGLAVPSTLPAGPEIGPSPAPPYGLFVGGRFQAPGARSSRPIRDSSGNLHGYVAEGGAKDIRGAVEAAHQAFPGWAGQSPGARAALLWALAAALERRKSTLASRLERQGAELKAAEAEVELSARRLRAWGARVQAQGHTLQVAGLRGPVLRLREPLGVLAVVCPDEWPLLAFVSLLAPALAYGNTVVMVPSAACPLLALEVCQDMATVFPAGLANVVTGDRDHLTRCLALHQDVQAMWYFGSAQGSQFVEWASAGNLKPVWASRGCPRAWDQEAEGAGPELGLRVARTKALWLPMGD

SEQ ID NO: 361 - protein, 485 aa, unidentified
MELEVRRVRQAFLSGRSRPLRFRLQQLEALRRMVQEREKDILTAIAADLCKSEFNVYSQEVITVLGEIDFMLENLPEWVTAKPVKKNVLTMLDEAYIQPQPLGVVLIIGAWNYPFVLTIQPLIGAIAAGNAVIIKPSELSENTAKILAKLLPQYLDQDLYIVINGGVEETTELLKQRFDHIFYTGNTAVGKIVMEAAAKHLTPVTLELGGKSPCYIDKDCDLDIVCRRITWGKYMNCGQTCIAPDYILCEASLQNQIVWKIKETVKEFYGENIKESPDYERIINLRHFKRILSLLEGQKIAFGGETDEATRYIAPTVLTDVDPKTKVMQEEIFGPILPIVPVKNVDEAINFINEREKPLALYVFSHNHKLIKRMIDETSSGGVTGNDVIMHFTLNSFPFGGVGSSGMGAYHGKHSFDTFSHQRPCLLKSLKREGANKLRYPPNSQSKVDWGKFFLLKRFNKEKLGLLLLTFLGIVAAVLVKAEYY

SEQ ID NO: 362 - protein, 385 aa, unidentified
MKDEPRSTNLFMKLDSVFIWKEPFGLVLIIAPWNYPLNLTLVLLVGALAAGSCVVLKPSEISQGTEKVLAEVLPQYLDQSCFAVVLGGPQETGQLLEHKLDYIFFTGSPRVGKIVMTAATKHLTPVTLELGGKNPCYVDDNCDPQTVANRVAWFCYFNAGQTCVAPDYVLCSPEMQERLLPALQSTITRFYGDDPQSSPNLGHIINQKQFQRLRALLGCSRVAIGGQSNESDRYIAPTVLVDVQETEPVMQEEIFGPILPIVNVQSVDEAIKFINRQEKPLALYAFSNSSQVVNQMLERTSSGSFGGNEGFTYISLLSVPFGGVGHSGMGRYHGKFTFDTFSHHRTCLLAPSGLEKLKEIHYPPYTDWNQQLLRWGMGSQSCTLL

SEQ ID NO: 363 - protein, 535 aa, unidentified
MAALLAAAAVRARILQVSSKVKSSPTWYSASSFSSSVPTVKLFIGGKFVESKSDKWIDIHNPATNEVIGRVPQATKAEMDAAIASCKRAFPAWADTSVLSRQQVLLRYQQLIKENLKEIAKLITLEQGKTLADAEGDVFRGLQVVEHACSVTSLMMGETMPSITKDMDLYSYRLPLGVCAGIAPFNFPAMIPLWMFPMAMVCGNTFLMKPSERVPGATMLLAKLLQDSGAPDGTLNIIHGQHEAVNFICDHPDIKAISFVGSNKAGEYIFERGSRHGKRVQANMGAKNHGVVMPDANKENTLNQLVGAAFGAAGQRCMALSTAVLVGEAKKWLPELVEHAKNLRVNAGDQPGADLGPLITPQAKERVCNLIDSGTKEGASILLDGRKIKVKGYENGNFVGPTIISNVKPNMTCYKEEIFGPVLVVLETETLDEAIQIVNNNPYGNGTAIFTTNGATARKYAHLVDVGQVGVNVPIPVPLPMFSFTGSRSSFRGDTNFYGKQGIQFYTQLKTITSQWKEEDATLSSPAVVMPTMGR

SEQ ID NO: 364 - protein, 364 aa, unidentified
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 365 - protein, 464 aa, unidentified
MAASCLVLLALCLLLPLLLLGGWKRWRRGRAARHVVAVVLGDVGRSPRMQYHALSLAMHGFSVTLLGFCNSKPHDELLQNNRIQIVGLTELQSLAVGPRVFQYGVKVVLQAMYLLWKLMWREPGAYIFLQNPPGLPSIAVCWFVGCLCGSKLVIDWHNYGYSIMGLVHGPNHPLVLLAKWYEKFFGRLSHLNLCVTNAMREDLADNWHIRAVTVYDKPASFFKETPLDLQHRLFMKLGSMHSPFRARSEPEDPVTERSAFTERDAGSGLVTRLRERPALLVSSTSWTEDEDFSILLAALEKFEQLTLDGHNLPSLVCVITGKGPLREYYSRLIHQKHFQHIQVCTPWLEAEDYPLLLGSADLGVCLHTSSSGLDLPMKVVDMFGCCLPVCAVNFKCLHELVKHEENGLVFEDSEELAAQLQMLFSNFPDPAGKLNQFRKNLRESQQLRWDESWVQTVLPLVMDT

SEQ ID NO: 366 - protein, 473 aa, unidentified
MAQLEGYYFSAALSCTFLVSCLLFSAFSRALREPYMDEIFHLPQAQRYCEGHFSLSQWDPMITTLPGLYLVSIGVIKPAIWIFGWSEHVVCSIGMLRFVNLLFSVGNFYLLYLLFCKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLLLLTWPYILLGFLFCAFVVVNGGIVIGDRSSHEACLHFPQLFYFFSFTLFFSFPHLLSPSKIKTFLSLVWKRRILFFVVTLVSVFLVWKFTYAHKYLLADNRHYTFYVWKRVFQRYETVKYLLVPAYIFAGWSIADSLKSKSIFWNLMFFICLFTVIVPQKLLEFRYFILPYVIYRLNIPLPPTSRLICELSCYAVVNFITFFIFLNKTFQWPNSQDIQRFMW

SEQ ID NO: 367 - protein, 473 aa, unidentified
MAQLEGYCFSAALSCTFLVSCLLFSAFSRALREPYMDEIFHLPQAQRYCEGHFSLSQWDPMITTLPGLYLVSVGVVKPAIWIFAWSEHVVCSIGMLRFVNLLFSVGNFYLLYLLFHKVQPRNKAASSIQRVLSTLTLAVFPTLYFFNFLYYTEAGSMFFTLFAYLMCLYGNHKTSAFLGFCGFMFRQTNIIWAVFCAGNVIAQKLTEAWKTELQKKEDRLPPIKGPFAEFRKILQFLLAYSMSFKNLSMLFCLTWPYILLGFLFCAFVVVNGGIVIGDRSSHEACLHFPQLFYFFSFTLFFSFPHLLSPSKIKTFLSLVWKHGILFLVVTLVSVFLVWKFTYAHKYLLADNRHYTFYVWKRVFQRYAILKYLLVPAYIFAGWSIADSLKSKPIFWNLMFFICLFIVIVPQKLLEFRYFILPYVIYRLNITLPPTSRLVCELSCYAIVNFITFYIFLNKTFQWPNSQDIQRFMW

SEQ ID NO: 368 - protein, 492 aa, unidentified
MAAGERSWCLCKLLRFFYSLFFPGLIVCGTLCVCLVIVLWGIRLLLQRKKKLVSTSKNGKNQMVIAFFHPYCNAGGGGERVLWCALRALQKKYPEAVYVVYTGDVNVNGQQILEGAFRRFNIRLIHPVQFVFLRKRYLVEDSLYPHFTLLGQSLGSIFLGWEALMQCVPDVYIDSMGYAFTLPLFKYIGGCQVGSYVHYPTISTDMLSVVKNQNIGFNNAAFITRNPFLSKVKLIYYYLFAFIYGLVGSCSDVVMVNSSWTLNHILSLWKVGNCTNIVYPPCDVQTFLDIPLHEKKMTPGHLLVSVGQFRPEKNHPLQIRAFAKLLNKKMVESPPSLKLVLIGGCRNKDDELRVNQLRRLSEDLGVQEYVEFKINIPFDELKNYLSEATIGLHTMWNEHFGIGVVECMAAGTIILAHNSGGPKLDIVVPHEGDITGFLAESEEDYAETIAHILSMSAEKRLQIRKSARASVSRFSDQEFEVTFLSSVEKLFK

SEQ ID NO: 369 - protein, 488 aa, unidentified
MAGKGSSGRRPLLLGLLVAVATVHLVICPYTKVEESFNLQATHDLLYHWQDLEQYDHLEFPGVVPRTFLGPVVIAVFSSPAVYVLSLLEMSKFYSQLIVRGVLGLGVIFGLWTLQKEVRRHFGAMVATMFCWVTAMQFHLMFYCTRTLPNVLALPVVLLALAAWLRHEWARFIWLSAFAIIVFRVELCLFLGLLLLLALGNRKVSVVRALRHAVPAGILCLGLTVAVDSYFWRQLTWPEGKVLWYNTVLNKSSNWGTSPLLWYFYSALPRGLGCSLLFIPLGLVDRRTHAPTVLALGFMALYSLLPHKELRFIIYAFPMLNITAARGCSYLLNNYKKSWLYKAGSLLVIGHLVVNAAYSATALYVSHFNYPGGVAMQRLHQLVPPQTDVLLHIDVAAAQTGVSRFLQVNSAWRYDKREDVQPGTGMLAYTHILMEAAPGLLALYRDTHRVLASVVGTTGVSLNLTQLPPFNVHLQTKLVLLERLPRPS

SEQ ID NO: 370 - protein, 216 aa, unidentified
MVCVLVLAAAAGAVAVFLILRIWVVLRSMDVTPRESLSILVVAGSGGHTTEILRLLGSLSNAYSPRHYVIADTDEMSANKINSFELDRADRDPSNMYTKYYIHRIPRSREVQQSWPSTVFTTLHSMWLSFPLIHRVKPDLVLCNGPGTCVPICVSALLLGILGIKKVIIVYVESICRVETLSMSGKILFHLSDYFIVQWPALKEKYPKSVYLGRIV

SEQ ID NO: 371 - protein, 416 aa, unidentified
MAEEQGRERDSVPKPSVLFLHPDLGVGGAERLVLDAALALQARGCSVKIWTAHYDPGHCFAESRELPVRCAGDWLPRGLGWGGRGAAVCAYVRMVFLALYVLFLADEEFDVVVCDQVSACIPVFRLARRRKKILFYCHFPDLLLTKRDSFLKRLYRAPIDWIEEYTTGMADCILVNSQFTAAVFKETFKSLSHIDPDVLYPSLNVTSFDSVVPEKLDDLVPKGKKFLLLSINRYERKKNLTLALEALVQLRGRLTSQDWERVHLIVAGGYDERVLENVEHYQELKKMVQQSDLGQYVTFLRSFSDKQKISLLHSCTCVLYTPSNEHFGIVPLEAMYMQCPVIAVNSGGPLESIDHSVTGFLCEPDPVHFSEAIEKFIREPSLKATMGLAGRARVKEKFSPEAFTEQLYRYVTKLLV

SEQ ID NO: 372 - protein, 438 aa, unidentified
MAAGLRKRGRSGSAAQAEGLCKQWLQRAWQERRLLLREPRYTLLVAACLCLAEVGITFWVIHRVAYTEIDWKAYMAEVEGVINGTYDYTQLQGDTGPLVYPAGFVYIFMGLYYATSRGTDIRMAQNIFAVLYLATLLLVFLIYHQTCKVPPFVFFFMCCASYRVHSIFVLRLFNDPVAMVLLFLSINLLLAQRWGWGCCFFSLAVSVKMNVLLFAPGLLFLLLTQFGFRGALPKLGICAGLQVVLGLPFLLENPSGYLSRSFDLGRQFLFHWTVNWRFLPEALFLHRAFHLALLTAHLTLLLLFALCRWHRTGESILSLLRDPSKRKVPPQPLTPNQIVSTLFTSNFIGICFSRSLHYQFYVWYFHTLPYLLWAMPARWLTHLLRLLVLGLIELSWNTYPSTSCSSAALHICHAVILLQLWLGPQPFPKSTQHSKKAH

SEQ ID NO: 373 - protein, 324 aa, unidentified
MAPLLLQLAVLGAALAAAALVLISIVAFTTATKMPALHRHEEEKFFLNAKGQKETLPSIWDSPTKQLSVVVPSYNEEKRLPVMMDEALSYLEKRQKRDPAFTYEVIVVDDGSKDQTSKVAFKYCQKYGSDKVRVITLVKNRGKGGAIRMGIFSSRGEKILMADADGATKFPDVEKLEKGLNDLQPWPNQMAIACGSRAHLEKESIAQRSYFRTLLMYGFHFLVWFLCVKGIRDTQCGFKLFTREAASRTFSSLHVERWAFDVELLYIAQFFKIPIAEIAVNWTEIEGSKLVPFWSWLQMGKDLLFIRLRYLTGAWRLEQTRKMN

SEQ ID NO: 374 - protein, 507 aa, unidentified
MEKWYLMTVVVLIGLTVRWTVSLNSYSGAGKPPMFGDYEAQRHWQEITFNLPVKQWYFNSSDNNLQYWGLDYPPLTAYHSLLCAYVAKFINPDWIALHTSRGYESQAHKLFMRTTVLIADLLIYIPAVVLYCCCLKEISTKKKIANALCILLYPGLILIDYGHFQYNSVSLGFALWGVLGISCDCDLLGSLAFCLAINYKQMELYHALPFFCFLLGKCFKKGLKGKGFVLLVKLACIVVASFVLCWLPFFTEREQTLQVLRRLFPVDRGLFEDKVANIWCSFNVFLKIKDILPRHIQLIMSFCSTFLSLLPACIKLILQPSSKGFKFTLVSCALSFFLFSFQVHEKSILLVSLPVCLVLSEIPFMSTWFLLVSTFSMLPLLLKDELLMPSVVTTMAFFIACVTSFSIFEKTSEEELQLKSFSISVRKYLPCFTFLSRIIQYLFLISVITMVLLTLMTVTLDPPQKLPDLFSVLVCFVSCLNFLFFLVYFNIIIMWDSKSGRNQKKIS

SEQ ID NO: 375 - protein, 526 aa, unidentified
MAALTIATGTGNWFSALALGVTLLKCLLIPTYHSTDFEVHRNWLAITHSLPISQWYYEATSEWTLDYPPFFAWFEYILSHVAKYFDQEMLNVHNLNYSSSRTLLFQRFSVIFMDVLFVYAVRECCKCIDGKKVGKELTEKPKFILSVLLLWNFGLLIVDHIHFQYNGFLFGLMLLSIARLFQKRHMEGAFLFAVLLHFKHIYLYVAPAYGVYLLRSYCFTANKPDGSIRWKSFSFVRVISLGLVVFLVSALSLGPFLALNQLPQVFSRLFPFKRGLCHAYWAPNFWALYNALDKVLSVIGLKLKFLDPNNIPKASMTSGLVQQFQHTVLPSVTPLATLICTLIAILPSIFCLWFKPQGPRGFLRCLTLCALSSFMFGWHVHEKAILLAILPMSLLSVGKAGDASIFLILTTTGHYSLFPLLFTAPELPIKILLMLLFTIYSISSLKTLFRKEKPLFNWMETFYLLGLGPLEVCCEFVFPFTSWKVKYPFIPLLLTSVYCAVGITYAWFKLYVSVLIDSAIGKTKKQ

SEQ ID NO: 376 - protein, 611 aa, unidentified
MASRGARQRLKGSGASSGDTAPAADKLRELLGSREAGGAEHRTELSGNKAGQVWAPEGSTAFKCLLSARLCAALLSNISDCDETFNYWEPTHYLIYGEGFQTWEYSPAYAIRSYAYLLLHAWPAAFHARILQTNKILVFYFLRCLLAFVSCICELYFYKAVCKKFGLHVSRMMLAFLVLSTGMFCSSSAFLPSSFCMYTTLIAMTGWYMDKTSIAVLGVAAGAILGWPFSAALGLPIAFDLLVMKHRWKSFFHWSLMALILFLVPVVVIDSYYYGKLVIAPLNIVLYNVFTPHGPDLYGTEPWYFYLINGFLNFNVAFALALLVLPLTSLMEYLLQRFHVQNLGHPYWLTLAPMYIWFIIFFIQPHKEERFLFPVYPLICLCGAVALSALQKCYHFVFQRYRLEHYTVTSNWLALGTVFLFGLLSFSRSVALFRGYHGPLDLYPEFYRIATDPTIHTVPEGRPVNVCVGKEWYRFPSSFLLPDNWQLQFIPSEFRGQLPKPFAEGPLATRIVPTDMNDQNLEEPSRYIDISKCHYLVDLDTMRETPREPKYSSNKEEWISLAYRPFLDASRSSKLLRAFYVPFLSDQYTVYVNYTILKPRKAKQIRKKSGG

SEQ ID NO: 377 - protein, 1620 aa, unidentified
MGAIGLLWLLPLLLSTAAVGSGMGTGQRAGSPAAGPPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEISVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 378 - protein, 161 aa, unidentified
MDQETVGNVVLLAIVTLISVVQNGFFAHKVEHESRTQNGRSFQRTGTLAFERVYTANQNCVDAYPTFLAVLWSAGLLCSQVPAAFAGLMYLFVRQKYFVGYLGERTQSTPGYIFGKRIILFLFLMSVAGIFNYYLIFFFGSDFENYIKTISTTISPLLLIP

SEQ ID NO: 379 - protein, 1244 aa, unidentified
MNNQKVVAVLLQECKQVLDQLLLEAPDVSEEDKSEDQRCRALLPSELRTLIQEAKEMKWPFVPEKWQYKQAVGPEDKTNLKDVIGAGLQQLLASLRASILARDCAAAAAIVFLVDRFLYGLDVSGKLLQVAKGLHKLQPATPIAPQVVIRQARISVNSGKLLKAEYILSSLISNNGATGTWLYRNESDKVLVQSVCIQIRGQILQKLGMWYEAAELIWASIVGYLALPQPDKKGLSTSLGILADIFVSMSKNDYEKFKNNPQINLSLLKEFDHHLLSAAEACKLAAAFSAYTPLFVLTAVNIRGTCLLSYSSSNDCPPELKNLHLCEAKEAFEIGLLTKRDDEPVTGKQELHSFVKAAFGLTTVHRRLHGETGTVHAASQLCKEAMGKLYNFSTSSRSQDREALSQEVMSVIAQVKEHLQVQSFSNVDDRSYVPESFECRLDKLILHGQGDFQKILDTYSQHHTSVCEVFESDCGNNKNEQKDAKTGVCITALKTEIKNIDTVSTTQEKPHCQRDTGISSSLMGKNVQRELRRGGRRNWTHSDAFRVSLDQDVETETEPSDYSNGEGAVFNKSLSGSQTSSAWSNLSGFSSSASWEEVNYHVDDRSARKEPGKEHLVDTQCSTALSEELENDREGRAMHSLHSQLHDLSLQEPNNDNLEPSQNQPQQQMPLTPFSPHNTPGIFLAPGAGLLEGAPEGIQEVRNMGPRNTSAHSRPSYRSASWSSDSGRPKNMGTHPSVQKEEAFEIIVEFPETNCDVKDRQGKEQGEEISERGAGPTFKASPSWVDPEGETAESTEDAPLDFHRVLHNSLGNISMLPCSSFTPNWPVQNPDSRKSGGPVAEQGIDPDASTVDEEGQLLDSMDVPCTNGHGSHRLCILRQPPGQRAETPNSSVSGNILFPVLSEDCTTTEEGNQPGNMLNCSQNSSSSSVWWLKSPAFSSGSSEGDSPWSYLNSSGSSWVSLPGKMRKEILEARTLQPDDFEKLLAGVRHDWLFQRLENTGVFKPSQLHRAHSALLLKYSKKSELWTAQETIVYLGDYLTVKKKGRQRNAFWVHHLHQEEILGRYVGKDYKEQKGLWHHFTDVERQMTAQHYVTEFNKRLYEQNIPTQIFYIPSTILLILEDKTIKGCISVEPYILGEFVKLSNNTKVVKTEYKATEYGLAYGHFSYEFSNHRDVVVDLQGWVTGNGKGLIYLTDPQIHSVDQKVFTTNFGKRGIFYFFNNQHVECNEICHRLSLTRPSMEKPCT

SEQ ID NO: 380 - protein, 524 aa, unidentified
MISPFLVLAIGTCLTNSLVPEKEKDPKYWRDQAQETLKYALELQKLNTNVAKNVIMFLGDGMGVSTVTAARILKGQLHHNPGEETRLEMDKFPFVALSKTYNTNAQVPDSAGTATAYLCGVKANEGTVGVSAATERSRCNTTQGNEVTSILRWAKDAGKSVGIVTTTRVNHATPSAAYAHSADRDWYSDNEMPPEALSQGCKDIAYQLMHNIRDIDVIMGGGRKYMYPKNKTDVEYESDEKARGTRLDGLDLVDTWKSFKPRYKHSHFIWNRTELLTLDPHNVDYLLGLFEPGDMQYELNRNNVTDPSLSEMVVVAIQILRKNPKGFFLLVEGGRIDHGHHEGKAKQALHEAVEMDRAIGQAGSLTSSEDTLTVVTADHSHVFTFGGYTPRGNSIFGLAPMLSDTDKKPFTAILYGNGPGYKVVGGERENVSMVDYAHNNYQAQSAVPLRHETHGGEDVAVFSKGPMAHLLHGVHEQNYVPHVMAYAACIGANLGHCAPASSAGSLAAGPLLLALALYPLSVLF

SEQ ID NO: 381 - protein, 643 aa, unidentified
MPLLFLERFPWPSLRTYTGLSGLALLGTIISAYRALSQPEAGPGEPDQLTASLQPEPPAPARPSAGGPRARDVAQYLLSDSLFVWVLVNTACCVLMLVAKLIQCIVFGPLRVSERQHLKDKFWNFIFYKFIFIFGVLNVQTVEEVVMWCLWFAGLVFLHLMVQLCKDRFEYLSFSPTTPMSSHGRVLSLLVAMLLSCCGLAAVCSITGYTHGMHTLAFMAAESLLVTVRTAHVILRYVIHLWDLNHEGTWEGKGTYVYYTDFVMELTLLSLDLMHHIHMLLFGNIWLSMASLVIFMQLRYLFHEVQRRIRRHKNYLRVVGNMEARFAVATPEELAVNNDDCAICWDSMQAARKLPCGHLFHNSCLRSWLEQDTSCPTCRMSLNIADNNRVREEHQGENLDENLVPVAAAEGRPRLNQHNHFFHFDGSRIASWLPSFSVEVMHTTNILGITQASNSQLNAMAHQIQEMFPQVPYHLVLQDLQLTRSVEITTDNILEGRIQVPFPTQRSDSIRPALNSPVERPSSDQEEGETSAQTERVPLDLSPRLEETLDFGEVEVEPSEVEDFEARGSRFSKSADERQRMLVQRKDELLQQARKRFLNKSSEDDAASESFLPSEGASSDPVTLRRRMLAAAAERRLQKQQTS

SEQ ID NO: 382 - protein, 573 aa, unidentified
MLGSLGLWALLPTAVEAPPNRRTCVFFEAPGVRGSTKTLGELLDTGTELPRAIRCLYSRCCFGIWNLTQDRAQVEMQGCRDSDEPGCESLHCDPSPRAHPSPGSTLFTCSCGTDFCNANYSHLPPPGSPGTPGSQGPQAAPGESIWMALVLLGLFLLLLLLLGSIILALLQRKNYRVRGEPVPEPRPDSGRDWSVELQELPELCFSQVIREGGHAVVWAGQLQGKLVAIKAFPPRSVAQFQAERALYELPGLQHDHIVRFITASRGGPGRLLSGPLLVLELHPKGSLCHYLTQYTSDWGSSLRMALSLAQGLAFLHEERWQNGQYKPGIAHRDLSSQNVLIREDGSCAIGDLGLALVLPGLTQPPAWTPTQPQGPAAIMEAGTQRYMAPELLDKTLDLQDWGMALRRADIYSLALLLWEILSRCPDLRPDSSPPPFQLAYEAELGNTPTSDELWALAVQERRRPYIPSTWRCFATDPDGLRELLEDCWDADPEARLTAECVQQRLAALAHPQESHPFPESCPRGCPPLCPEDCTSIPAPTILPCRPQRSACHFSVQQGPCSRNPQPACTLSPV

SEQ ID NO: 383 - protein, 493 aa, unidentified
MHPHRDPRGLWLLLPSLSLLLFEVARAGRAVVSCPAACLCASNILSCSKQQLPNVPHSLPSYTALLDLSHNNLSRLRAEWTPTRLTQLHSLLLSHNHLNFISSEAFSPVPNLRYLDLSSNQLRTLDEFLFSDLQVLEVLLLYNNHIMAVDRCAFDDMAQLQKLYLSQNQISRFPLELVKEGAKLPKLTLLDLSSNKLKNLPLPDLQKLPAWIKNGLYLHNNPLNCDCELYQLFSHWQYRQLSSVMDFQEDLYCMNSKKLHNVFNLSFLNCGEYKERAWEAHLGDTLIIKCDTKQQGMTKVWVTPSNERVLDEVTNGTVSVSKDGSLLFQQVQVEDGGVYTCYAMGETFNETLSVELKVHNFTLHGHHDTLNTAYTTLVGCILSVVLVLIYLYLTPCRCWCRGVEKPSSHQGDSLSSSMLSTTPNHDPMAGGDKDDGFDRRVAFLEPAGPGQGQNGKLKPGNTLPVPEATGKGQRRMSDPESVSSVFSDTPIVV

SEQ ID NO: 384 - protein, 522 aa, unidentified
MSLRVHTLPTLLGAVVRPGCRELLCLLMITVTVGPGASGVCPTACICATDIVSCTNKNLSKVPGNLFRLIKRLDLSYNRIGLLDSEWIPVSFAKLNTLILRHNNITSISTGSFSTTPNLKCLDLSSNKLKTVKNAVFQELKVLEVLLLYNNHISYLDPSAFGGLSQLQKLYLSGNFLTQFPMDLYVGRFKLAELMFLDVSYNRIPSMPMHHINLVPGKQLRGIYLHGNPFVCDCSLYSLLVFWYRRHFSSVMDFKNDYTCRLWSDSRHSRQVLLLQDSFMNCSDSIINGSFRALGFIHEAQVGERLMVHCDSKTGNANTDFIWVGPDNRLLEPDKEMENFYVFHNGSLVIESPRFEDAGVYSCIAMNKQRLLNETVDVTINVSNFTVSRSHAHEAFNTAFTTLAACVASIVLVLLYLYLTPCPCKCKTKRQKNMLHQSNAHSSILSPGPASDASADERKAGAGKRVVFLEPLKDTAAGQNGKVRLFPSEAVIAEGILKSTRGKSDSDSVNSVFSDTPFVAST

SEQ ID NO: 385 - protein, 504 aa, unidentified
MTWLVLLGTLLCMLRVGLGTPDSEGFPPRALHNCPYKCICAADLLSCTGLGLQDVPAELPAATADLDLSHNALQRLRPGWLAPLFQLRALHLDHNELDALGRGVFVNASGLRLLDLSSNTLRALGRHDLDGLGALEKLLLFNNRLVHLDEHAFHGLRALSHLYLGCNELASFSFDHLHGLSATHLLTLDLSSNRLGHISVPELAALPAFLKNGLYLHNNPLPCDCRLYHLLQRWHQRGLSAVRDFAREYVCLAFKVPASRVRFFQHSRVFENCSSAPALGLERPEEHLYALVGRSLRLYCNTSVPAMRIAWVSPQQELLRAPGSRDGSIAVLADGSLAIGNVQEQHAGLFVCLATGPRLHHNQTHEYNVSVHFPRPEPEAFNTGFTTLLGCAVGLVLVLLYLFAPPCRCCRRACRCRRWPQTPSPLQELSAQSSVLSTTPPDAPSRKASVHKHVVFLEPGRRGLNGRVQLAVAEEFDLYNPGGLQLKAGSESASSIGSEGPMTT

SEQ ID NO: 386 - protein, 453 aa, unidentified
MGVLGRVLLWLQLCALTQAVSKLWVPNTDFDVAANWSQNRTPCAGGAVEFPADKMVSVLVQEGHAVSDMLLPLDGELVLASGAGFGVSDVGSHLDCGAGEPAVFRDSDRFSWHDPHLWRSGDEAPGLFFVDAERVPCRHDDVFFPPSASFRVGLGPGASPVRVRSISALGRTFTRDEDLAVFLASRAGRLRFHGPGALSVGPEDCADPSGCVCGNAEAQPWICAALLQPLGGRCPQAACHSALRPQGQCCDLCGAVVLLTHGPAFDLERYRARILDTFLGLPQYHGLQVAVSKVPRSSRLREADTEIQVVLVENGPETGGAGRLARALLADVAENGEALGVLEATMRESGAHVWGSSAAGLAGGVAAAVLLALLVLLVAPPLLRRAGRLRWRRHEAAAPAGAPLGFRNPVFDVTASEELPLPRRLSLVPKAAADSTSHSYFVNPLFAGAEAEA

SEQ ID NO: 387 - protein, 1944 aa, unidentified
MSNFYEERTTMIAARDLQEFVPFGRDHCKHHPNALNLQLRQLQPASELWSSDGAAGLVGSLQEVTIHEKQKESWQLRKGVSEIGEDVDYDEELYVAGNMVIWSKGSKSQALAVYKAFTVDSPVQQALWCDFIISQDKSEKAYSSNEVEKCICILQSSCINMHSIEGKDYIASLPFQVANVWPTKYGLLFERSASSHEVPPGSPREPLPTMFSMLHPLDEITPLVCKSGSLFGSSRVQYVVDHAMKIVFLNTDPSIVMTYDAVQNVHSVWTLRRVKSEEENVVLKFSEQGGTPQNVATSSSLTAHLRSLSKGDSPVTSPFQNYSSIHSQSRSTSSPSLHSRSPSISNMAALSRAHSPALGVHSFSGVQRFNISSHNQSPKRHSISHSPNSNSNGSFLAPETEPIVPELCIDHLWTETITNIREKNSQASKVFITSDLCGQKFLCFLVESQLQLRCVKFQESNDKTQLIFGSVTNIPAKDAAPVEKIDTMLVLEGSGNLVLYTGVVRVGKVFIPGLPAPSLTMSNTMPRPSTPLDGVSTPKPLSKLLGSLDEVVLLSPVPELRDSSKLHDSLYNEDCTFQQLGTYIHSIRDPVHNRVTLELSNGSMVRITIPEIATSELVQTCLQAIKFILPKEIAVQMLVKWYNVHSAPGGPSYHSEWNLFVTCLMNMMGYNTDRLAWTRNFDFEGSLSPVIAPKKARPSETGSDDDWEYLLNSDYHQNVESHLLNRSLCLSPSEASQMKDEDFSQNLSLDSSTLLFTHIPAIFFVLHLVYEELKLNTLMGEGICSLVELLVQLARDLKLGPYVDHYYRDYPTLVRTTGQVCTIDPGQTGFMHHPSFFTSEPPSIYQWVSSCLKGEGMPPYPYLPGICERSRLVVLSIALYILGDESLVSDESSQYLTRITIAPQKLQVEQEENRFSFRHSTSVSSLAERLVVWMTNVGFTLRDLETLPFGIALPIRDAIYHCREQPASDWPEAVCLLIGRQDLSKQACEGNLPKGKSVLSSDVPSGTETEEEDDGMNDMNHEVMSLIWSEDLRVQDVRRLLQSAHPVRVNVVQYPELSDHEFIEEKENRLLQLCQRTMALPVGRGMFTLFSYHPVPTEPLPIPKLNLTGRAPPRNTTVDLNSGNIDVPPNMTSWASFHNGVAAGLKIAPASQIDSAWIVYNKPKHAELANEYAGFLMALGLNGHLTKLATLNIHDYLTKGHEMTSIGLLLGVSAAKLGTMDMSITRLLSIHIPALLPPTSTELDVPHNVQVAAVVGIGLVYQGTAHRHTAEVLLAEIGRPPGPEMEYCTDRESYSLAAGLALGMVCLGHGSNLIGMSDLNVPEQLYQYMVGGHRRFQTGMHREKHKSPSYQIKEGDTINVDVTCPGATLALAMIYLKTNNRSIADWLRAPDTMYLLDFVKPEFLLLRTLARCLILWDDILPNSKWVDSNVPQIIRENSISLSEIELPCSEDLNLETLSQAHVYIIAGACLSLGFRFAGSENLSAFNCLHKFAKDFMTYLSAPNASVTGPHNLETCLSVVLLSLAMVMAGSGNLKVLQLCRFLHMKTGGEMNYGFHLAHHMALGLLFLGGGRYSLSTSNSSIAALLCALYPHFPAHSTDNRYHLQALRHLYVLAAEPRLLVPVDVDTNTPCYALLEVTYKGTQWYEQTKEELMAPTLLPELHLLKQIKVKGPRYWELLIDLSKGTQHLKSILSKDGVLYVKLRAGQLSYKEDPMGWQSLLAQTVANRNSEARAFKPETISAFTSDPALLSFAEYFCKPTVNMGQKQEILDLFSSVLYECVTQETPEMLPAYIAMDQAIRRLGRREMSETSELWQIKLVLEFFSSRSHQERLQNHPKRGLFMNSEFLPVVKCTIDNTLDQWLQVGGDMCVHAYLSGQPLEESQLSMLACFLVYHSVPAPQHLPPIGLEGSTSFAELLFKFKQLKMPVRALLRLAPLLLGNPQPMVM

SEQ ID NO: 388 - protein, 492 aa, unidentified
MVKFPALTHYWPLIRFLVPLGITNIAIDFGEQALNRGIAAVKEDAVEMLASYGLAYSLMKFFTGPMSDFKNVGLVFVNSKRDRTKAVLCMVVAGAIAAVFHTLIAYSDLGYYIINKLHHVDESVGSKTRRAFLYLAAFPFMDAMAWTHAGILLKHKYSFLVGCASISDVIAQVVFVAILLHSHLECREPLLIPILSLYMGALVRCTTLCLGYYKNIHDIIPDRSGPELGGDATIRKMLSFWWPLALILATQRISRPIVNLFVSRDLGGSSAATEAVAILTATYPVGHMPYGWLTEIRAVYPAFDKNNPSNKLVSTSNTVTAAHIKKFTFVCMALSLTLCFVMFWTPNVSEKILIDIIGVDFAFAELCVVPLRIFSFFPVPVTVRAHLTGWLMTLKKTFVLAPSSVLRIIVLIASLVVLPYLGVHGATLGVGSLLAGFVGESTMVAIAACYVYRKQKKKMENESATEGEDSAMTDMPPTEEVTDIVEMREENE

SEQ ID NO: 389 - protein, 615 aa, unidentified
MCSEARLARRLRDALREEEPWAVEELLRCGADPNLVLEDGAAAVHLAAGARHPRGLRCLGALLRQGGDPNARSVEALTPLHVAAAWGCRRGLELLLSQGADPALRDQDGLRPLDLALQQGHLECARVLQDLDTRTRTRTRIGAETQEPEPAPGTPGLSGPTDETLDSIALQKQPCRGDNRDIGLEADPGPPSLPVPLETVDKHGSSASPPGHWDYSSDASFVTAVEVSGAEDPASDTPPWAGSLPPTRQGLLHVVHANQRVPRSQGTEAELNARLQALTLTPPNAAGFQSSPSSMPLLDRSPAHSPPRTPTPGASDCHCLWEHQTSIDSDMATLWLTEDEASSTGGREPVGPCRHLPVSTVSDLELLKGLRALGENPHPITPFTRQLYHQQLEEAQIAPGPEFSGHSLELAAALRTGCIPDVQADEDALAQQFEQPDPARRWREGVVKSSFTYLLLDPRETQDLPARAFSLTPAERLQTFIRAIFYVGKGTRARPYVHLWEALGHHGRSRKQPHQACPKVRQILDIWASGCGVVSLHCFQHVVAVEAYTREACIVEALGIQTLTNQKQGHCYGVVAGWPPARRRRLGVHLLHRALLVFLAEGERQLHPQDIQARG

SEQ ID NO: 390 - protein, 938 aa, unidentified
MLWPRLAAAEWAALAWELLGASVLLIAVRWLVRRLGPRPGGLGRSGTPVPPPSAAAAPASGEMTMDALLARLKLLNPDDLREEIVKAGLKCGPITSTTRFIFEKKLAQALLEQGGRLSSFYHHEAGVTALSQDPQRILKPAEGNPTDQAGFSEDRDFGYSVGLNPPEEEAVTSKTCSVPPSDTDTYRAGATASKEPPLYYGVCPVYEDVPARNERIYVYENKKEALQAVKMIKGSRFKAFSTREDAEKFARGICDYFPSPSKTSLPLSPVKTAPLFSNDRLKDGLCLSESETVNKERANSYKNPRTQDLTAKLRKAVEKGEEDTFSDLIWSNPRYLIGSGDNPTIVQEGCRYNVMHVAAKENQASICQLTLDVLENPDFMRLMYPDDDEAMLQKRIRYVVDLYLNTPDKMGYDTPLHFACKFGNADVVNVLSSHHLIVKNSRNKYDKTPEDVICERSKNKSVELKERIREYLKGHYYVPLLRAEETSSPVIGELWSPDQTAEASHVSRYGGSPRDPVLTLRAFAGPLSPAKAEDFRKLWKTPPREKAGFLHHVKKSDPERGFERVGRELAHELGYPWVEYWEFLGCFVDLSSQEGLQRLEEYLTQQEIGKKAQQETGEREASCRDKATTSGSNSISVRAFLDEDDMSLEEIKNRQNAARNNSPPTVGAFGHTRCSAFPLEQEADLIEAAEPGGPHSSRNGLCHPLNHSRTLAGKRPKAPRGEEAHLPPVSDLTVEFDKLNLQNIGRSVSKTPDESTKTKDQILTSRINAVERDLLEPSPADQLGNGHRRTESEMSARIAKMSLSPSSPRHEDQLEVTREPARRLFLFGEEPSKLDQDVLAALECADVDPHQFPAVHRWKSAVLCYSPSDRQSWPSPAVKGRFKSQLPDLSGPHSYSPGRNSVAGSNPAKPGLGSPGRYSPVHGSQLRRMARLAELAAL

SEQ ID NO: 391 - protein, 301 aa, unidentified
MCRMSFKKETPLANAAFWAARRGNLALLKLLLNSGRVDVDCRDSHGTTLLMVAAYAGHIDCVRELVLQGADINLQRESGTTALFFAAQQGHNDVVRFLFGFGASTEFRTKDGGTALLAASQYGHMQVVETLLKHGANIHDQLYDGATALFLAAQGGYLDVIRLLLASGAKVNQPRQDGTAPLWIASQMGHSEVVRVMLLRGADRDAARNDGTTALLKAANKGYNDVIKELLKFSPTLGILKNGTSALHAAVLSGNIKTVALLLEAGADPSLRNKANELPAELTKNERILRLLRSKEGPRKS

SEQ ID NO: 392 - protein, 232 aa, unidentified
MSYVFVNDSSQTNVPLLQACIDGDFNYSKRLLESGFDPNIRDSRGRTGLHLAAARGNVDICQLLHKFGADLLATDYQGNTALHLCGHVDTIQFLVSNGLKIDICNHQGATPLVLAKRRGVNKDVIRLLESLEEQEVKGFNRGTHSKLETMQTAESESAMESHSLLNPNLQQGEGVLSSFRTTWQEFVEDLGFWRVLLLIFVIALLSLGIAYYRRTLRLGSFARQDRSRIQAI

SEQ ID NO: 393 - protein, 986 aa, unidentified
MRVNEKYSTLPAEDRSVHIINICAIEDIGYLPSEGTLLNSLSVDPDAECKYGLYFRDGRRKVDYILVYHHKRPSGNRTLVRRVQHSDTPSGARSVKQDHPLPGKGASLDAGSGEPPMDYHEDDKRFRREEYEGNLLEAGLELERDEDTKIHGVGFVKIHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEEAVKDHPRAEYEARVLEKSLKKESRNKEKRRHIPEESTNKWKQRVKTAMAGVKLTDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 394 - protein, 660 aa, unidentified
MKVTLSALDTSESSFTPLVVIELAQDVKEETKEWLKNRIIAKKKDGGAQLLFRPLLNKYEQETLENQNLYLVGASKIRMLLGAEAVGLVKECNDNTMRAFTYRTRQNFKGFDDNNDDFLTMAECQFIIKHELENLRAKDEKMIPGYPQAKLYPGKSLLRRLLTSGIVIQVFPLHDSEALKKLEDTWYTRFALKYQPIDSIRGYFGETIALYFGFLEYFTFALIPMAVIGLPYYLFVWEDYDKYVIFASFNLIWSTVILELWKRGCANMTYRWGTLLMKRKFEEPRPGFHGVLGINSITGKEEPLYPSYKRQLRIYLVSLPFVCLCLYFSLYVMMIYFDMEVWALGLHENSGSEWTSVLLYVPSIIYAIVIEIMNRLYRYAAEFLTSWENHRLESAYQNHLILKVLVFNFLNCFASLFYIAFVLKDMKLLRQSLATLLITSQILNQIMESFLPYWLQRKHGVRVKRKVQALKADIDATLYEQVILEKEMGTYLGTFDDYLELFLQFGYVSLFSCVYPLAAAFAVLNNFTEVNSDALKMCRVFKRPFSEPSANIGVWQLAFETMSVISVVTNCALIGMSPQVNAVFPESKADLILIVVAVEHALLALKFILAFAIPDKPRHIQMKLARLEFESLEALKQQQMKLVTENLKEEPMESGKEKAT

SEQ ID NO: 395 - protein, 1003 aa, unidentified
MATPGPRDIPLLPGSPRRLSPQAGSRGGQGPKHGQQCLKMPGPRAPGLQGGSNRDPGQPCGGESTRSSSVINNYLDANEPVSLEARLSRMHFHDSQRKVDYVLAYHYRKRGVHLAQGFPGHSLAIVSNGETGKEPHAGGPGDIELGPLDALEEERKEQREEFEHNLMEAGLELEKDLENKSQGSIFVRIHAPWQVLAREAEFLKIKVPTKKEMYEIKAGGSIAKKFSAALQKLSSHLQPRVPEHSNNKMKNLSYPFSREKMYLYNIQEKDTFFDNATRSRIVHEILKRTACSRANNTMGINSLIANNIYEAAYPLHDGEYDSPEDDMNDRKLLYQEWARYGVFYKFQPIDLIRKYFGEKIGLYFAWLGLYTSFLIPSSVIGVIVFLYGCATIEEDIPSREMCDQQNAFTMCPLCDKSCDYWNLSSACGTAQASHLFDNPATVFFSIFMALWATMFLENWKRLQMRLGYFWDLTGIEEEEERAQEHSRPEYETKVREKMLKESNQSAVQKLETNTTECGDEDDEDKLTWKDRFPGYLMNFASILFMIALTFSIVFGVIVYRITTAAALSLNKATRSNVRVTVTATAVIINLVVILILDEIYGAVAKWLTKIEVPKTEQTFEERLILKAFLLKFVNAYSPIFYVAFFKGRFVGRPGSYVYVFDGYRMEECAPGGCLMELCIQLSIIMLGKQLIQNNIFEIGVPKLKKLFRKLKDETEAGETDSAHSKHPEQWDLDYSLEPYTGLTPEYMEMIIQFGFVTLFVASFPLAPVFALLNNVIEVRLDAKKFVTELRRPDAVRTKDIGIWFDILSGIGKFSVISNAFVIAITSDFIPRLVYQYSYSHNGTLHGFVNHTLSFFNVSQLKEGTQPENSQFDQEVQFCRFKDYREPPWAPNPYEFSKQYWFILSARLAFVIIFQNLVMFLSVLVDWMIPDIPTDISDQIKKEKSLLVDFFLKEEHEKLKLMDEPALRSPGGGDRSRSRAASSAPSGQSQLGSMMSSGSQHTNV

SEQ ID NO: 396 - protein, 981 aa, unidentified
MVHHSGSIQSFKQQKGMNISKSEITKETSLKPSRRSLPCLAQSYAYSKSLSQSTSLFQSTESESQAPTSITLISTDKAEQVNTEENKNDSVLRCSFADLSDFCLALGKDKDYTDESEHATYDRSRLINDFVIKDKSEFKTKLSKNDMNYIASSGPLFKDGKKRIDYILVYRKTNIQYDKRNTFEKNLRAEGLMLEKEPAIASPDIMFIKIHIPWDTLCKYAERLNIRMPFRKKCYYTDGRSKSMGRMQTYFRRIKNWMAQNPMVLDKSAFPDLEESDCYTGPFSRARIHHFIINNKDTFFSNATRSRIVYHMLERTKYENGISKVGIRKLINNGSYIAAFPPHEGAYKSSQPIKTHGPQNNRHLLYERWARWGMWYKHQPLDLIRLYFGEKIGLYFAWLGWYTGMLIPAAIVGLCVFFYGLFTMNNSQVSQEICKATEVFMCPLCDKNCSLQRLNDSCIYAKVTYLFDNGGTVFFAIFMAIWATVFLEFWKRRRSILTYTWDLIEWEEEEETLRPQFEAKYYKMEIVNPITGKPEPHQPSSDKVTRLLVSVSGIFFMISLVITAVFGVVVYRLVVMEQFASFKWNFIKQYWQFATSAAAVCINFIIIMLLNLAYEKIAYLLTNLEYPRTESEWENSFALKMFLFQFVNLNSSIFYIAFFLGRFVGHPGKYNKLFDRWRLEECHPSGCLIDLCLQMGVIMFLKQIWNNFMELGYPLIQNWWSRHKIKRGIHDASIPQWENDWNLQPMNLHGLMDEYLEMVLQFGFTTIFVAAFPLAPLLALLNNIIEIRLDAYKFVTQWRRPLPARATDIGIWLGILEGIGILAVITNAFVIAITSDYIPRFVYEYKYGPCANHVEPSENCLKGYVNNSLSFFDLSELGMGKSGYCRYRDYRGPPWSSKPYEFTLQYWHILAARLAFIIVFEHLVFGIKSFIAYLIPDVPKGLHDRIRREKYLVQEMMYEAELEHLQQQRRKSGQPVHHEWP

SEQ ID NO: 397 - protein, 955 aa, unidentified
MEASSSGITNGKTKVFHPEGGVDLQGYQLDMQILPDGPKSDVDFSEILNAIQEMAKDVNILFDELEAVSSPCKDDDSLLHPGNLTSTSDDASRLEAGGETVPERNKSNGLYFRDGKCRIDYILVYRKSNPQTEKREVFERNIRAEGLQMEKESSLINSDIIFVKLHAPWEVLGRYAEQMNVRMPFRRKIYYLPRRYKFMSRIDKQISRFRRWLPKKPMRLDKETLPDLEENDCYTAPFSQQRIHHFIIHNKETFFNNATRSRIVHHILQRIKYEEGKNKIGLNRLLTNGSYEAAFPLHEGSYRSKNSIRTHGAENHRHLLYECWASWGVWYKYQPLDLVRRYFGEKIGLYFAWLGWYTGMLFPAAFIGLFVFLYGVTTLDHSQVSKEVCQATDIIMCPVCDKYCPFMRLSDSCVYAKVTHLFDNGATVFFAVFMAVWATVFLEFWKRRRAVIAYDWDLIDWEEEEEEIRPQFEAKYSKKERMNPISGKPEPYQAFTDKCSRLIVSASGIFFMICVVIAAVFGIVIYRVVTVSTFAAFKWALIRNNSQVATTGTAVCINFCIIMLLNVLYEKVALLLTNLEQPRTESEWENSFTLKMFLFQFVNLNSSTFYIAFFLGRFTGHPGAYLRLINRWRLEECHPSGCLIDLCMQMGIIMVLKQTWNNFMELGYPLIQNWWTRRKVRQEHGPERKISFPQWEKDYNLQPMNAYGLFDEYLEMILQFGFTTIFVAAFPLAPLLALLNNIIEIRLDAYKFVTQWRRPLASRAKDIGIWYGILEGIGILSVITNAFVIAITSDFIPRLVYAYKYGPCAGQGEAGQKCMVGYVNASLSVFRISDFENRSEPESDGSEFSGTPLKYCRYRDYRDPPHSLVPYGYTLQFWHVLAARLAFIIVFEHLVFCIKHLISYLIPDLPKDLRDRMRREKYLIQEMMYEAELERLQKERKERKKNGKAHHNEWP

SEQ ID NO: 398 - protein, 913 aa, unidentified
MGDPDLLEVLAEEGEKVNKHIDYSFQMSEQSLSSRETSFLINEETMPAKRFNLFLRRRLMFQKNQQSKDSIFFRDGIRQIDFVLSYVDDVKKDAELKAERRKEFETNLRKTGLELEIEDKRDSEDGRTYFVKIHAPWEVLVTYAEVLGIKMPIKESDIPRPKHTPISYVLGPVRLPLSVKYPHPEYFTAQFSRHRQELFLIEDQATFFPSSSRNRIVYYILSRCPFGIEDGKKRFGIERLLNSNTYSSAYPLHDGQYWKPSEPPNPTNERYTLHQNWARFSYFYKEQPLDLIKNYYGEKIGIYFVFLGFYTEMLFFAAVVGLACFIYGLLSMEHNTSSTEICDPEIGGQMIMCPLCDQVCDYWRLNSTCLASKFSHLFDNESTVFFAIFMGIWVTLFLEFWKQRQARLEYEWDLVDFEEEQQQLQLRPEFEAMCKHRKLNAVTKEMEPYMPLYTRIPWYFLSGATVTLWMSLVVTSMVAVIVYRLSVFATFASFMESDASLKQVKSFLTPQITTSLTGSCLNFIVILILNFFYEKISAWITKMEIPRTYQEYESSLTLKMFLFQFVNFYSSCFYVAFFKGKFVGYPGKYTYLFNEWRSEECDPGGCLIELTTQLTIIMTGKQIFGNIKEAIYPLALNWWRRRKARTNSEKLYSRWEQDHDLESFGPLGLFYEYLETVTQFGFVTLFVASFPLAPLLALINNIVEIRVDAWKLTTQYRRTVASKAHSIGVWQDILYGMAVLSVATNAFIVAFTSDIIPRLVYYYAYSTNATQPMTGYVNNSLSVFLIADFPNHTAPSEKRDFITCRYRDYRYPPDDENKYFHNMQFWHVLAAKMTFIIVMEHVVFLVKFLLAWMIPDVPKDVVERIKREKLMTIKILHDFELNKLKENLGINSNEFAKHVMIEENKAQLAKSTL

SEQ ID NO: 399 - protein, 910 aa, unidentified
MKKMSRNVLLQMEEEEDDDDGDIVLENLGQTIVPDLGSLESQHDFRTPEFEEFNGKPDSLFFNDGQRRIDFVLVYEDESRKETNKKGTNEKQRRKRQAYESNLICHGLQLEATRSVLDDKLVFVKVHAPWEVLCTYAEIMHIKLPLKPNDLKNRSSAFGTLNWFTKVLSVDESIIKPEQEFFTAPFEKNRMNDFYIVDRDAFFNPATRSRIVYFILSRVKYQVINNVSKFGINRLVNSGIYKAAFPLHDCKFRRQSEDPSCPNERYLLYREWAHPRSIYKKQPLDLIRKYYGEKIGIYFAWLGYYTQMLLLAAVVGVACFLYGYLNQDNCTWSKEVCHPDIGGKIIMCPQCDRLCPFWKLNITCESSKKLCIFDSFGTLVFAVFMGVWVTLFLEFWKRRQAELEYEWDTVELQQEEQARPEYEARCTHVVINEITQEEERIPFTAWGKCIRITLCASAVFFWILLIIASVIGIIVYRLSVFIVFSAKLPKNINGTDPIQKYLTPQTATSITASIISFIIIMILNTIYEKVAIMITNFELPRTQTDYENSLTMKMFLFQFVNYYSSCFYIAFFKGKFVGYPGDPVYWLGKYRNEECDPGGCLLELTTQLTIIMGGKAIWNNIQEVLLPWIMNLIGRFHRVSGSEKITPRWEQDYHLQPMGKLGLFYEYLEMIIQFGFVTLFVASFPLAPLLALVNNILEIRVDAWKLTTQFRRLVPEKAQDIGAWQPIMQGIAILAVVTNAMIIAFTSDMIPRLVYYWSFSVPPYGDHTSYTMEGYINNTLSIFKVADFKNKSKGNPYSDLGNHTTCRYRDFRYPPGHPQEYKHNIYYWHVIAAKLAFIIVMEHVIYSVKFFISYAIPDVSKRTKSKIQREKYLTQKLLHENHLKDMTKNMGVIAERMIEAVDNNLRPKSE

SEQ ID NO: 400 - protein, 933 aa, unidentified
MRMAATAWAGLQGPPLPTLCPAVRTGLYCRDQAHAERWAMTSETSSGSHCARSRMLRRRAQEEDSTVLIDVSPPEAEKRGSYGSTAHASEPGGQQAAACRAGSPAKPRIADFVLVWEEDLKLDRQQDSAARDRTDMHRTWRETFLDNLRAAGLCVDQQDVQDGNTTVHYALLSASWAVLCYYAEDLRLKLPLQELPNQASNWSAGLLAWLGIPNVLLEVVPDVPPEYYSCRFRVNKLPRFLGSDNQDTFFTSTKRHQILFEILAKTPYGHEKKNLLGIHQLLAEGVLSAAFPLHDGPFKTPPEGPQAPRLNQRQVLFQHWARWGKWNKYQPLDHVRRYFGEKVALYFAWLGFYTGWLLPAAVVGTLVFLVGCFLVFSDIPTQELCGSKDSFEMCPLCLDCPFWLLSSACALAQAGRLFDHGGTVFFSLFMALWAVLLLEYWKRKSATLAYRWDCSDYEDTEERPRPQFAASAPMTAPNPITGEDEPYFPERSRARRMLAGSVVIVVMVAVVVMCLVSIILYRAIMAIVVSRSGNTLLAAWASRIASLTGSVVNLVFILILSKIYVSLAHVLTRWEMHRTQTKFEDAFTLKVFIFQFVNFYSSPVYIAFFKGRFVGYPGNYHTLFGVRNEECAAGGCLIELAQELLVIMVGKQVINNMQEVLIPKLKGWWQKFRLRSKKRKAGASAGASQGPWEDDYELVPCEGLFDEYLEMVLQFGFVTIFVAACPLAPLFALLNNWVEIRLDARKFVCEYRRPVAERAQDIGIWFHILAGLTHLAVISNAFLLAFSSDFLPRAYYRWTRAHDLRGFLNFTLARAPSSFAAAHNRTCRYRAFRDDDGHYSQTYWNLLAIRLAFVIVFEHVVFSVGRLLDLLVPDIPESVEIKVKREYYLAKQALAENEVLFGTNGTKDEQPEGSELSSHWTPFTVPKASQLQQ

SEQ ID NO: 401 - protein, 1232 aa, unidentified
MAEAASGAGGTSLEGERGKRPPPEGEPAAPASGVLDKLFGKRLLQAGRYLVSHKAWMKTVPTENCDVLMTFPDTTDDHTLLWLLNHIRVGIPELIVQVRHHRHTRAYAFFVTATYESLLRGADELGLRKAVKAEFGGGTRGFSCEEDFIYENVESELRFFTSQERQSIIRFWLQNLRAKQGEALHNVRFLEDQPIIPELAARGIIQQVFPVHEQRILNRLMKSWVQAVCENQPLDDICDYFGVKIAMYFAWLGFYTSAMVYPAVFGSVLYTFTEADQTSRDVSCVVFALFNVIWSTLFLEEWKRRGAELAYKWGTLDSPGEAVEEPRPQFRGVRRISPITRAEEFYYPPWKRLLFQLLVSLPLCLACLVCVFLLMLGCFQLQELVLSVKGLPRLARFLPKVMLALLVSVSAEGYKKLAIWLNDMENYRLESAYEKHLIIKVVLFQFVNSYLSLFYIGFYLKDMERLKEMLATLLITRQFLQNVREVLQPHLYRRLGRGELGLRAVWELARALLGLLSLRRPAPRRLEPQADEGGGGGSGGGGRRCLSGGCGAPEEEEEAALVERRRAGEGGEEGDGPPGGKEEDEDDEEEEDEEEEEDEEEGEEGGLLDCGLRLKKVSFAERGAGRRRPGPSPEALLEEGSPTMVEKGLEPGVFTLAEEDDEAEGAPGSPEREPPAILFRRAGGEGRDQGPDGGPDPEPGSNSDSTRRQRRQNRSSWIDPPEEEHSPQLTQAELESCMKKYEDTFQDYQEMFVQFGYVVLFSSAFPLAALCALVNNLIEIRSDAFKLCTGLQRPFGQRVESIGQWQKVMEAMGVLAIVVNCYLIGQCGQLQRLFPWLSPEAAIVSVVVLEHFALLLKYLIHVAIPDIPGWVAEEMAKLEYQRREAFKRHERQAQHRYQQQQRRRREEEERQRHAEHHARREHDSGGREEARAEGSGLDPATSSEKASAKAKGSTAGGHGPERPKRPGSLLAPNNVMKLKQIIPLQGKFLSSGATSSLAAAGAGATTRPPPAQSPTGSDTRLPAFLSFKFLKSPETRRDSERSHSPPKAFHAGKLFPFGGTRAEPGSNGAGGQARPDGTPSSGSSRVQRSGPVDEALAEELEAPRPEEEGSGTALAPVGAPALRTRRSRSPAPPPPMPLPRPPTPPAGCWQWDGPWGCGGEGAAPRQALAAAECPPCAMAGPPPAPQPLPGDASFYSLPPPPLPPTSDPLETPAPSPSPSPSPQAVCWPSGWH

SEQ ID NO: 402 - protein, 782 aa, unidentified
MQGEESLRILVEPEGDSFPLMEISTCETEASEQWDYVLVAQRHTQRDPRQARQQQFLEELRRKGFHIKVIRDQKQVFFGIRADNSVFGLYRTLLLEPEGPAPHAELAAPTTIPVTTSLRIRIVNFVVMNNKTSAGETFEDLMKDGVFEARFPLHKGEGRLKKTWARWRHMFREQPVDEIRNYFGEKVALYFVWLGWYTYMLVPAALTGLLVFLSGFSLFEASQISKEICEAHDILMCPLGDHSRRYQRLSETCTFAKLTHLFDNDGTVVFAIFMALWATVFLEIWKRQRARVVLHWDLYVWDEEQEEMALQLINCPDYKLRPYQHSYLRSTVILVLTLLMICLMIGMAHVLVVYRVLASALFSSSAVPFLEEQVTTAVVVTGALVHYVTIIIMTKINRCVALKLCDFEMPRTFSERESRFTIRFFTLQFFTHFSSLIYIAFILGRINGHPGKSTRLAGLWKLEECHASGCMMDLFVQMAIIMGLKQTLSNCVEYLVPWVTHKCRSLRASESGHLPRDPELRDWRRNYLLNPVNTFSLFDEFMEMMIQYGFTTIFVAAFPLAPLLALFSNLVEIRLDAIKMVWLQRRLVPRKAKDIGTWLQVLETIGVLAVIANGMVIAFTSEFIPRVVYKYRYSPCLKEGNSTVDCLKGYVNHSLSVFHTKDFQDPDGIEGSENVTLCRYRDYRNPPDYNFSEQFWFLLAIRLAFVILFEHVALCIKLIAAWFVPDIPQSVKNKVLEVKYQRLREKMWHGRQRLGGVGAGSRPPMPAHPTPASIFSARSTDV

SEQ ID NO: 403 - protein, 967 aa, unidentified
MAKGFYISKSLGILGILLGVAAVCTIIALSVVYSQEKNKNANSSPVASTTPSASATTNPASATTLDQSKAWNRYRLPNTLKPDSYRVTLRPYLTPNDRGLYVFKGSSTVRFTCKEATDVIIIHSKKLNYTLSQGHRVVLRGVGGSQPPDIDKTELVEPTEYLVVHLKGSLVKDSQYEMDSEFEGELADDLAGFYRSEYMEGNVRKVVATTQMQAADARKSFPCFDEPAMKAEFNITLIHPKDLTALSNMLPKGPSTPLPEDPNWNVTEFHTTPKMSTYLLAFIVSEFDYVEKQASNGVLIRIWARPSAIAAGHGDYALNVTGPILNFFAGHYDTPYPLPKSDQIGLPDFNAGAMENWGLVTYRENSLLFDPLSSSSSNKERVVTVIAHELAHQWFGNLVTIEWWNDLWLNEGFASYVEYLGADYAEPTWNLKDLMVLNDVYRVMAVDALASSHPLSTPASEINTPAQISELFDAISYSKGASVLRMLSSFLSEDVFKQGLASYLHTFAYQNTIYLNLWDHLQEAVNNRSIQLPTTVRDIMNRWTLQMGFPVITVDTSTGTLSQEHFLLDPDSNVTRPSEFNYVWIVPITSIRDGRQQQDYWLIDVRAQNDLFSTSGNEWVLLNLNVTGYYRVNYDEENWRKIQTQLQRDHSAIPVINRAQIINDAFNLASAHKVPVTLALNNTLFLIEERQYMPWEAALSSLSYFKLMFDRSEVYGPMKNYLKKQVTPLFIHFRNNTNNWREIPENLMDQYSEVNAISTACSNGVPECEEMVSGLFKQWMENPNNNPIHPNLRSTVYCNAIAQGGEEEWDFAWEQFRNATLVNEADKLRAALACSKELWILNRYLSYTLNPDLIRKQDATSTIISITNNVIGQGLVWDFVQSNWKKLFNDYGGGSFSFSNLIQAVTRRFSTEYELQQLEQFKKDNEETGFGSGTRALEQALEKTKANIKWVKENKEVVLQWFTENSK

SEQ ID NO: 404 - protein, 564 aa, unidentified
MATAERRALGIGFQWLSLATLVLICAGQGGRREDGGPACYGGFDLYFILDKSGSVLHHWNEIYYFVEQLAHKFISPQLRMSFIVFSTRGTTLMKLTEDREQIRQGLEELQKVLPGGDTYMHEGFERASEQIYYENRQGYRTASVIIALTDGELHEDLFFYSEREANRSRDLGAIVYCVGVKDFNETQLARIADSKDHVFPVNDGFQALQGIIHSILKKSCIEILAAEPSTICAGESFQVVVRGNGFRHARNVDRVLCSFKINDSVTLNEKPFSVEDTYLLCPAPILKEVGMKAALQVSMNDGLSFISSSVIITTTHCSDGSILAIALLILFLLLALALLWWFWPLCCTVIIKEVPPPPAEESEEEDDDGLPKKKWPTVDASYYGGRGVGGIKRMEVRWGEKGSTEEGAKLEKAKNARVKMPEQEYEFPEPRNLNNNMRRPSSPRKWYSPIKGKLDALWVLLRKGYDRVSVMRPQPGDTGRCINFTRVKNNQPAKYPLNNAYHTSSPPPAPIYTPPPPAPHCPPPPPSAPTPPIPSPPSTLPPPPQAPPPNRAPPPSRPPPRPSV

SEQ ID NO: 405 - protein, 489 aa, unidentified
MVAERSPARSPGSWLFPGLWLLVLSGPGGLLRAQEQPSCRRAFDLYFVLDKSGSVANNWIEIYNFVQQLAERFVSPEMRLSFIVFSSQATIILPLTGDRGKISKGLEDLKRVSPVGETYIHEGLKLANEQIQKAGGLKTSSIIIALTDGKLDGLVPSYAEKEAKISRSLGASVYCVGVLDFEQAQLERIADSKEQVFPVKGGFQALKGIINSILAQSCTEILELQPSSVCVGEEFQIVLSGRGFMLGSRNGSVLCTYTVNETYTTSVKPVSVQLNSMLCPAPILNKAGETLDVSVSFNGGKSVISGSLIVTATECSNGIAAIIVILVLLLLLGIGLMWWFWPLCCKVVIKDPPPPPAPAPKEEEEEPLPTKKWPTVDASYYGGRGVGGIKRMEVRWGDKGSTEEGARLEKAKNAVVKIPEETEEPIRPRPPRPKPTHQPPQTKWYTPIKGRLDALWALLRRQYDRVSLMRPQEGDEVCIWECIEKELTA

SEQ ID NO: 406 - protein, 200 aa, unidentified
MVHAFLIHTLRAPNTEDTGLCRVLYSCVFGAEKSPDDPRPHGAERDRLLRKEQILAVARQVESMCRLQQQASGRPPMDLQPQSSDEQVPLHEAPRGAFRLAAENPFQEPRTVVWLGVLSLGFALVLDAHENLLLAEGTLRLLTRLLLDHLRLLAPSTSLLLRADRIEGILTRFLPHGQLLFLNDQFVQGLEKEFSAAWPR

SEQ ID NO: 407 - protein, 514 aa, unidentified
MSWPRRLLLRYLFPALLLHGLGEGSALLHPDSRSHPRSLEKSAWRAFKESQCHHMLKHLHNGARITVQMPPTIEGHWVSTGCEVRSGPEFITRSYRFYHNNTFKAYQFYYGSNRCTNPTYTLIIRGKIRLRQASWIIRGGTEADYQLHNVQVICHTEAVAEKLGQQVNRTCPGFLADGGPWVQDVAYDLWREENGCECTKAVNFAMHELQLIRVEKQYLHHNLDHLVEELFLGDIHTDATQRMFYRPSSYQPPLQNAKNHDHACIACRIIYRSDEHHPPILPPKADLTIGLHGEWVSQRCEVRPEVLFLTRHFIFHDNNNTWEGHYYHYSDPVCKHPTFSIYARGRYSRGVLSSRVMGGTEFVFKVNHMKVTPMDAATASLLNVFNGNECGAEGSWQVGIQQDVTHTNGCVALGIKLPHTEYEIFKMEQDARGRYLLFNGQRPSDGSSPDRPEKRATSYQMPLVQCASSSPRAEDLAEDSGSSLYGRAPGRHTWSLLLAALACLVPLLHWNIRR

SEQ ID NO: 408 - protein, 501 aa, unidentified
MPAAMLPYACVLVLLGAHTAPAAGEAGGSCLRWEPHCQQPLPDRVPSTAILPPRLNGPWISTGCEVRPGPEFLTRAYTFYPSRLFRAHQFYYEDPFCGEPAHSLLVKGKVRLRRASWVTRGATEADYHLHKVGIVFHSRRALVDVTGRLNQTRAGRDCARRLPPARAWLPGALYELRSARAQGDCLEALGLTMHELSLVRVQRRLQPQPRASPRLVEELYLGDIHTDPAERRHYRPTGYQRPLQSALHHVQPCPACGLIARSDVHHPPVLPPPLALPLHLGGWWVSSGCEVRPAVLFLTRLFTFHGHSRSWEGYYHHFSDPACRQPTFTVYAAGRYTRGTPSTRVRGGTELVFEVTRAHVTPMDQVTTAMLNFSEPSSCGGAGAWSMGTERDVTATNGCLPLGIRLPHVEYELFKMEQDPLGQSLLFIGQRPTDGSSPDTPEKRPTSYQAPLVLCHGEAPDFSRPPQHRPSLQKHPSTGGLHIAPFPLLPLVLGLAFLHWL

SEQ ID NO: 409 - protein, 265 aa, unidentified
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCRRQEDSRVMVYSALRIPPED

SEQ ID NO: 410 - protein, 257 aa, unidentified
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCLLCQDKNFLLYNQRSR

SEQ ID NO: 411 - protein, 511 aa, unidentified
MSGGFELQPRDGGPRVALAPGETVIGRGPLLGITDKRVSRRHAILEVAGGQLRIKPIHTNPCFYQSSEKSQLLPLKPNLWCYLNPGDSFSLLVDKYIFRILSIPSEVEMQCTLRNSQVLDEDNILNETPKSPVINLPHETTGASQLEGSTEIAKTQMTPTNSVSFLGENRDCNKQQPILAERKRILPTWMLAEHLSDQNLSVPAISGGNVIQGSGKEEICKDKSQLNTTQQGRRQLISSGSSENTSAEQDTGEECKNTDQEESTISSKEMPQSFSAITLSNTEMNNIKTNAQRNKLPIEELGKVSKHKIATKRTPHKEDEAMSCSENCSSAQGDSLQDESQGSHSESSSNPSNPETLHAKATDSVLQGSEGNKVKRTSCMYGANCYRKNPVHFQHFSHPGDSDYGGVQIVGQDETDDRPECPYGPSCYRKNPQHKIEYRHNTLPVRNVLDEDNDNVGQPNEYDLNDSFLDDEEEDYEPTDEDSDWEPGKEDEEKEDVEELLKEAKRFMKRK

SEQ ID NO: 412 - protein, 380 aa, unidentified
MEEGGDFDNYYGADNQSECEYTDWKSSGALIPAIYMLVFLLGTTGNGLVLWTVFRSSREKRRSADIFIASLAVADLTFVVTLPLWATYTYRDYDWPFGTFFCKLSSYLIFVNMYASVFCLTGLSFDRYLAIVRPVANARLRLRVSGAVATAVLWVLAALLAMPVMVLRTTGDLENTTKVQCYMDYSMVATVSSEWAWEVGLGVSSTTVGFVVPFTIMLTCYFFIAQTIAGHFRKERIEGLRKRRRLLSIIVVLVVTFALCWMPYHLVKTLYMLGSLLHWPCDFDLFLMNIFPYCTCISYVNSCLNPFLYAFFDPRFRQACTSMLCCGQSRCAGTSHSSSGEKSASYSSGHSQGPGPNMGKGGEQMHEKSIPYSQETLVVD

SEQ ID NO: 413 - protein, 650 aa, unidentified
MGPASPAARGLSRRPGQPPLPLLLPLLLLLLRAQPAIGSLAGGSPGAAEAPGSAQVAGLCGRLTLHRDLRTGRWEPDPQRSRRCLRDPQRVLEYCRQMYPELQIARVEQATQAIPMERWCGGSRSGSCAHPHHQVVPFRCLPGEFVSEALLVPEGCRFLHQERMDQCESSTRRHQEAQEACSSQGLILHGSGMLLPCGSDRFRGVEYVCCPPPGTPDPSGTAVGDPSTRSWPPGSRVEGAEDEEEEESFPQPVDDYFVEPPQAEEEEETVPPPSSHTLAVVGKVTPTPRPTDGVDIYFGMPGEISEHEGFLRAKMDLEERRMRQINEVMREWAMADNQSKNLPKADRQALNEHFQSILQTLEEQVSGERQRLVETHATRVIALINDQRRAALEGFLAALQADPPQAERVLLALRRYLRAEQKEQRHTLRHYQHVAAVDPEKAQQMRFQVHTHLQVIEERVNQSLGLLDQNPHLAQELRPQIQELLHSEHLGPSELEAPAPGGSSEDKGGLQPPDSKDDTPMTLPKGSTEQDAASPEKEKMNPLEQYERKVNASVPRGFPFHSSEIQRDELAPAGTGVSREAVSGLLIMGAGGGSLIVLSMLLLRRKKPYGAISHGVVEVDPMLTLEEQQLRELQRHGYENPTYRFLEERP

SEQ ID NO: 414 - protein, 763 aa, unidentified
MAATGTAAAAATGRLLLLLLVGLTAPALALAGYIEALAANAGTGFAVAEPQIAMFCGKLNMHVNIQTGKWEPDPTGTKSCFETKEEVLQYCQEMYPELQITNVMEANQRVSIDNWCRRDKKQCKSRFVTPFKCLVGEFVSDVLLVPEKCQFFHKERMEVCENHQHWHTVVKEACLTQGMTLYSYGMLLPCGVDQFHGTEYVCCPQTKIIGSVSKEEEEEDEEEEEEEDEEEDYDVYKSEFPTEADLEDFTEAAVDEDDEDEEEGEEVVEDRDYYYDTFKGDDYNEENPTEPGSDGTMSDKEITHDVKAVCSQEAMTGPCRAVMPRWYFDLSKGKCVRFIYGGCGGNRNNFESEDYCMAVCKAMIPPTPLPTNDVDVYFETSADDNEHARFQKAKEQLEIRHRNRMDRVKKEWEEAELQAKNLPKAERQTLIQHFQAMVKALEKEAASEKQQLVETHLARVEAMLNDRRRMALENYLAALQSDPPRPHRILQALRRYVRAENKDRLHTIRHYQHVLAVDPEKAAQMKSQVMTHLHVIEERRNQSLSLLYKVPYVAQEIQEEIDELLQEQRADMDQFTASISETPVDVRVSSEESEEIPPFHPFHPFPALPENEDTQPELYHPMKKGSGVGEQDGGLIGAEEKVINSKNKVDENMVIDETLDVKEMIFNAERVGGLEEERESVGPLREDFSLSSSALIGLLVIAVAIATVIVISLVMLRKRQYGTISHGIVEVDPMLTPEERHLNKMQNHGYENPTYKYLEQMQI

SEQ ID NO: 415 - protein, 416 aa, unidentified
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQLRFPNGVQLSPAEDFVLVAETTMARIRRVYVSGLMKGGADLFVENMPGFPDNIRPSSSGGYWVGMSTIRPNPGFSMLDFLSERPWIKRMIFKLFSQETVMKFVPRYSLVLELSDSGAFRRSLHDPDGLVATYISEVHEHDGHLYLGSFRSPFLCRLSLQAV

SEQ ID NO: 416 - protein, 398 aa, unidentified
MEGAALLRVSVLCIWMSALFLGVGVRAEEAGARVQQNVPSGTDTGDPQSKPLGDWAAGTMDPESSIFIEDAIKYFKEKVSTQNLLLLLTDNEAWNGFVAAAELPRNEADELRKALDNLARQMIMKDKNWHDKGQQYRNWFLKEFPRLKSELEDNIRRLRALADGVQKVHKGTTIANVVSGSLSISSGILTLVGMGLAPFTEGGSLVLLEPGMELGITAALTGITSSTMDYGKKWWTQAQAHDLVIKSLDKLKEVREFLGENISNFLSLAGNTYQLTRGIGKDIRALRRARANLQSVPHASASRPRVTEPISAESGEQVERVNEPSILEMSRGVKLTDVAPVSFFLVLDVVYLVYESKHLHEGAKSETAEELKKVAQELEEKLNILNNNYKILQADQEL

SEQ ID NO: 417 - protein, 337 aa, unidentified
MNPESSIFIEDYLKYFQDQVSRENLLQLLTDDEAWNGFVAAAELPRDEADELRKALNKLASHMVMKDKNRHDKDQQHRQWFLKEFPRLKRELEDHIRKLRALAEEVEQVHRGTTIANVVSNSVGTTSGILTLLGLGLAPFTEGISFVLLDTGMGLGAAAAVAGITCSVVELVNKLRARAQARNLDQSGTNVAKVMKEFVGGNTPNVLTLVDNWYQVTQGIGRNIRAIRRARANPQLGAYAPPPHIIGRISAEGGEQVERVVEGPAQAMSRGTMIVGAATGGILLLLDVVSLAYESKHLLEGAKSESAEELKKRAQELEGKLNFLTKIHEMLQPGQDQ

SEQ ID NO: 418 - protein, 351 aa, unidentified
MEGAALLKIFVVCIWVQQNHPGWTVAGQFQEKKRFTEEVIEYFQKKVSPVHLKILLTSDEAWKRFVRVAELPREEADALYEALKNLTPYVAIEDKDMQQKEQQFREWFLKEFPQIRWKIQESIERLRVIANEIEKVHRGCVIANVVSGSTGILSVIGVMLAPFTAGLSLSITAAGVGLGIASATAGIASSIVENTYTRSAELTASRLTATSTDQLEALRDILRDITPNVLSFALDFDEATKMIANDVHTLRRSKATVGRPLIAWRYVPINVVETLRTRGAPTRIVRKVARNLGKATSGVLVVLDVVNLVQDSLDLHKGAKSESAESLRQWAQELEENLNELTHIHQSLKAG

SEQ ID NO: 419 - protein, 343 aa, unidentified
MDNQAERESEAGVGLQRDEDDAPLCEDVELQDGDLSPEEKIFLREFPRLKEDLKGNIDKLRALADDIDKTHKKFTKANMVATSTAVISGVMSLLGLALAPATGGGSLLLSTAGQGLATAAGVTSIVSGTLERSKNKEAQARAEDILPTYDQEDREDEEEKADYVTAAGKIIYNLRNTLKYAKKNVRAFWKLRANPRLANATKRLLTTGQVSSRSRVQVQKAFAGTTLAMTKNARVLGGVMSAFSLGYDLATLSKEWKHLKEGARTKFAEELRAKALELERKLTELTQLYKSLQQKVRSRARGVGKDLTGTCETEAYWKELREHVWMWLWLCVCLCVCVYVQFT

SEQ ID NO: 420 - protein, 279 aa, unidentified
MFRAPCHRLRARGTRKARAGAWRGCTFPCLGKGMERPAAREPHGPDALRRFQGLLLDRRGRLHGQVLRLREVARRLERLRRRSLVANVAGSSLSATGALAAIVGLSLSPVTLGTSLLVSAVGLGVATAGGAVTITSDLSLIFCNSRELRRVQEIAATCQDQMREILSCLEFFCRWQGCGDRQLLQCGRNASIALYNSVYFIVFFGSRGFLIPRRAEGDTKVSQAVLKAKIQKLAESLESCTGALDELSEQLESRVQLCTKSSRGHDLKISADQRAGLFF

SEQ ID NO: 421 - protein, 198 aa, unidentified
MFKVIQRSVGPASLSLLTFKVYAAPKKDSPPKNSVKVDELSLYSVPEGQSKYVEEARSQLEESISQLRHYCEPYTTWCQETYSQTKPKMQSLVQWGLDSYDYLQNAPPGFFPRLGVIGFAGLIGLLLARGSKIKKLVYPPGFMGLAASLYYPQQAIVFAQVSGERLYDWGLRGYIVIEDLWKENFQKPGNVKNSPGTK

SEQ ID NO: 422 - protein, 770 aa, unidentified
MLPGLALLLLAAWTARALEVPTDGNAGLLAEPQIAMFCGRLNMHMNVQNGKWDSDPSGTKTCIDTKEGILQYCQEVYPELQITNVVEANQPVTIQNWCKRGRKQCKTHPHFVIPYRCLVGEFVSDALLVPDKCKFLHQERMDVCETHLHWHTVAKETCSEKSTNLHDYGMLLPCGIDKFRGVEFVCCPLAEESDNVDSADAEEDDSDVWWGGADTDYADGSEDKVVEVAEEEEVAEVEEEEADDDEDDEDGDEVEEEAEEPYEEATERTTSIATTTTTTTESVEEVVREVCSEQAETGPCRAMISRWYFDVTEGKCAPFFYGGCGGNRNNFDTEEYCMAVCGSAMSQSLLKTTQEPLARDPVKLPTTAASTPDAVDKYLETPGDENEHAHFQKAKERLEAKHRERMSQVMREWEEAERQAKNLPKADKKAVIQHFQEKVESLEQEAANERQQLVETHMARVEAMLNDRRRLALENYITALQAVPPRPRHVFNMLKKYVRAEQKDRQHTLKHFEHVRMVDPKKAAQIRSQVMTHLRVIYERMNQSLSLLYNVPAVAEEIQDEVDELLQKEQNYSDDVLANMISEPRISYGNDALMPSLTETKTTVELLPVNGEFSLDDLQPWHSFGADSVPANTENEVEPVDARPAADRGLTTRPGSGLTNIKTEEISEVKMDAEFRHDSGYEVHHQKLVFFAEDVGSNKGAIIGLMVGGVVIATVIVITLVMLKKKQYTSIHHGVVEVDAAVTPEERHLSKMQQNGYENPTYKFFEQMQN

SEQ ID NO: 423 - protein, 269 aa, unidentified
MASEFKKKLFWRAVVAEFLATTLFVFISIGSALGFKYPVGNNQTAVQDNVKVSLAFGLSIATLAQSVGHISGAHLNPAVTLGLLLSCQISIFRALMYIIAQCVGAIVATAILSGITSSLTGNSLGRNDLADGVNSGQGLGIEIIGTLQLVLCVLATTDRRRRDLGGSAPLAIGLSVALGHLLAIDYTGCGINPARSFGSAVITHNFSNHWIFWVGPFIGGALAVLIYDFILAPRSSDLTDRVKVWTSGQVEEYDLDADDINSRVEMKPK

SEQ ID NO: 424 - protein, 301 aa, unidentified
MVFTQAPAEIMGHLRIRSLLARQCLAEFLGVFVLMLLTQGAVAQAVTSGETKGNFFTMFLAGSLAVTIAIYVGGNVSGAHLNPAFSLAMCIVGRLPWVKLPIYILVQLLSAFCASGATYVLYHDALQNYTGGNLTVTGPKETASIFATYPAPYLSLNNGFLDQVLGTGMLIVGLLAILDRRNKGVPAGLEPVVVGMLILALGLSMGANCGIPLNPARDLGPRLFTYVAGWGPEVFSAGNGWWWVPVVAPLVGATVGTATYQLLVALHHPEGPEPAQDLVSAQHKASELETPASAQMLECKL

SEQ ID NO: 425 - protein, 271 aa, unidentified
MSPLLGLRSELQDTCTSLGLMLSVVLLMGLARVVARQQLHRPVAHAFVLEFLATFQLCCCTHELQLLSEQHPAHPTWTLTLVYFFSLVHGLTLVGTSSNPCGVMMQMMLGGMSPETGAVRLLAQLVSALCSRYCTSALWSLGLTQYHVSERSFACKNPIRVDLLKAVITEAVCSFLFHSALLHFQEVRTKLRIHLLAALITFLVYAGGSLTGAVFNPALALSLHFMCFDEAFPQFFIVYWLAPSLGILLMILMFSFFLPWLHNNHTINKKE

SEQ ID NO: 426 - protein, 295 aa, unidentified
MAGLNVSLSFFFATFALCEAARRASKALLPVGAYEVFAREAMRTLVELGPWAGDFGPDLLLTLLFLLFLAHGVTLDGASANPTVSLQEFLMAEQSLPGTLLKLAAQGLGMQAACTLMRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTGMVLAVLLHQGRLPHLFQRNLFYGQKNKYRAPRGKPAPASGDTQTPAKGSSVREPGRSGVEGPHSS

SEQ ID NO: 427 - protein, 295 aa, unidentified
MAGLNVSLSFFFATFTLCEAARRASKALLPVGAYEVFAREAMRTLVELGPWAGDFGPDLLLTLLFLLFLAHGVTLDGASANPTVSLQEFLMAEESLPGTLLKLAAQGLGMQAACTLTRLCWAWELSDLHLLQSLMAQSCSSALRTSVPHGALVEAACAFCFHLTLLHLRHSPPAYSGPAVALLVTVTAYTAGPFTSAFFNPALAASVTFACSGHTLLEYVQVYWLGPLTGMVLAVLLHQGRLPHLFQRNLFYGQKNKYRAPRGKPAPASGDTQTPAKGSSVREPGRSGVEGPHSS

SEQ ID NO: 428 - protein, 271 aa, unidentified
MWELRSIAFSRAVFAEFLATLLFVFFGLGSALNWPQALPSVLQIAMAFGLGIGTLVQALGHISGAHINPAVTVACLVGCHVSVLRAAFYVAAQLLGAVAGAALLHEITPADIRGDLAVNALSNSTTAGQAVTVELFLTLQLVLCIFASTDERRGENPGTPALSIGFSVALGHLLGIHYTGCSMNPARSLAPAVVTGKFDDHWVFWIGPLVGAILGSLLYNYVLFPPAKSLSERLAVLKGLEPDTDWEEREVRRRQSVELHSPQSLPRGTKA

SEQ ID NO: 429 - protein, 292 aa, unidentified
MGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 430 - protein, 323 aa, unidentified
MSDRPTARRWGKCGPLCTRENIMVAFKGVWTQAFWKAVTAEFLAMLIFVLLSLGSTINWGGTEKPLPVDMVLISLCFGLSIATMVQCFGHISGGHINPAVTVAMVCTRKISIAKSVFYIAAQCLGAIIGAGILYLVTPPSVVGGLGVTMVHGNLTAGHGLLVELIITFQLVFTIFASCDSKRTDVTGSIALAIGFSVAIGHLFAINYTGASMNPARSFGPAVIMGNWENHWIYWVGPIIGAVLAGGLYEYVFCPDVEFKRRFKEAFSKAAQQTKGSYMEVEDNRSQVETDDLILKPGVVHVIDVDRGEEKKGKDQSGEVLSSV

SEQ ID NO: 431 - protein, 265 aa, unidentified
MKKEVCSVAFLKAVFAEFLATLIFVFFGLGSALKWPSALPTILQIALAFGLAIGTLAQALGPVSGGHINPAITLALLVGNQISLLRAFFYVAAQLVGAIAGAGILYGVAPLNARGNLAVNALNNNTTQGQAMVVELILTFQLALCIFASTDSRRTSPVGSPALSIGLSVTLGHLVGIYFTGCSMNPARSFGPAVVMNRFSPAHWVFWVGPIVGAVLAAILYFYLLFPNSLSLSERVAIIKGTYEPDEDWEEQREERKKTMELTTR

SEQ ID NO: 432 - protein, 282 aa, unidentified
MDAVEPGGRGWASMLACRLWKAISRALFAEFLATGLYVFFGVGSVMRWPTALPSVLQIAITFNLVTAMAVQVTWKASGAHANPAVTLAFLVGSHISLPRAVAYVAAQLVGATVGAALLYGVMPGDIRETLGINVVRNSVSTGQAVAVELLLTLQLVLCVFASTDSRQTSGSPATMIGISVALGHLIGIHFTGCSMNPARSFGPAIIIGKFTVHWVFWVGPLMGALLASLIYNFVLFPDTKTLAQRLAILTGTVEVGTGAGAGAEPLKKESQPGSGAVEMESV

SEQ ID NO: 433 - protein, 342 aa, unidentified
MVQASGHRRSTRGSKMVSWSVIAKIQEILQRKMVREFLAEFMSTYVMMVFGLGSVAHMVLNKKYGSYLGVNLGFGFGVTMGVHVAGRISGAHMNAAVTFANCALGRVPWRKFPVYVLGQFLGSFLAAATIYSLFYTAILHFSGGQLMVTGPVATAGIFATYLPDHMTLWRGFLNEAWLTGMLQLCLFAITDQENNPALPGTEALVIGILVVIIGVSLGMNTGYAINPSRDLPPRIFTFIAGWGKQVFSNGENWWWVPVVAPLLGAYLGGIIYLVFIGSTIPREPLKLEDSVAYEDHGITVLPKMGSHEPTISPLTPVSVSPANRSSVHPAPPLHESMALEHF

SEQ ID NO: 434 - protein, 261 aa, unidentified
MSGEIAMCEPEFGNDKAREPSVGGRWRVSWYERFVQPCLVELLGSALFIFIGCLSVIENGTDTGLLQPALAHGLALGLVIATLGNISGGHFNPAVSLAAMLIGGLNLVMLLPYWVSQLLGGMLGAALAKAVSPEERFWNASGAAFVTVQEQGQVAGALVAEIILTTLLALAVCMGAINEKTKGPLAPFSIGFAVTVDILAGGPVSGGCMNPARAFGPAVVANHWNFHWIYWLGPLLAGLLVGLLIRCFIGDGKTRLILKAR

SEQ ID NO: 435 - protein, 295 aa, unidentified
MQPEGAEKGKSFKQRLVLKSSLAKETLSEFLGTFILIVLGCGCVAQAILSRGRFGGVITINVGFSMAVAMAIYVAGGVSGGHINPAVSLAMCLFGRMKWFKLPFYVGAQFLGAFVGAATVFGIYYDGLMSFAGGKLLIVGENATAHIFATYPAPYLSLANAFADQVVATMILLIIVFAIFDSRNLGAPRGLEPIAIGLLIIVIASSLGLNSGCAMNPARDLSPRLFTALAGWGFEVFRAGNNFWWIPVVGPLVGAVIGGLIYVLVIEIHHPEPDSVFKTEQSEDKPEKYELSVIM

SEQ ID NO: 436 - protein, 1485 aa, unidentified
MAAPAQPKKIVAPTVSQINAEFVTQLACKYWAPHIKKKSPFDIKVIEDIYEKEIVKSRFAIRKIMLLEFSQYLENYLWMNYSPEVSSKAYLMSICCMVNEKFRENVPAWEIFKKKPDHFPFFFKHILKAALAETDGEFSLHEQTVLLLFLDHCFNSLEVDLIRSQVQQLISLPMWMGLQLARLELELKKTPKLRKFWNLIKKNDEKMDPEAREQAYQERRFLSQLIQKFISVLKSVPLSEPVTMDKVHYCERFIELMIDLEALLPTRRWFNTILDDSHLLVHCYLSNLVRREEDGHLFSQLLDMLKFYTGFEINDQTGNALTENEMTTIHYDRITSLQRAAFAHFPELYDFALSNVAEVDTRESLVKFFGPLSSNTLHQVASYLCLLPTLPKNEDTTFDKEFLLELLVSRHERRISQIQQLNQMPLYPTEKIIWDENIVPTEYYSGEGCLALPKLNLQFLTLHDYLLRNFNLFRLESTYEIRQDIEDSVSRMKPWQSEYGGVVFGGWARMAQPIVAFTVVEVAKPNIGENWPTRVRADVTINLNVRDHIKDEWEGLRKHDVCFLITVRPTKPYGTKFDRRRPFIEQVGLVYVRGCEIQGMLDDKGRVIEDGPEPRPNLRGESRTFRVFLDPNQYQQDMTNTIQNGAEDVYETFNIIMRRKPKENNFKAVLETIRNLMNTDCVVPDWLHDIILGYGDPSSAHYSKMPNQIATLDFNDTFLSIEHLKASFPGHNVKVTVEDPALQIPPFRITFPVRSGKGKKRKDADVEDEDTEEAKTLIVEPHVIPNRGPYPYNQPKRNTIQFTHTQIEAIRAGMQPGLTMVVGPPGTGKTDVAVQIISNIYHNFPEQRTLIVTHSNQALNQLFEKIMALDIDERHLLRLGHGEEELETEKDFSRYGRVNYVLARRIELLEEVKRLQKSLGVPGDASYTCETAGYFFLYQVMSRWEEYISKVKNKGSTLPDVTEVSTFFPFHEYFANAPQPIFKGRSYEEDMEIAEGCFRHIKKIFTQLEEFRASELLRSGLDRSKYLLVKEAKIIAMTCTHAALKRHDLVKLGFKYDNILMEEAAQILEIETFIPLLLQNPQDGFSRLKRWIMIGDHHQLPPVIKNMAFQKYSNMEQSLFTRFVRVGVPTVDLDAQGRARASLCNLYNWRYKNLGNLPHVQLLPEFSTANAGLLYDFQLINVEDFQGVGESEPNPYFYQNLGEAEYVVALFMYMCLLGYPADKISILTTYNGQKHLIRDIINRRCGNNPLIGRPNKVTTVDRFQGQQNDYILLSLVRTRAVGHLRDVRRLVVAMSRARLGLYIFARVSLFQNCFELTPAFSQLTARPLHLHIIPTEPFPTTRKNGERPSHEVQIIKNMPQMANFVYNMYMHLIQTTHHYHQTLLQLPPAMVEEGEEVQNQETELETEEEAMTVQADIIPSPTDTSCRQETPAFQTDTTPSETGATSTPEAIPALSETTPTVVGAVSAPAEANTPQDATSAPEETK

SEQ ID NO: 437 - protein, 252 aa, unidentified
MRAPLLPPAPVVLSLLILGSGHYAAGLDLNDTYSGKREPFSGDHSADGFEVTSRSEMSSGSEISPVSEMPSSSEPSSGADYDYSEEYDNEPQIPGYIVDDSVRVEQVVKPPQNKTESENTSDKPKRKKKGGKNGKNRRNRKKKNPCNAEFQNFCIHGECKYIEHLEAVTCKCQQEYFGERCGEKSMKTHSMIDSSLSKIALAAIAAFMSAVILTAVAVITVQLRRQYVRKYEGEAEERKKLRQENGNVHAIA

SEQ ID NO: 438 - protein, 823 aa, unidentified
MFYVIGGITVSVVAFFFTIKFLFELAARVVSFLQNEDRERRGDRTIYDYVRGNYLDPRSCKVSWDWKDPYEVGHSMAFRVHLFYKNGQPFPAHRPVGLRVHISHVELAVEIPVTQEVLQEPNSNVVKVAFTVRKAGRYEITVKLGGLNVAYSPYYKIFQPGMVVPSKTKIVCHFSTLVLTCGQPHTLQIVPRDEYDNPTNNSMSLRDEHNYTLSIHELGPQEEESTGVSFEKSVTSNRQTFQVFLRLTLHSRGCFHACISYQNQPINNGEFDIIVLSEDEKNIVERNVSTSGVSIYFEAYLYNATNCSSTPWHLPPMHMTSSQRRPSTAVDEEDEDSPSECHTPEKVKKPKKVYCYVSPKQFSVKEFYLKIIPWRLYTFRVCPGTKFSYLGPDPVHKLLTLVVDDGIQPPVELSCKERNILAATFIRSLHKNIGGSETFQDKVNFFQRELRQVHMKRPHSKVTLKVSRHALLESSLKATRNFSISDWSKNFEVVFQDEEALDWGGPRREWFELICKALFDTTNQLFTRFSDNNQALVHPNPNRPAHLRLKMYEFAGRLVGKCLYESSLGGAYKQLVRARFTRSFLAQIIGLRMHYKYFETDDPEFYKSKVCFILNNDMSEMELVFAEEKYNKSGQLDKVVELMTGGAQTPVTNANKIFYLNLLAQYRLASQVKEEVEHFLKGLNELVPENLLAIFDENELELLMCGTGDISVSDFKAHAVVVGGSWHFREKVMRWFWTVVSSLTQEELARLLQFTTGSSQLPPGGFAALCPSFQIIAAPTHSTLPTAHTCFNQLCLPTYDSYEEVHRMLQLAISEGCEGFGML

SEQ ID NO: 439 - protein, 439 aa, unidentified
MDPLSELQDDLTLDDTSEALNQLKLASIDEKNWPSDEMPDFPKSDDSKSSSPELVTHLKWDDPYYDIARHQIVEVAGDDKYGRKIIVFSACRMPPSHQLDHSKLLGYLKHTLDQYVESDYTLLYLHHGLTSDNKPSLSWLRDAYREFDRKYKKNIKALYIVHPTMFIKTLLILFKPLISFKFGQKIFYVNYLSELSEHVKLEQLGIPRQVLKYDDFLKSTQKSPATAPKPMPPRPPLPNQQFGVSLQHLQEKNPEQEPIPIVLRETVAYLQAHALTTEGIFRRSANTQVVREVQQKYNMGLPVDFDQYNELHLPAVILKTFLRELPEPLLTFDLYPHVVGFLNIDESQRVPATLQVLQTLPEENYQVLRFLTAFLVQISAHSDQNKMTNTNLAVVFGPNLLWAKDAAITLKAINPINTFTKFLLDHQGELFPSPDPSGL

SEQ ID NO: 440 - protein, 814 aa, unidentified
MGLPALEFSDCCLDSPHFRETLKSHEAELDKTNKFIKELIKDGKSLISALKNLSSAKRKFADSLNEFKFQCIGDAETDDEMCIARSLQEFATVLRNLEDERIRMIENASEVLITPLEKFRKEQIGAAKEAKKKYDKETEKYCGILEKHLNLSSKKKESQLQEADSQVDLVRQHFYEVSLEYVFKVQEVQERKMFEFVEPLLAFLQGLFTFYHHGYELAKDFGDFKTQLTISIQNTRNRFEGTRSEVESLMKKMKENPLEHKTISPYTMEGYLYVQEKRHFGTSWVKHYCTYQRDSKQITMVPFDQKSGGKGGEDESVILKSCTRRKTDSIEKRFCFDVEAVDRPGVITMQALSEEDRRLWMEAMDGREPVYNSNKDSQSEGTAQLDSIGFSIIRKCIHAVETRGINEQGLYRIVGVNSRVQKLLSVLMDPKTASETETDICAEWEIKTITSALKTYLRMLPGPLMMYQFQRSFIKAAKLENQESRVSEIHSLVHRLPEKNRQMLQLLMNHLANVANNHKQNLMTVANLGVVFGPTLLRPQEETVAAIMDIKFQNIVIEILIENHEKIFNTVPDMPLTNAQLHLSRKKSSDSKPPSCSERPLTLFHTVQSTEKQEQRNSIINSSLESVSSNPNSILNSSSSLQPNMNSSDPDLAVVKPTRPNSLPPNPSPTSPLSPSWPMFSAPSSPMPTSSTSSDSSPVRSVAGFVWFSVAAVVLSLARSSLHAVFSLLVNFVPCHPNLHLLFDRPEEAVHEDSSTPFRKAKALYACKAEHDSELSFTAGTVFDNVHPSQEPGWLEGTLNGKTGLIPENYVEFL

SEQ ID NO: 441 - protein, 290 aa, unidentified
MLGQRAGDGERPGLPGDGEGGVPARPGRRAERPPQRPAKVNKAVTCAAHLPGAAASRPLSPNKPDRVRPGQRDRIGAKRQRRRRADAGQARAASSRRVVPTAPEVLGAVASLPDRGRPTVARVATGSRLEGLFSAASLKLSALTQSLTRVRQAPTASGATIRLPASPVEMFLTSAFLTGFSFHCLYSGIGHGEDILASVEQITIVSRPLSGQRGAGPGNSAYTPRRSQGGPRAATTPGFRFPCRGLVRRAVLRLTVTVQDCILTALLAVSFHSIGVVIMTSSYLLGPVVK

SEQ ID NO: 442 - protein, 244 aa, unidentified
MAPRPLGPLVLALGGAAAVLGSVLFILWKTYFGRGRERRWDRGEAWWGAEAARLPEWDEWDPEDEEDEEPALEELEQREVLVLGLDGAGKSTFLRVLSGKPPLEGHIPTWGFNSVRLPTKDFEVDLLEIGGSQNLRFYWKEFVSEVDVLVFVVDSADRLRLPWARQELHKLLDKDPDLPVVVVANKQDLSEAMSMGELQRELGLQAIDNQREVFLLAASIAPAGPTFEEPGTVHIWKLLLELLS

SEQ ID NO: 443 - protein, 203 aa, unidentified
MAEGDNRSTNLLAAETASLEEQLQGWGEVMLMADKVLRWERAWFPPAIMGVVSLVFLIIYYLDPSVLSGVSCFVMFLCLADYLVPILAPRIFGSNKWTTEQQQRFHEICSNLVKTRRRAVGWWKRLFTLKEEKPKMYFMTMIVSLAAVAWVGQQVHNLLLTYLIVTSLLLLPGLNQHGIILKYIGMAKREINKLLKQKEKKNE

SEQ ID NO: 444 - protein, 188 aa, unidentified
MDVNIAPLRAWDDFFPGSDRFARPDFRDISKWNNRVVSNLLYYQTNYLVVAAMMISIVGFLSPFNMILGGIVVVLVFTGFVWAAHNKDVLRRMKKRYPTTFVMVVMLASYFLISMFGGVMVFVFGITFPLLLMFIHASLRLRNLKNKLENKMEGIGLKRTPMGIVLDALEQQEEGINRLTDYISKVKE

SEQ ID NO: 445 - protein, 226 aa, unidentified
MSFAESGWRSALRRRGPGTPGPVARPSYSSFTQGDSWGEGEVDEEEGCDQVARDLRAEFSAGAWSEPRKRSVLPPDGNGSPVLPDKRNGIFPAAAGSRAQPRRWPVQVLSILCSLLFAILLAFLLAIAYLIVKELHAENLKNEDDVDTGLLGFWTLLIISLTAGFSCCSFSWTVTYFDSFEPGMFPPTPLSPARFKKLTGHSFHMGYSMAILNGIVAALTVAWCLM

SEQ ID NO: 446 - protein, 343 aa, unidentified
MGGPRGAGWVAAGLLLGAGACYCIYRLTRGRRRGDRELGIRSSKSAGALEEGTSEGQLCGRSARPQTGGTWESQWSKTSQPEDLTDGSYDDVLNAEQLQKLLYLLESTEDPVIIERALITLGNNAAFSVNQAIIRELGGIPIVANKINHSNQSIKEKALNALNNLSVNVENQIKIKIYISQVCEDVFSGPLNSAVQLAGLTLLTNMTVTNDHQHMLHSYITDLFQVLLTGNGNTKVQVLKLLLNLSENPAMTEGLLRAQVDSSFLSLYDSHVAKEILLRVLTLFQNIKNCLKIEGHLAVQPTFTEGSLFFLLHGEECAQKIRALVDHHDAEVKEKVVTIIPKI

SEQ ID NO: 447 - protein, 453 aa, unidentified
MGRTREAGCVAAGVVIGAGACYCVYRLAWGRDENEKIWDEDEESTDTSEIGVETVKGAKTNAGAGSGAKLQGDSEVKPEVSLGLEDCPGVKEKAHSGSHSGGGLEAKAKALFNTLKEQASAKAGKGARVGTISGNRTLAPSLPCPGGRGGGCHPTRSGSRAGGRASGKSKGKARSKSTRAPATTWPVRRGKFNFPYKIDDILSAPDLQKVLNILERTNDPFIQEVALVTLGNNAAYSFNQNAIRELGGVPIIAKLIKTKDPIIREKTYNALNNLSVNAENQGKIKTYISQVCDDTMVCRLDSAVQMAGLRLLTNMTVTNHYQHLLSYSFPDFFALLFLGNHFTKIQIMKLIINFTENPAMTRELVSCKVPSELISLFNKEWDREILLNILTLFENINDNIKNEGLASSRKEFSRSSLFFLFKESGVCVKKIKALANHNDLVVKVKVLKVLTKL

SEQ ID NO: 448 - protein, 632 aa, unidentified
MSRVRDAGCVAAGIVIGAGAWYCVYKYTRGRDQTKKRMAKPKNRAVAGTGARARAGLRAGFTIDLGSGFSPPTPVRAEAEDRAQDEASALDTVGAEAVAPAASSAEAQSGAGSQAQEADGAGVGPKAESVVGAAMASAIAPPPGVTEALGAAEAPAMAGAPKVAEAPREAETSRAAVPPGTVVPTEAAAPTEVTEGPGVAAPTKVAEAPGVASPTEAAEAPVPATPTGAAAPTGAAESPGTSGSPRTAVVPGTSAAKKATPGAHTGAIPKATSATGAVPKGGGKGVTRSRNGGKGKGKKSKVEVDELGMGFRPGDGAAAAAAASANGGQAFLAEVPDSEEGESGWTDTESDSDSEPETQRRGRGRRPVAMQKRPFPYEIDEILGVRDLRKVLALLQKSDDPFIQQVALLTLSNNANYSCNQETIRKLGGLPIIANMINKTDPHIKEKALMAMNNLSENYENQGRLQVYMNKVMDDIMASNLNSAVQVVGLKFLTNMTITNDYQHLLVNSIANFFRLLSQGGGKIKVEILKILSNFAENPDMLKKLLSTQVPASFSSLYNSYVESEILINALTLFEIIYDNLRAEVFNYREFNKGSLFYLCTTSGVCVKKIRALANHHDLLVKVKVIKLVNKF

SEQ ID NO: 449 - protein, 379 aa, unidentified
MGYARKVGWVTAGLVIGAGACYCIYRLTRGRKQNKEKMAEGGSGDVDDAGDCSGARYNDWSDDDDDSNESKSIVWYPPWARIGTEAGTRARARARARATRARRAVQKRASPNSDDTVLSPQELQKVLCLVEMSEKPYILEAALIALGNNAAYAFNRDIIRDLGGLPIVAKILNTRDPIVKEKALIVLNNLSVNAENQRRLKVYMNQVCDDTITSRLNSSVQLAGLRLLTNMTVTNEYQHMLANSISDFFRLFSAGNEETKLQVLKLLLNLAENPAMTRELLRAQVPSSLGSLFNKKENKEVILKLLVIFENINDNFKWEENEPTQNQFGEGSLFFFLKEFQVCADKVLGIESHHDFLVKVKVGKFMAKLAEHMFPKSQE

SEQ ID NO: 450 - protein, 300 aa, unidentified
MGRAREVGWMAAGLMIGAGACYCVYKLTIGRDDSEKLEEEGEEEWDDDQELDEEEPDIWFDFETMARPWTEDGDWTEPGAPGGTEDRPSGGGKANRAHPIKQRPFPYEHKNTWSAQNCKNGSCVLDLSKCLFIQGKLLFAEPKDAGFPFSQDINSHLASLSMARNTSPTPDPTVREALCAPDNLNASIESQGQIKMYINEVCRETVSRCCNSFLQQAGLNLLISMTVINNMLAKSASDLKFPLISEGSGCAKVQVLKPLMGLSEKPVLAGELVGAQMLFSFMSLFIRNGNREILLETPAP

SEQ ID NO: 451 - protein, 593 aa, unidentified
MRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGKWHQGVNCASRGDHCHHPLNHGFDYFYGMPFTLTNDCDPGRPPEVDAALRAQLWGYTQFLALGILTLAAGQTCGFFSVSARAVTGMAGVGCLFFISWYSSFGFVRRWNCILMRNHDVTEQPMVLEKTASLMLKEAVSYIERHKHGPFLLFLSLLHVHIPLVTTSAFLGKSQHGLYGDNVEEMDWLIGKVLNAIEDNGLKNSTFTYFTSDHGGHLEARDGHSQLGGWNGIYKGGKGMGGWEGGIRVPGIFHWPGVLPAGRVIGEPTSLMDVFPTVVQLVGGEVPQDRVIDGHSLVPLLQGAEARSAHEFLFHYCGQHLHAARWHQKDSGSVWKVHYTTPQFHPEGAGACYGRGVCPCSGEGVTHHRPPLLFDLSRDPSEARPLTPDSEPLYHAVIARVGAAVSEHRQTLSPVPQQFSMSNILWKPWLQPCCGHFPFCSCHEDGDGTP

SEQ ID NO: 452 - protein, 589 aa, unidentified
MLHLHHSCLCFRSWLPAMLAVLLSLAPSASSDISASRPNILLLMADDLGIGDIGCYGNNTMRTPNIDRLAEDGVKLTQHISAASLCTPSRAAFLTGRYPVRSGMVSSIGYRVLQWTGASGGLPTNETTFAKILKEKGYATGLIGKWHLGLNCESASDHCHHPLHHGFDHFYGMPFSLMGDCARWELSEKRVNLEQKLNFLFQVLALVALTLVAGKLTHLIPVSWMPVIWSALSAVLLLASSYFVGALIVHADCFLMRNHTITEQPMCFQRTTPLILQEVASFLKRNKHGPFLLFVSFLHVHIPLITMENFLGKSLHGLYGDNVEEMDWMVGRILDTLDVEGLSNSTLIYFTSDHGGSLENQLGNTQYGGWNGIYKGGKGMGGWEGGIRVPGIFRWPGVLPAGRVIGEPTSLMDVFPTVVRLAGGEVPQDRVIDGQDLLPLLLGTAQHSDHEFLMHYCERFLHAARWHQRDRGTMWKVHFVTPVFQPEGAGACYGRKVCPCFGEKVVHHDPPLLFDLSRDPSETHILTPASEPVFYQVMERVQQAVWEHQRTLSPVPLQLDRLGNIWRPWLQPCCGPFPLCWCLREDDPQ

SEQ ID NO: 453 - protein, 590 aa, unidentified
MRPRRPLVFMSLVCALLNTCQAHRVHDDKPNIVLIMVDDLGIGDLGCYGNDTMRTPHIDRLAREGVRLTQHISAASLCSPSRSAFLTGRYPIRSGMVSSGNRRVIQNLAVPAGLPLNETTLAALLKKQGYSTGLIGKWHQGLNCDSRSDQCHHPYNYGFDYYYGMPFTLVDSCWPDPSRNTELAFESQLWLCVQLVAIAILTLTFGKLSGWVSVPWLLIFSMILFIFLLGYAWFSSHTSPLYWDCLLMRGHEITEQPMKAERAGSIMVKEAISFLERHSKETFLLFFSFLHVHTPLPTTDDFTGTSKHGLYGDNVEEMDSMVGKILDAIDDFGLRNNTLVYFTSDHGGHLEARRGHAQLGGWNGIYKGGKGMGGWEGGIRVPGIVRWPGKVPAGRLIKEPTSLMDILPTVASVSGGSLPQDRVIDGRDLMPLLQGNVRHSEHEFLFHYCGSYLHAVRWIPKDDSGSVWKAHYVTPVFQPPASGGCYVTSLCRCFGEQVTYHNPPLLFDLSRDPSESTPLTPATEPLHDFVIKKVANALKEHQETIVPVTYQLSELNQGRTWLKPCCGVFPFCLCDKEEEVSQPRGPNEKR

SEQ ID NO: 454 - protein, 562 aa, unidentified
MTRNARPNIVLLMADDLGVGDLCCYGNNSVSTPNIDRLASEGVRLTQHLAAASMCTPSRAAFLTGRYPIRSGMVSAYNLNRAFTWLGGSGGLPTNETTFAKLLQHRGYRTGLIGKWHLGLSCASRNDHCYHPLNHGFHYFYGVPFGLLSDCQASKTPELHRWLRIKLWISTVALALVPFLLLIPKFARWFSVPWKVIFVFALLAFLFFTSWYSSYGFTRRWNCILMRNHEIIQQPMKEEKVASLMLKEALAFIERYKREPFLLFFSFLHVHTPLISKKKFVGRSKYGRYGDNVEEMDWMVGKILDALDQERLANHTLVYFTSDNGGHLEPLDGAVQLGGWNGIYKGGKGMGGWEGGIRVPGIFRWPSVLEAGRVINEPTSLMDIYPTLSYIGGGILSQDRVIDGQNLMPLLEGRASHSDHEFLFHYCGVYLHTVRWHQKDCATVWKAHYVTPKFYPEGTGACYGSGICSCSGDVTYHDPPLLFDISRDPSEALPLNPDNEPLFDSVIKKMEAAIREHRRTLTPVPQQFSVFNTIWKPWLQPCCGTFPFCGCDKEDDILPMAP

SEQ ID NO: 455 - protein, 327 aa, unidentified
MQMPAMMSLLLVSVGLMEALQAQSHPITRRDLFSQEIQLDMALASFDDQYAGCAAAMTAALPDLNHTEFQANQVYADSWTLASSQWQERQARWPEWSLSPTRPSPPPLGFRDEHGVALLAYTANSPLHKEFNAAVREAGRSRAHYLHHFSFKTLHFLLTEALQLLGSGQRPPRCHQVFRGVHGLRFRPAGPRATVRLGGFASASLKHVAAQQFGEDTFFGIWTCLGAPIKGYSFFPGEEEVLIPPFETFQVINASRLAQGPARIYLRALGKHSTYNCEYIKDKKCKSGPCHLDNSAMGQSPLSAVWSLLLLLWFLVVRAFPDGPGLL

SEQ ID NO: 456 - protein, 389 aa, unidentified
MKTGHFEIVTMLLATMILVDIFQVKAEVLDMADNAFDDEYLKCTDRMEIKYVPQLLKEEKASHQQLDTVWENAKAKWAARKTQIFLPMNFKDNHGIALMAYISEAQEQTPFYHLFSEAVKMAGQSREDYIYGFQFKAFHFYLTRALQLLRKPCEASSKTVVYRTSQGTSFTFGGLNQARFGHFTLAYSAKPQAANDQLTVLSIYTCLGVDIENFLDKESERITLIPLNEVFQVSQEGAGNNLILQSINKTCSHYECAFLGGLKTENCIENLEYFQPIYVYNPGEKNQKLEDHSEKNWKLEDHGEKNQKLEDHGVKILEPTQIPGMKIPEPFPLPEDKSQGNINNPTPGPVPVPGPKSHPSASSGKLLLPQFGMVIILISVSAINLFVAL

SEQ ID NO: 457 - protein, 314 aa, unidentified
MGPLINRCKKILLPTTVPPATMRIWLLGGLLPFLLLLSGLQRPTEGSEVAIKIDFDFAPGSFDDQYQGCSKQVMEKLTQGDYFTKDIEAQKNYFRMWQKAHLAWLNQGKVLPQNMTTTHAVAILFYTLNSNVHSDFTRAMASVARTPQQYERSFHFKYLHYYLTSAIQLLRKDSIMENGTLCYEVHYRTKDVHFNAYTGATIRFGQFLSTSLLKEEAQEFGNQTLFTIFTCLGAPVQYFSLKKEVLIPPYELFKVINMSYHPRGNWLQLRSTGNLSTYNCQLLKASSKKCIPDPIAIASLSFLTSVIIFSKSRV

SEQ ID NO: 458 - protein, 271 aa, unidentified
MGNGGRSGLQQGKGNVDGVAATPTAASASCQYRCIECNQEAKELYRDYNHGVLKITICKSCQKPVDKYIEYDPVIILINAILCKAQAYRHILFNTQINIHGKLCIFCLLCEAYLRWWQLQDSNQNTAPDDLIRYAKEWDFYRMFAIAALEQTAYFIGIFTFLWVERPMTAKKKPNFILLLKALLLSSYGKLLLIPAVIWEHDYTSVCLKLIKVFVLTSNFQAIRVTLNINRKLSFLAVLSGLLLESIMVYFFQSMEWDVGSDYAIFKSQDF

SEQ ID NO: 459 - protein, 323 aa, unidentified
MEDGPVFYGFKNIFITMFATFFFFKLLIKVFLALLTHFYIVKGNRKEAARIAEEIYGGISDCWADRSPLHEAAAQGRLLALKTLIAQGVNVNLVTINRVSSLHEACLGGHVACAKALLENGAHVNGVTVHGATPLFNACCSGSAACVNVLLEFGAKAQLEVHLASPIHEAVKRGHRECMEILLANNVNIDHEVPQLGTPLYVACTYQRVDCVKKLLELGASVDHGQWLDTPLHAAARQSNVEVIHLLTDYGANLKRRNAQGKSALDLAAPKSSVEQALLLREGPPALSQLCRLCVRKCLGRACHQAIHKLHLPEPLERFLLYQ

SEQ ID NO: 460 - protein, 466 aa, unidentified
MSNSDYLPDYPLNSDLVKRLKSALDAKDEERVRDLICTEITPVDAVIELANDDWMKDPSAQLPTGMLLGDLDHLKPLMDQFFQDANVVFEINKDEMEWQVKSPATFGLSGLWTLEYKRELTTPLCIAAAHGHTACVRHLLGRGADPDASPGGRGALHEACLGGHTACVRLLLQHRADPDLLSAEGLAPLHLCRTAASLGCAQALLEHGASVQRVGGTGRDTPLHVAAQRGLDEHARLYLGRGAHVDARNGRGETALSAACGAARRPDEHGRCLRLCALLLRRGAEADARDEDERSPLHKACGHASHSLARLLLRHGADAGALDYGGASPLGRVLQTASCALQASPQRTVQALLNHGSPTVWPDAFPKVLKTCASVPAVIEVLFNSYPQLCLSESWKEVIPEEVFQMHKPFYQSLFALALTPRCLQHLCRCALRRLFGKRCFDLIPLLPLPKPLQNYLLLEPQGVLH

SEQ ID NO: 461 - protein, 329 aa, unidentified
MSVLEENRPFAQQLSNVYFTILSLFCFKLFVKISLAILSHFYIVKGNRKEAARIAAEFYGVTQGQGSWADRSPLHEAASQGRLLALRTLLSQGYNVNAVTLDHVTPLHEACLGDHVACARTLLEAGANVNAITIDGVTPLFNACSQGSPSCAELLLEYGAKAQLESCLPSPTHEAASKGHHECLDILISWGIDVDQEIPHLGTPLYVACMSQQFHCIWKLLYAGADVQKGKYWDTPLHAAAQQSSTEIVNLLLEFGADINAKNTELLRPIDVATSSSMVERILLQHEATPSSLYQLCRLCIRSYIGKPRLHLIPQLQLPTLLKNFLQYR

SEQ ID NO: 462 - protein, 311 aa, unidentified
MAKDFQDIQQLSSEENDHPFHQGEGPGTRRLNPRRGNPFLKGPPPAQPLAQRLCSMVCFSLLALSFNILLLVVICVTGSQSEGHGGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHNYKNWAVTQPDNWHGHELGGSEDCVEVQPDGRWNDDFCLQVYRWVCEKRRNATGEVA

SEQ ID NO: 463 - protein, 528 aa, unidentified
MELKAEEEEVGGVQPVSIQAFASSSTLHGLAHIFSYERLSLKRALWALCFLGSLAVLLCVCTERVQYYFHYHHVTKLDEVAASQLTFPAVTLCNLNEFRFSQVSKNDLYHAGELLALLNNRYEIPDTQMADEKQLEILQDKANFRSFKPKPFNMREFYDRAGHDIRDMLLSCHFRGEVCSAEDFKVVFTRYGKCYTFNSGRDGRPRLKTMKGGTGNGLEIMLDIQQDEYLPVWGETDETSFEAGIKVQIHSQDEPPFIDQLGFGVAPGFQTFVACQEQRLIYLPPPWGTCKAVTMDSDLDFFDSYSITACRIDCETRYLVENCNCRMVHMPGDAPYCTPEQYKECADPALDFLVEKDQEYCVCEMPCNLTRYGKELSMVKIPSKASAKYLAKKFNKSEQYIGENILVLDIFFEVLNYETIEQKKAYEIAGLLGDIGGQMGLFIGASILTVLELFDYAYEVIKHKLCRRGKCQKEAKRSSADKGVALSLDDVKRHNPCESLRGHPAGMTYAANILPHHPARGTFEDFTC

SEQ ID NO: 464 - protein, 512 aa, unidentified
MDLKESPSEGSLQPSSIQIFANTSTLHGIRHIFVYGPLTIRRVLWAVAFVGSLGLLLVESSERVSYYFSYQHVTKVDEVVAQSLVFPAVTLCNLNGFRFSRLTTNDLYHAGELLALLDVNLQIPDPHLADPSVLEALRQKANFKHYKPKQFSMLEFLHRVGHDLKDMMLYCKFKGQECGHQDFTTVFTKYGKCYMFNSGEDGKPLLTTVKGGTGNGLEIMLDIQQDEYLPIWGETEETTFEAGVKVQIHSQSEPPFIQELGFGVAPGFQTFVATQEQRLTYLPPPWGECRSSEMGLDFFPVYSITACRIDCETRYIVENCNCRMVHMPGDAPFCTPEQHKECAEPALGLLAEKDSNYCLCRTPCNLTRYNKELSMVKIPSKTSAKYLEKKFNKSEKYISENILVLDIFFEALNYETIEQKKAYEVAALLGDIGGQMGLFIGASILTILELFDYIYELIKEKLLDLLGKEEDEGSHDENVSTCDTMPNHSETISHTVNVPLQTTLGTLEEIAC

SEQ ID NO: 465 - protein, 531 aa, unidentified
MKPTSGPEEARRPASDIRVFASNCSMHGLGHVFGPGSLSLRRGMWAAAVVLSVATFLYQVAERVRYYREFHHQTALDERESHRLIFPAVTLCNINPLRRSRLTPNDLHWAGSALLGLDPAEHAAFLRALGRPPAPPGFMPSPTFDMAQLYARAGHSLDDMLLDCRFRGQPCGPENFTTIFTRMGKCYTFNSGADGAELLTTTRGGMGNGLDIMLDVQQEEYLPVWRDNEETPFEVGIRVQIHSQEEPPIIDQLGLGVSPGYQTFVSCQQQQLSFLPPPWGDCSSASLNPNYEPEPSDPLGSPSPSPSPPYTLMGCRLACETRYVARKCGCRMVYMPGDVPVCSPQQYKNCAHPAIDAMLRKDSCACPNPCASTRYAKELSMVRIPSRAAARFLARKLNRSEAYIAENVLALDIFFEALNYETVEQKKAYEMSELLGDIGGQMGLFIGASLLTILEILDYLCEVFRDKVLGYFWNRQHSQRHSSTNLLQEGLGSHRTQVPHLSLGPRPPTPPCAVTKTLSASHRTCYLVTQL

SEQ ID NO: 466 - protein, 647 aa, unidentified
MLSGAAGAARRGGAALAPSLTRSLAGTHAGADSCAGADKGSHKETIEERDKRQQRQQRQRQHQGCGAAGSGSDSPTSGPHPVPVLFPLALSLEEQPLPPLPLGRAPGLLAREGQGREALASPSSRGQMPIEIVCKIKFAEEDAKPKEKEAGDEQSLLGAVAPGAAPRDLATFASTSTLHGLGRACGPGPHGLRRTLWALALLTSLAAFLYQAAGLARGYLTRPHLVAMDPAAPAPVAGFPAVTLCNINRFRHSALSDADIFHLANLTGLPPKDRDGHRAAGLRYPEPDMVDILNRTGHQLADMLKSCNFSGHHCSASNFSVVYTRYGKCYTFNADPRSSLPSRAGGMGSGLEIMLDIQQEEYLPIWRETNETSFEAGIRVQIHSQEEPPYIHQLGFGVSPGFQTFVSCQEQRLTYLPQPWGNCRAESELREPELQGYSAYSVSACRLRCEKEAVLQRCHCRMVHMPDSLGGGPEGPCFCPTPCNLTRYGKEISMVRIPNRGSARYLARKYNRNETYIRENFLVLDVFFEALTSEAMEQRAAYGLSALLGDLGGQMGLFIGASILTLLEILDYIYEVSWDRLKRVWRRPKTPLRTSTGGISTLGLQELKEQSPCPSRGRVEGGGVSSLLPNHHHPHGPPGGLFEDFAC

SEQ ID NO: 467 - protein, 505 aa, unidentified
MEQTEKSKVYAENGLLEKIKLCLSKKPLPSPTERKKFDHDFAISTSFHGIHNIVQNRSKIRRVLWLVVVLGSVSLVTWQIYIRLLNYFTWPTTTSIEVQYVEKMEFPAVTFCNLNRFQTDAVAKFGVIFFLWHIVSKVLHLQEITANSTGSREATDFAASHQNFSIVEFIRNKGFYLNNSTLLDCEFFGKPCSPKDFAHVFTEYGNCFTFNHGETLQAKRKVSVSGRGLSLLFNVNQEAFTDNPALGFVDAGIIFVIHSPKKVPQFDGLGLLSPVGMHARVTIRQVKTVHQEYPWGECNPNIKLQNFSSYSTSGCLKECKAQHIKKQCGCVPFLLPGYGIECDLQKYFSCVSPVLDHIEFKDLCTVGTHNSSCPVSCEEIEYPATISYSSFPSQKALKYLSKKLNQSRKYIRENLVKIEINYSDLNYKITQQQKAVSVSELLADLGGQLGLFCGASLITIIEIIEYLFTNFYWICIFFLLKISEMTQWTPPPQNHLGNKNRIEEC

SEQ ID NO: 468 - protein, 758 aa, unidentified
MAQRKNAKSSGNSSSSGSGSGSTSAGSSSPGARRETKHGGHKNGRKGGLSGTSFFTWFMVIALLGVWTSVAVVWFDLVDYEEVLGKLGIYDADGDGDFDVDDAKVLLGLKERSTSEPAVPPEEAEPHTEPEEQVPVEAEPQNIEDEAKEQIQSLLHEMVHAEHVEGEDLQQEDGPTGEPQQEDDEFLMATDVDDRFETLEPEVSHEETEHSYHVEETVSQDCNQDMEEMMSEQENPDSSEPVVEDERLHHDTDDVTYQVYEEQAVYEPLENEGIEITEVTAPPEDNPVEDSQVIVEEVSIFPVEEQQEVPPETNRKTDDPEQKAKVKKKKPKLLNKFDKTIKAELDAAEKLRKRGKIEEAVNAFKELVRKYPQSPRARYGKAQCEDDLAEKRRSNEVLRGAIETYQEVASLPDVPADLLKLSLKRRSDRQQFLGHMRGSLLTLQRLVQLFPNDTSLKNDLGVGYLLIGDNDNAKKVYEEVLSVTPNDGFAKVHYGFILKAQNKIAESIPYLKEGIESGDPGTDDGRFYFHLGDAMQRVGNKEAYKWYELGHKRGHFASVWQRSLYNVNGLKAQPWWTPKETGYTELVKSLERNWKLIRDEGLAVMDKAKGLFLPEDENLREKGDWSQFTLWQQGRRNENACKGAPKTCTLLEKFPETTGCRRGQIKYSIMHPGTHVWPHTGPTNCRLRMHLGLVIPKEGCKIRCANETKTWEEGKVLIFDDSFEHEVWQDASSFRLIFIVDVWHPELTPQQRRSLPAI

SEQ ID NO: 469 - protein, 390 aa, unidentified
MKEGRGSFSVERGPRKERETAQSGMWKGNSPAGSQGAAMEGTGGELGGQGNWGPEDAPGLLARASLIMLPWPLPLASSALTLLFGALTSLFLWYCYRLGSQDMQALGAGSRAGGVRGGPVGCSEAGGPSPGGPGDPGEGPRTEGLVSRRLRAYARRYSWAGMGRVRRAAQGGPGPGRGPGVLGIQRPGLLFLPDLPSAPFVPRDAQRHDVELLESSFPAILRDFGAVSWDFSGTTPPPRGWSPPLAPGCYQLLLYQAGRCQPSNCRRCPGAYRALRGLRSFMSANTFGNAGFSVLLPGARLEGRCGPTNARVRCHLGLKIPPGCELVVGGEPQCWAEGHCLLVDDSFLHTVAHNGSPEDGPRVVFIVDLWHPNVAGAERQALDFVFAPDP

SEQ ID NO: 470 - protein, 369 aa, unidentified
MVWAPLGPPRTDCLTLLHTPSKDSPKMSLEWLVAWSWSLDGLRDCIATGIQSVRDCDTTAVITVACLLVLFVWYCYHVGREQPRPYVSVNSLMQAADANGLQNGYVYCQSPECVRCTHNEGLNQKLYHNLQEYAKRYSWSGMGRIHKGIREQGRYLNSRPSIQKPEVFFLPDLPTTPYFSRDAQKHDVEVLERNFQTILCEFETLYKAFSNCSLPQGWKMNSTPSGEWFTFYLVNQGVCVPRNCRKCPRTYRLLGSLRTCIGNNVFGNACISVLSPGTVITEHYGPTNIRIRCHLGLKTPNGCELVVGGEPQCWAEGRCLLFDDSFLHAAFHEGSAEDGPRVVFMVDLWHPNVAAAERQALDFIFAPGR

SEQ ID NO: 471 - protein, 343 aa, unidentified
MGSPGASLGIKKALQSEQATALPASAPAVSQPTAPAPSCLPKAGQVIPTLLREAPFSSVIAPTLLCGFLFLAWVAAEVPEESSRMAGSGARSEEGRRQHAFVPEPFDGANVVPNLWLHSFEVINDLNHWDHITKLRFLKESLRGEALGVYNRLSPQDQGDYGTVKEALLKAFGVPGAAPSHLPKEIVFANSMGKGYYLKGKIGKVPVRFLVDSGAQVSVVHPNLWEEVTDGDLDTLQPFENVVKVANGAEMKILGVWDTAVSLGKLKLKAQFLVANASAEEAIIGTDVLQDHNAILDFEHRTCTLKGKKFRLLPVGGSLEDEFDLELIEEDPSSEEGRQELSH

SEQ ID NO: 472 - protein, 1302 aa, unidentified
MALAGLCALLACCWGPAAVLATAAGDVDPSKELECKLKSITVSALPFLRENDLSIMHSPSASEPKLLFSVRNDFPGEMVVVDDLENTELPYFVLEISGNTEDIPLVRWRQQWLENGTLLFHIHHQDGAPSLPGQDPTEEPQHESAEEELRILHISVMGGMIALLLSILCLVMILYTRRRWCKRRRVPQPQKSASAEAANEIHYIPSVLIGGHGRESLRNARVQGHNSSGTLSIRETPILDGYEYDITDLRHHLQRECMNGGEDFASQVTRTLDSLQGCNEKSGMDLTPGSDNAKLSLMNKYKDNIIATSPVDSNHQQATLLSHTSSSQRKRINNKARAGSAFLNPEGDSGTEAENDPQLTFYTDPSRSRRRSRVGSPRSPVNKTTLTLISITSCVIGLVCSSHVNCPLVVKITLHVPEHLIADGSRFILLEGSQLDASDWLNPAQVVLFSQQNSSGPWAMDLCARRLLDPCEHQCDPETGRREHRAAGECLCYEGYMKDPVHKHLCIRNEWGTNQGPWPYTIFQRGFDLVLGEQPSDKIFRFTYTLGEGMWLPLSKSFVIPPAELAINPSAKCKTDMTVMEDAVEVREELMTSSSFDSLEVLLDSFGPVRDCSKDNGGCSKNFRCISDRKLDSTGCVCPSGLSPMKDSSGCYDRHIGVDCSDGFNGGCEQLCLQQMAPFPDDPTLYNILMFCGCIEDYKLGVDGRSCQLITETCPEGSDCGESRELPMNQTLFGEMFFGYNNHSKEVAAGQVLKGTFRQNNFARGLDQQLPDGLVVATVPLENQCLEEISEPTPDPDFLTGMVNFSEVSGYPVLQHWKVRSVMYHIKLNQVAISQALSNALHSLDGATSRADFVALLDQFGNHYIQEAIYGFEESCSIWYPNKQVQRRLWLEYEDISKGNSPSDESEERERDPKVLTFPEYITSLSDSGTKHMAAGVRMECHSKGRCPSSCPLCHVTSSPDTPAEPVLLEVTKAAPIYELVTNNQTQRLLQEATMSSLWCSGTGDVIEDWCRCDSTAFGADGLPTCAPLPQPVLRLSTVHEPSSTLVVLEWEHSEPPIGVQIVDYLLRQEKVTDRMDHSKVETETVLSFVDDIISGAKSPCAMPSQVPDKQLTTISLIIRCLEPDTIYMFTLWGVDNTGRRSRPSDVIVKTPCPVVDDVKAQEIADKIYNLFNGYTSGKEQQTAYNTLLDLGSPTLHRVLYHYNQHYESFGEFTWRCEDELGPRKAGLILSQLGDLSSWCNGLLQEPKISLRRSSLKYLGCRYSEIKPYGLDWAELSRDLRKTCEEQTLSIPYNDYGDSKEI

SEQ ID NO: 473 - protein, 1339 aa, unidentified
MAAAGARLSPGPGSGLRGRPRLCFHPGPPPLLPLLLLFLLLLPPPPLLAGATAAASREPDSPCRLKTVTVSTLPALRESDIGWSGARAGAGAGTGAGAAAAAASPGSPGSAGTAAESRLLLFVRNELPGRIAVQDDLDNTELPFFTLEMSGTAADISLVHWRQQWLENGTLYFHVSMSSSGQLAQATAPTLQEPSEIVEEQMHILHISVMGGLIALLLLLLVFTVALYAQRRWQKRRRIPQKSASTEATHEIHYIPSVLLGPQARESFRSSRLQTHNSVIGVPIRETPILDDYDCEEDEEPPRRANHVSREDEFGSQVTHTLDSLGHPGEEKVDFEKKAAAEATQETVESLMQKFKESFRANTPIEIGQLQPPLRSTSAGKRKRRSKSRGGISFGRAKGTSGSEADDETQLTFYTEQYRSRRRSKGLLKSPVNKTALTLIAVSSCILAMVCGSQMSCPLTVKVTLHVPEHFIADGSSFVVSEGSYLDISDWLNPAKLSLYYQINATSPWVRDLCGQRTTDACEQLCDPETGECSCHEGYAPDPVHRHLCVRSDWGQSEGPWPYTTLERGYDLVTGEQAPEKILRSTFSLGQGLWLPVSKSFVVPPVELSINPLASCKTDVLVTEDPADVREEAMLSTYFETINDLLSSFGPVRDCSRNNGGCTRNFKCVSDRQVDSSGCVCPEELKPMKDGSGCYDHSKGIDCSDGFNGGCEQLCLQQTLPLPYDATSSTIFMFCGCVEEYKLAPDGKSCLMLSDVCEGPKCLKPDSKFNDTLFGEMLHGYNNRTQHVNQGQVFQMTFRENNFIKDFPQLADGLLVIPLPVEEQCRGVLSEPLPDLQLLTGDIRYDEAMGYPMVQQWRVRSNLYRVKLSTITLAAGFTNVLKILTKESSREELLSFIQHYGSHYIAEALYGSELTCIIHFPSKKVQQQLWLQYQKETTELGSKKELKSMPFITYLSGLLTAQMLSDDQLISGVEIRCEEKGRCPSTCHLCRRPGKEQLSPTPVLLEINRVVPLYTLIQDNGTKEAFKSALMSSYWCSGKGDVIDDWCRCDLSAFDANGLPNCSPLLQPVLRLSPTVEPSSTVVSLEWVDVQPAIGTKVSDYILQHKKVDEYTDTDLYTGEFLSFADDLLSGLGTSCVAAGRSHGEVPEVSIYSVIFKCLEPDGLYKFTLYAVDTRGRHSELSTVTLRTACPLVDDNKAEEIADKIYNLYNGYTSGKEQQMAYNTLMEVSASMLFRVQHHYNSHYEKFGDFVWRSEDELGPRKAHLILRRLERVSSHCSSLLRSAYIQSRVETVPYLFCRSEEVRPAGMVWYSILKDTKITCEEKMVSMARNTYGESKGR

SEQ ID NO: 474 - protein, 475 aa, unidentified
MAASALRGLPVAGGGESSESEDDGWEIGYLDRTSQKLKRLLPIEEKKEKFKKAMTIGDVSLVQELLDSGISVDSNFQYGWTPLMYAASVANAELVRVLLDRGANASFEKDKQSILITACSAHGSEEQILKCVELLLSRNADPNVACRRLMTPIMYAARDGHTQVVALLVAHGAEVNTQDENGYTALTWAARQGHKNIVLKLLELGANKMLQTKDGKMPSEIAKRNKHHEIFNLLSFTLNPLEGKLQQLTKEDTICKILTTDSDREKDHIFSSYTAFGDLEVFLHGLGLEHMTDLLKERDITLRHLLTMREDEFTKNGITSKDQQKILAALKELQVEEIQFGELSEETKLEISGDEFLNFLLKLNKQCGHLITAVQNVITELPVNSQKITLEWASPQNFTSVCEELVNNVEDLSEKVCKLKDLIQKLQNERENDPTHIQLREEVSTWNSRILKRTAITICGFGFLLFICKLTFQRK

SEQ ID NO: 475 - protein, 361 aa, unidentified
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRFHINQPALKQREAILKLILKNENVDRHVDLLEVAQETDGFSGSDLKEMCRDAALLCVREYVNSTSEESHDEDEIRPVQQQDLHRAIEKMKKSKDAAFQNVLTHVCLD

SEQ ID NO: 476 - protein, 670 aa, unidentified
MGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 477 - protein, 703 aa, unidentified
MAELMLLSEIADPTRFFTDNLLSPEDWGLQNSTLYSGLDEVAEEQTQLFRCPEQDVPFDGSSLDVGMDVSPSEPPWELLPIFPDLQVKSEPSSPCSSSSLSSESSRLSTEPSSEALGVGEVLHVKTESLAPPLCLLGDDPTSSFETVQINVIPTSDDSSDVQTKIEPVSPCSSVNSEASLLSADSSSQAFIGEEVLEVKTESLSPSGCLLWDVPAPSLGAVQISMGPSLDGSSGKALPTRKPPLQPKPVVLTTVPMPSRAVPPSTTVLLQSLVQPPPVSPVVLIQGAIRVQPEGPAPSLPRPERKSIVPAPMPGNSCPPEVDAKLLKRQQRMIKNRESACQSRRKKKEYLQGLEARLQAVLADNQQLRRENAALRRRLEALLAENSELKLGSGNRKVVCIMVFLLFIAFNFGPVSISEPPSAPISPRMNKGEPQPRRHLLGFSEQEPVQGVEPLQGSSQGPKEPQPSPTDQPSFSNLTAFPGGAKELLLRDLDQLFLSSDCRHFNRTESLRLADELSGWVQRHQRGRRKIPQRAQERQKSQPRKKSPPVKAVPIQPPGPPERDSVGQLQLYRHPDRSQPAFLDAIDRREDTFYVVSFRRDHLLLPAISHNKTSRPKMSLVMPAMAPNETLSGRGAPGDYEEMMQIECEVMDTRVIHIKTSTVPPSLRKQPSPTPGNATGGPLPVSAASQAHQASHQPLYLNHP

SEQ ID NO: 478 - protein, 494 aa, unidentified
MGDDRPFVCNAPGCGQRFTNEDHLAVHKHKHEMTLKFGPARTDSVIIADQTPTPTRFLKNCEEVGLFNELASSFEHEFKKAADEDEKKARSRTVAKKLVAAAGPLDMSLPSTPDIKIKEEEPVEVDSSPPDSPASSPCSPPLKEKEVTPKPVLISTPTPTIVRPGSLPLHLGYDPLHPTLPSPTSVITQAPPSNRQMGSPTGSLPLVMHLANGQTMPVLPGPPVQMPSVISLARPVSMVPNIPGIPGPPVNSSGSISPSGHPIPSEAKMRLKATLTHQVSSINGGCGMVVGTASTMVTARPEQSQILIQHPDAPSPAQPQVSPAQPTPSTGGRRRRTVDEDPDERRQRFLERNRAAASRCRQKRKLWVSSLEKKAEELTSQNIQLSNEVTLLRNEVAQLKQLLLAHKDCPVTALQKKTQGYLESPKESSEPTGSPAPVIQHSSATAPSNGLSVRSAAEAVATSVLTQMASQRTELSMPIQSHVIMTPQSQSAGR

SEQ ID NO: 479 - protein, 839 aa, unidentified
MAQFDTEYQRLEASYSDSPPGEEDLLVHVAEGSKSPWHHIENLDLFFSRVYNLHQKNGFTCMLIGEIFELMQFLFVVAFTTFLVSCVDYDILFANKMVNHSLHPTEPVKVTLPDAFLPAQVCSARIQENGSLITILVIAGVFWIHRLIKFIYNICCYWEIHSFYLHALRIPMSALPYCTWQEVQARIVQTQKEHQICIHKRELTELDIYHRILRFQNYMVALVNKSLLPLRFRLPGLGEAVFFTRGLKYNFELILFWGPGSLFLNEWSLKAEYKRGGQRLELAQRLSNRILWIGIANFLLCPLILIWQILYAFFSYAEVLKREPGALGARCWSLYGRCYLRHFNELEHELQSRLNRGYKPASKYMNCFLSPLLTLLAKNGAFFAGSILAVLIALTIYDEDVLAVEHVLTTVTLLGVTVTVCRSFIPDQHMVFCPEQLLRVILAHIHYMPDHWQGNAHRSQTRDEFAQLFQYKAVFILEELLSPIVTPLILIFCLRPRALEIIDFFRNFTVEVVGVGDTCSFAQMDVRQHGHPQWLSAGQTEASVYQQAEDGKTELSLMHFAITNPGWQPPRESTAFLGFLKEQVQRDGAAASLAQGGLLPENALFTSIQSLQSESEPLSLIANVVAGSSCRGPPLPRDLQGSRHRAEVASALRSFSPLQPGQAPTGRAHSTMTGSGVDARTASSGSSVWEGQLQSLVLSEYASTEMSLHALYMHQLHKQQAQAEPERHVWHRRESDESGESAPDEGGEGARAPQSIPRSASYPCAAPRPGAPETTALHGGFQRRYGGITDPGTVPRVPSHFSRLPLGGWAEDGQSASRHPEPVPEEGSEDELPPQVHKV

SEQ ID NO: 480 - protein, 924 aa, unidentified
MVSRMGWGGRRRRLGRWGDLGPGSVPLLPMPLPPPPPPSCRGPGGGRISIFSLSPAPHTRSSPSSFSPPTAGPPCSVLQGTGASQSCHSALPIPATPPTQAQPAMTPASASPSWGSHSTPPLAPATPTPSQQCPQDSPGLRVGPLIPEQDYERLEDCDPEGSQDSPIHGEEQQPLLHVPEGLRGSWHHIQNLDSFFTKIYSYHQRNGFACILLEDVFQLGQFIFIVTFTTFLLRCVDYNVLFANQPSNHTRPGPFHSKVTLSDAILPSAQCAERIRSSPLLVLLLVLAAGFWLVQLLRSVCNLFSYWDIQVFYREALHIPPEELSSVPWAEVQSRLLALQRSGGLCVQPRPLTELDIHHRILRYTNYQVALANKGLLPARCPLPWGGSAAFLSRGLALNVDLLLFRGPFSLFRGGWELPHAYKRSDQRGALAARWGRTVLLLAALNLALSPLVLAWQVLHVFYSHVELLRREPGALGARGWSRLARLQLRHFNELPHELRARLARAYRPAAAFLRTAAPPAPLRTLLARQLVFFAGALFAALLVLTVYDEDVLAVEHVLTAMTALGVTATVARSFIPEEQCQGRAPQLLLQTALAHMHYLPEEPGPGGRDRAYRQMAQLLQYRAVSLLEELLSPLLTPLFLLFWFRPRALEIIDFFHHFTVDVAGVGDICSFALMDVKRHGHPQWLSAGQTEASLSQRAEDGKTELSLMRFSLAHPLWRPPGHSSKFLGHLWGRVQQDAAAWGATSARGPSTPGVLSNCTSPLPEAFLANLFVHPLLPPRDLSPTAPCPAAATASLLASISRIAQDPSSVSPGGTGGQKLAQLPELASAEMSLHVIYLHQLHQQQQQQEPWGEAAASILSRPCSSPSQPPSPDEEKPSWSSDGSSPASSPRQQWGTQKARNLFPGGFQVTTDTQKEPDRASCTD

SEQ ID NO: 481 - protein, 558 aa, unidentified
MAKNRRDRNSWGGFSEKTYEWSSEEEEPVKKAGPVQVLIVKDDHSFELDETALNRILLSEAVRDKEVVAVSVAGAFRKGKSFLMDFMLRYMYNQESVDWVGDYNEPLTGFSWRGGSERETTGIQIWSEIFLINKPDGKKVAVLLMDTQGTFDSQSTLRDSATVFALSTMISSIQVYNLSQNVQEDDLQHLQLFTEYGRLAMEETFLKPFQSLIFLVRDWSFPYEFSYGADGGAKFLEKRLKVSGNQHEELQNVRKHIHSCFTNISCFLLPHPGLKVATNPNFDGKLKEIDDEFIKNLKILIPWLLSPESLDIKEINGNKITCRGLVEYFKAYIKIYQGEELPHPKSMLQATAEANNLAAVATAKDTYNKKMEEICGGDKPFLAPNDLQTKHLQLKEESVKLFRGVKKMGGEEFSRRYLQQLESEIDELYIQYIKHNDSKNIFHAARTPATLFVVIFITYVIAGVTGFIGLDIIASLCNMIMGLTLITLCTWAYIRYSGEYRELGAVIDQVAAALWDQGSTNEALYKLYSAAATHRHLYHQAFPTPKSESTEQSEKKKM

SEQ ID NO: 482 - protein, 583 aa, unidentified
MAEGDEAARGQQPHQGLWRRRRTSDPSAAVNHVSSTTSLGENYEDDDLVNSDEVMKKPCPVQIVLAHEDDHNFELDEEALEQILLQEHIRDLNIVVVSVAGAFRKGKSFLLDFMLRYMYNKDSQSWIGGNNEPLTGFTWRGGCERETTGIQVWNEVFVIDRPNGTKVAVLLMDTQGAFDSQSTIKDCATVFALSTMTSSVQVYNLSQNIQEDDLQHLQLFTEYGRLAMEEIYQKPFQTLMFLIRDWSYPYEHSYGLEGGKQFLEKRLQVKQNQHEELQNVRKHIHNCFSNLGCFLLPHPGLKVATNPSFDGRLKDIDEDFKRELRNLVPLLLAPENLVEKEISGSKVTCRDLVEYFKAYIKIYQGEELPHPKSMLQATAEANNLAAVAGARDTYCKSMEQVCGGDKPYIAPSDLERKHLDLKEVAIKQFRSVKKMGGDEFCRRYQDQLEAEIEETYANFIKHNDGKNIFYAARTPATLFAVMFAMYIISGLTGFIGLNSIAVLCNLVMGLALIFLCTWAYVKYSGEFREIGTVIDQIAETLWEQVLKPLGDNLMEENIRQSVTNSIKAGLTDQVSHHARLKTD

SEQ ID NO: 483 - protein, 541 aa, unidentified
MLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 484 - protein, 3056 aa, unidentified
MSLVLNDLLICCRQLEHDRATERKKEVEKFKRLIRDPETIKHLDRHSDSKQGKYLNWDAVFRFLQKYIQKETECLRIAKPNVSASTQASRQKKMQEISSLVKYFIKCANRRAPRLKCQELLNYIMDTVKDSSNGAIYGADCSNILLKDILSVRKYWCEISQQQWLELFSVYFRLYLKPSQDVHRVLVARIIHAVTKGCCSQTDGLNSKFLDFFSKAIQCARQEKSSSGLNHILAALTIFLKTLAVNFRIRVCELGDEILPTLLYIWTQHRLNDSLKEVIIELFQLQIYIHHPKGAKTQEKGAYESTKWRSILYNLYDLLVNEISHIGSRGKYSSGFRNIAVKENLIELMADICHQVFNEDTRSLEISQSYTTTQRESSDYSVPCKRKKIELGWEVIKDHLQKSQNDFDLVPWLQIATQLISKYPASLPNCELSPLLMILSQLLPQQRHGERTPYVLRCLTEVALCQDKRSNLESSQKSDLLKLWNKIWCITFRGISSEQIQAENFGLLGAIIQGSLVEVDREFWKLFTGSACRPSCPAVCCLTLALTTSIVPGTVKMGIEQNMCEVNRSFSLKESIMKWLLFYQLEGDLENSTEVPPILHSNFPHLVLEKILVSLTMKNCKAAMNFFQSVPECEHHQKDKEELSFSEVEELFLQTTFDKMDFLTIVRECGIEKHQSSIGFSVHQNLKESLDRCLLGLSEQLLNNYSSEITNSETLVRCSRLLVGVLGCYCYMGVIAEEEAYKSELFQKAKSLMQCAGESITLFKNKTNEEFRIGSLRNMMQLCTRCLSNCTKKSPNKIASGFFLRLLTSKLMNDIADICKSLASFIKKPFDRGEVESMEDDTNGNLMEVEDQSSMNLFNDYPDSSVSDANEPGESQSTIGAINPLAEEYLSKQDLLFLDMLKFLCLCVTTAQTNTVSFRAADIRRKLLMLIDSSTLEPTKSLHLHMYLMLLKELPGEEYPLPMEDVLELLKPLSNVCSLYRRDQDVCKTILNHVLHVVKNLGQSNMDSENTRDAQGQFLTVIGAFWHLTKERKYIFSVRMALVNCLKTLLEADPYSKWAILNVMGKDFPVNEVFTQFLADNHHQVRMLAAESINRLFQDTKGDSSRLLKALPLKLQQTAFENAYLKAQEGMREMSHSAENPETLDEIYNRKSVLLTLIAVVLSCSPICEKQALFALCKSVKENGLEPHLVKKVLEKVSETFGYRRLEDFMASHLDYLVLEWLNLQDTEYNLSSFPFILLNYTNIEDFYRSCYKVLIPHLVIRSHFDEVKSIANQIQEDWKSLLTDCFPKILVNILPYFAYEGTRDSGMAQQRETATKVYDMLKSENLLGKQIDHLFISNLPEIVVELLMTLHEPANSSASQSTDLCDFSGDLDPAPNPPHFPSHVIKATFAYISNCHKTKLKSILEILSKSPDSYQKILLAICEQAAETNNVYKKHRILKIYHLFVSLLLKDIKSGLGGAWAFVLRDVIYTLIHYINQRPSCIMDVSLRSFSLCCDLLSQVCQTAVTYCKDALENHLHVIVGTLIPLVYEQVEVQKQVLDLLKYLVIDNKDNENLYITIKLLDPFPDHVVFKDLRITQQKIKYSRGPFSLLEEINHFLSVSVYDALPLTRLEGLKDLRRQLELHKDQMVDIMRASQDNPQDGIMVKLVVNLLQLSKMAINHTGEKEVLEAVGSCLGEVGPIDFSTIAIQHSKDASYTKALKLFEDKELQWTFIMLTYLNNTLVEDCVKVRSAAVTCLKNILATKTGHSFWEIYKMTTDPMLAYLQPFRTSRKKFLEVPRFDKENPFEGLDDINLWIPLSENHDIWIKTLTCAFLDSGGTKCEILQLLKPMCEVKTDFCQTVLPYLIHDILLQDTNESWRNLLSTHVQGFFTSCLRHFSQTSRSTTPANLDSESEHFFRCCLDKKSQRTMLAVVDYMRRQKRPSSGTIFNDAFWLDLNYLEVAKVAQSCAAHFTALLYAEIYADKKSMDDQEKRSLAFEEGSQSTTISSLSEKSKEETGISLQDLLLEIYRSIGEPDSLYGCGGGKMLQPITRLRTYEHEAMWGKALVTYDLETAIPSSTRQAGIIQALQNLGLCHILSVYLKGLDYENKDWCPELEELHYQAAWRNMQWDHCTSVSKEVEGTSYHESLYNALQSLRDREFSTFYESLKYARVKEVEEMCKRSLESVYSLYPTLSRLQAIGELESIGELFSRSVTHRQLSEVYIKWQKHSQLLKDSDFSFQEPIMALRTVILEILMEKEMDNSQRECIKDILTKHLVELSILARTFKNTQLPERAIFQIKQYNSVSCGVSEWQLEEAQVFWAKKEQSLALSILKQMIKKLDASCAANNPSLKLTYTECLRVCGNWLAETCLENPAVIMQTYLEKAVEVAGNYDGESSDELRNGKMKAFLSLARFSDTQYQRIENYMKSSEFENKQALLKRAKEEVGLLREHKIQTNRYTVKVQRELELDELALRALKEDRKRFLCKAVENYINCLLSGEEHDMWVFRLCSLWLENSGVSEVNGMMKRDGMKIPTYKFLPLMYQLAARMGTKMMGGLGFHEVLNNLISRISMDHPHHTLFIILALANANRDEFLTKPEVARRSRITKNVPKQSSQLDEDRTEAANRIICTIRSRRPQMVRSVEALCDAYIILANLDATQWKTQRKGINIPADQPITKLKNLEDVVVPTMEIKVDHTGEYGNLVTIQSFKAEFRLAGGVNLPKIIDCVGSDGKERRQLVKGRDDLRQDAVMQQVFQMCNTLLQRNTETRKRKLTICTYKVVPLSQRSGVLEWCTGTVPIGEFLVNNEDGAHKRYRPNDFSAFQCQKKMMEVQKKSFEEKYEVFMDVCQNFQPVFRYFCMEKFLDPAIWFEKRLAYTRSVATSSIVGYILGLGDRHVQNILINEQSAELVHIDLGVAFEQGKILPTPETVPFRLTRDIVDGMGITGVEGVFRRCCEKTMEVMRNSQETLLTIVEVLLYDPLFDWTMNPLKALYLQQRPEDETELHPTLNADDQECKRNLSDIDQSFNKVAERVLMRLQEKLKGVEEGTVLSVGGQVNLLIQQAIDPKNLSRLFPGWKAWV

SEQ ID NO: 485 - protein, 1499 aa, unidentified
MEREPAGTEEPGPPGRRRRREGRTRTVRSNLLPPPGAEDPAAGAAKGERRRRRGCAQHLADNRLKTTKYTLLSFLPKNLFEQFHRPANVYFVFIALLNFVPAVNAFQPGLALAPVLFILAITAFRDLWEDYSRHRSDHKINHLGCLVFSREEKKYVNRFWKEIHVGDFVRLRCNEIFPADILLLSSSDPDGLCHIETANLDGETNLKRRQVVRGFSELVSEFNPLTFTSVIECEKPNNDLSRFRGCIIHDNGKKAGLYKENLLLRGCTLRNTDAVVGIVIYAGHETKALLNNSGPRYKRSKLERQMNCDVLWCVLLLVCMSLFSAVGHGLWIWRYQEKKSLFYVPKSDGSSLSPVTAAVYSFLTMIIVLQVLIPISLYVSIEIVKACQVYFINQDMQLYDEETDSQLQCRALNITEDLGQIQYIFSDKTGTLTENKMVFRRCTVSGVEYSHDANAQRLARYQEADSEEEEVVPRGGSVSQRGSIGSHQSVRVVHRTQSTKSHRRTGSRAEAKRASMLSKHTAFSSPMEKDITPDPKLLEKVSECDKSLAVARHQEHLLAHLSPELSDVFDFFIALTICNTVVVTSPDQPRTKVRVRFELKSPVKTIEDFLRRFTPSCLTSGCSSIGSLAANKSSHKLGSSFPSTPSSDGMLLRLEERLGQPTSAIASNGYSSQADNWASELAQEQESERELRYEAESPDEAALVYAARAYNCVLVERLHDQVSVELPHLGRLTFELLHTLGFDSVRKRMSVVIRHPLTDEINVYTKGADSVVMDLLQPCSSVDARGRHQKKIRSKTQNYLNVYAAEGLRTLCIAKRVLSKEEYACWLQSHLEAESSLENSEELLFQSAIRLETNLHLLGATGIEDRLQDGVPETISKLRQAGLQIWVLTGDKQETAVNIAYACKLLDHDEEVITLNATSQEACAALLDQCLCYVQSRGLQRAPEKTKGKVSMRFSSLCPPSTSTASGRRPSLVIDGRSLAYALEKNLEDKFLFLAKQCRSVLCCRSTPLQKSMVVKLVRSKLKAMTLAIGDGANDVSMIQVADVGVGISGQEGMQAVMASDFAVPKFRYLERLLILHGHWCYSRLANMVLYFFYKNTMFVGLLFWFQFFCGFSASTMIDQWYLIFFNLLFSSLPPLVTGVLDRDVPANVLLTNPQLYKSGQNMEEYRPRTFWFNMADAAFQSLVCFSIPYLAYYDSNVDLFTWGTPIVTIALLTFLLHLGIETKTWTWLNWITCGFSVLLFFTVALIYNASCATCYPPSNPYWTMQALLGDPVFYLTCLMTPVAALLPRLFFRSLQGRVFPTQLQLARQLTRKSPRRCSAPKETFAQGRLPKDSGTEHSSGRTVKTSVPLSQPSWHTQQPVCSLEASGEPSTVDMSMPVREHTLLEGLSAPAPMSSAPGEAVLRSPGGCPEESKVRAASTGRVTPLSSLFSLPTFSLLNWISSWSLVSRLGSVLQFSRTEQLADGQAGRGLPVQPHSGRSGLQGPDHRLLIGASSRRSQ

SEQ ID NO: 486 - protein, 1461 aa, unidentified
MALSVDSSWHRWQWRVRDGFPHCPSETTPLLSPEKGRQSYNLTQQRVVFPNNSIFHQDWEEVSRRYPGNRTCTTKYTLFTFLPRNLFEQFHRWANLYFLFLVILNWMPSMEVFHREITMLPLAIVLFVIMIKDGMEDFKRHRFDKAINCSNIRIYERKEQTYVQKCWKDVRVGDFIQMKCNEIVPADILLLFSSDPNGICHLETASLDGETNLKQRCVVKGFSQQEVQFEPELFHNTIVCEKPNNHLNKFKGYMEHPDQTRTGFGCESLLLRGCTIRNTEMAVGIVIYAGHETKAMLNNSGPRYKRSKIERRMNIDIFFCIGILILMCLIGAVGHSIWNGTFEEHPPFDVPDANGSFLPSALGGFYMFLTMIILLQVLIPISLYVSIELVKLGQVFFLSNDLDLYDEETDLSIQCRALNIAEDLGQIQYIFSDKTGTLTENKMVFRRCTIMGSEYSHQENAKRLETPKELDSDGEEWTQYQCLSFSARWAQDPATMRSQKGAQPLRRSQSARVPIQGHYRQRSMGHRESSQPPVAFSSSIEKDVTPDKNLLTKVRDAALWLETLSDSRPAKASLSTTSSIADFFLALTICNSVMVSTTTEPRQRVTIKPSSKALGTSLEKIQQLFQKLKLLSLSQSFSSTAPSDTDLGESLGANVATTDSDERDDASVCSGGDSTDDGGYRSSMWDQGDILESGSGTSLEEALEAPATDLARPEFCYEAESPDEAALVHAAHAYSFTLVSRTPEQVTVRLPQGTCLTFSLLCTLGFDSVRKRMSVVVRHPLTGEIVVYTKGADSVIMDLLEDPACVPDINMEKKLRKIRARTQKHLDLYARDGLRTLCIAKKVVSEEDFRRWASFRREAEASLDNRDELLMETAQHLENQLTLLGATGIEDRLQEGVPDTIATLREAGIQLWVLTGDKQETAVNIAHSCRLLNQTDTVYTINTENQETCESILNCALEELKQFRELQKPDRKLFGFRLPSKTPSITSEAVVPEAGLVIDGKTLNAIFQGKLEKKFLELTQYCRSVLCCRSTPLQKSMIVKLVRDKLRVMTLSIGDGANDVSMIQAADIGIGISGQEGMQAVMSSDFAITRFKHLKKLLLVHGHWCYSRLARMVVYYLYKNVCYVNLLFWYQFFCGFSSSTMIDYWQMIFFNLFFTSLPPLVFGVLDKDISAETLLALPELYKSGQNSECYNLSTFWISMVDAFYQSLICFFIPYLAYKGSDIDVFTFGTPINTISLTTILLHQAMEMKTWTIFHGVVLLGSFLMYFLVSLLYNATCVICNSPTNPYWVMEGQLSNPTFYLVCFLTPVVALLPRYFFLSLQGTCGKSLISKAQKIDKLPPDKRNLEIQSWRSRQRPAPVPEVARPTHHPVSSITGQDFSASTPKSSNPPKRKHVEESVLHEQRCGTECMRDDSCSGDSSAQLSSGEHLLGPNRIMAYSRGQTDMCRCSKRSSHRRSQSSLTI

SEQ ID NO: 487 - protein, 1426 aa, unidentified
MTEALQWARYHWRRLIRGATRDDDSGPYNYSSLLACGRKSSQTPKLSGRHRIVVPHIQPFKDEYEKFSGAYVNNRIRTTKYTLLNFVPRNLFEQFHRAANLYFLFLVVLNWVPLVEAFQKEITMLPLVVVLTIIAIKDGLEDYRKYKIDKQINNLITKVYSRKEKKYIDRCWKDVTVGDFIRLSCNEVIPADMVLLFSTDPDGICHIETSGLDGESNLKQRQVVRGYAEQDSEVDPEKFSSRIECESPNNDLSRFRGFLEHSNKERVGLSKENLLLRGCTIRNTEAVVGIVVYAGHETKAMLNNSGPRYKRSKLERRANTDVLWCVMLLVIMCLTGAVGHGIWLSRYEKMHFFNVPEPDGHIISPLLAGFYMFWTMIILLQVLIPISLYVSIEIVKLGQIYFIQSDVDFYNEKMDSIVQCRALNIAEDLGQIQYLFSDKTGTLTENKMVFRRCSVAGFDYCHEENARRLESYQEAVSEDEDFIDTVSGSLSNMAKPRAPSCRTVHNGPLGNKPSNHLAGSSFTLGSGEGASEVPHSRQAAFSSPIETDVVPDTRLLDKFSQITPRLFMPLDETIQNPPMETLYIIDFFIALAICNTVVVSAPNQPRQKIRHPSLGGLPIKSLEEIKSLFQRWSVRRSSSPSLNSGKEPSSGVPNAFVSRLPLFSRMKPASPVEEEVSQVCESPQCSSSSACCTETEKQHGDAGLLNGKAESLPGQPLACNLCYEAESPDEAALVYAARAYQCTLRSRTPEQVMVDFAALGPLTFQLLHILPFDSVRKRMSVVVRHPLSNQVVVYTKGADSVIMELLSVASPDGASLEKQQMIVREKTQKHLDDYAKQGLRTLCIAKKVMSDTEYAEWLRNHFLAETSIDNREELLLESAMRLENKLTLLGATGIEDRLQEGVPESIEALHKAGIKIWMLTGDKQETAVNIAYACKLLEPDDKLFILNTQSKDACGMLMSTILKELQKKTQALPEQVSLSEDLLQPPVPRDSGLRAGLIITGKTLEFALQESLQKQFLELTSWCQAVVCCRATPLQKSEVVKLVRSHLQVMTLAIGDGANDVSMIQVADIGIGVSGQEGMQAVMASDFAVSQFKHLSKLLLVHGHWCYTRLSNMILYFFYKNVAYVNLLFWYQFFCGFSGTSMTDYWVLIFFNLLFTSAPPVIYGVLEKDVSAETLMQLPELYRSGQKSEAYLPHTFWITLLDAFYQSLVCFFVPYFTYQGSDTDIFAFGNPLNTAALFIVLLHLVIESKSLTWIHLLVIIGSILSYFLFAIVFGAMCVTCNPPSNPYWIMQEHMLDPVFYLVCILTTSIALLPRFVYRVLQGSLFPSPILRAKHFDRLTPEERTKALKKWRGAGKMNQVTSKYANQSAGKSGRRPMPGPSAVFAMKSASSCAIEQGNLSLCETALDQGYSETKAFEMAGPSKGKES

SEQ ID NO: 488 - protein, 1134 aa, unidentified
MDCSLVRTLVHRYCAGEENWVDSRTIYVGHREPPPGAEAYIPQRYPDNRIVSSKYTFWNFIPKNLFEQFRRVANFYFLIIFLVQLIIDTPTSPVTSGLPLFFVITVTAIKQGYEDWLRHKADNAMNQCPVHFIQHGKLVRKQSRKLRVGDIVMVKEDETFPCDLIFLSSNRGDGTCHVTTASLDGESSHKTHYAVQDTKGFHTEEDIGGLHATIECEQPQPDLYKFVGRINVYSDLNDPVVRPLGSENLLLRGATLKNTEKIFGVAIYTGMETKMALNYQSKSQKRSAVEKSMNAFLIVYLCILISKALINTVLKYMWQSEPFRDEPWYNQKTESERQRNLFLKAFTDFLAFMVLFNYIIPVSMYVTVEMQKFLGSYFITWDEDMFDEETGEGPLVNTSDLNEELGQVEYIFTDKTGTLTENNMEFKECCIEGHVYVPHVICNGQVLPESSGIDMIDSSPSVNGREREELFFRALCLCHTVQVKDDDSVDGPRKSPDGGKSCVYISSSPDEVALVEGVQRLGFTYLRLKDNYMEILNRENHIERFELLEILSFDSVRRRMSVIVKSATGEIYLFCKGADSSIFPRVIEGKVDQIRARVERNAVEGLRTLCVAYKRLIQEEYEGICKLLQAAKVALQDREKKLAEAYEQIEKDLTLLGATAVEDRLQEKAADTIEALQKAGIKVWVLTGDKMETAAATCYACKLFRRNTQLLELTTKRIEEQSLHDVLFELSKTVLRHSGSLTRDNLSGLSADMQDYGLIIDGAALSLIMKPREDGSSGNYRELFLEICRSCSAVLCCRMAPLQKAQIVKLIKFSKEHPITLAIGDGANDVSMILEAHVGIGVIGKEGRQAARNSDYAIPKFKHLKKMLLVHGHFYYIRISELVQYFFYKNVCFIFPQFLYQFFCGFSQQTLYDTAYLTLYNISFTSLPILLYSLMEQHVGIDVLKRDPTLYRDVAKNALLRWRVFIYWTLLGLFDALVFFFGAYFVFENTTVTSNGQIFGNWTFGTLVFTVMVFTVTLKLALDTHYWTWINHFVIWGSLLFYVVFSLLWGGVIWPFLNYQRMYYVFIQMLSSGPAWLAIVLLVTISLLPDVLKKVLCRQLWPTATERVQTKSQCLSVEQSTIFMLSQTSSSLSF

SEQ ID NO: 489 - protein, 1177 aa, unidentified
MWRWIRQQLGFDPPHQSDTRTIYVANRFPQNGLYTPQKFIDNRIISSKYTVWNFVPKNLFEQFRRVANFYFLIIFLVQLMIDTPTSPVTSGLPLFFVITVTAIKQGYEDWLRHNSDNEVNGAPVYVVRSGGLVKTRSKNIRVGDIVRIAKDEIFPADLVLLSSDRLDGSCHVTTASLDGETNLKTHVAVPETALLQTVANLDTLVAVIECQQPEADLYRFMGRMIITQQMEEIVRPLGPESLLLRGARLKNTKEIFGVAVYTGMETKMALNYKSKSQKRSAVEKSMNTFLIIYLVILISEAVISTILKYTWQAEEKWDEPWYNQKTEHQRNSSKILRFISDFLAFLVLYNFIIPISLYVTVEMQKFLGSFFIGWDLDLYHEESDQKAQVNTSDLNEELGQVEYVFTDKTGTLTENEMQFRECSINGMKYQEINGRLVPEGPTPDSSEGNLSYLSSLSHLNNLSHLTTSSSFRTSPENETELIKEHDLFFKAVSLCHTVQISNVQTDCTGDGPWQSNLAPSQLEYYASSPDEKALVEAAARIGIVFIGNSEETMEVKTLGKLERYKLLHILEFDSDRRRMSVIVQAPSGEKLLFAKGAESSILPKCIGGEIEKTRIHVDEFALKGLRTLCIAYRKFTSKEYEEIDKRIFEARTALQQREEKLAAVFQFIEKDLILLGATAVEDRLQDKVRETIEALRMAGIKVWVLTGDKHETAVSVSLSCGHFHRTMNILELINQKSDSECAEQLRQLARRITEDHVIQHGLVVDGTSLSLALREHEKLFMEVCRNCSAVLCCRMAPLQKAKVIRLIKISPEKPITLAVGDGANDVSMIQEAHVGIGIMGKEGRQAARNSDYAIARFKFLSKLLFVHGHFYYIRIATLVQYFFYKNVCFITPQFLYQFYCLFSQQTLYDSVYLTLYNICFTSLPILIYSLLEQHVDPHVLQNKPTLYRDISKNRLLSIKTFLYWTILGFSHAFIFFFGSYLLIGKDTSLLGNGQMFGNWTFGTLVFTVMVITVTVKMALETHFWTWINHLVTWGSIIFYFVFSLFYGGILWPFLGSQNMYFVFIQLLSSGSAWFAIILMVVTCLFLDIIKKVFDRHLHPTSTEKAQLTETNAGIKCLDSMCCFPEGEAACASVGRMLERVIGRCSPTHISRSWSASDPFYTNDRSILTLSTMDSSTC

SEQ ID NO: 490 - protein, 1132 aa, unidentified
MQMVPSLPPASECAGEEKRVGTRTVFVGNHPVSETEAYIAQRFCDNRIVSSKYTLWNFLPKNLFEQFRRIANFYFLIIFLVQVTVDTPTSPVTSGLPLFFVITVTAIKQGYEDCLRHRADNEVNKSTVYIIENAKRVRKESEKIKVGDVVEVQADETFPCDLILLSSCTTDGTCYVTTASLDGESNCKTHYAVRDTIALCTAESIDTLRAAIECEQPQPDLYKFVGRINIYSNSLEAVARSLGPENLLLKGATLKNTEKIYGVAVYTGMETKMALNYQGKSQKRSAVEKSINAFLIVYLFILLTKAAVCTTLKYVWQSTPYNDEPWYNQKTQKERETLKVLKMFTDFLSFMVLFNFIIPVSMYVTVEMQKFLGSFFISWDKDFYDEEINEGALVNTSDLNEELGQVDYVFTDKTGTLTENSMEFIECCIDGHKYKGVTQEVDGLSQTDGTLTYFDKVDKNREELFLRALCLCHTVEIKTNDAVDGATESAELTYISSSPDEIALVKGAKRYGFTFLGNRNGYMRVENQRKEIEEYELLHTLNFDAVRRRMSVIVKTQEGDILLFCKGADSAVFPRVQNHEIELTKVHVERNAMDGYRTLCVAFKEIAPDDYERINRQLIEAKMALQDREEKMEKVFDDIETNMNLIGATAVEDKLQDQAAETIEALHAAGLKVWVLTGDKMETAKSTCYACRLFQTNTELLELTTKTIEESERKEDRLHELLIEYRKKLLHEFPKSTRSFKKAWTEHQEYGLIIDGSTLSLILNSSQDSSSNNYKSIFLQICMKCTAVLCCRMAPLQKAQIVRMVKNLKGSPITLSIGDGANDVSMILESHVGIGIKGKEGRQAARNSDYSVPKFKHLKKLLLAHGHLYYVRIAHLVQYFFYKNLCFILPQFLYQFFCGFSQQPLYDAAYLTMYNICFTSLPILAYSLLEQHINIDTLTSDPRLYMKISGNAMLQLGPFLYWTFLAAFEGTVFFFGTYFLFQTASLEENGKVYGNWTFGTIVFTVLVFTVTLKLALDTRFWTWINHFVIWGSLAFYVFFSFFWGGIIWPFLKQQRMYFVFAQMLSSVSTWLAIILLIFISLFPEILLIVLKNVRRRSARRNLSCRRASDSLSARPSVRPLLLRTFSDESNVL

SEQ ID NO: 491 - protein, 1039 aa, unidentified
MHQKTPEIYSVELSGTKDIVKTDKGDGKEKYRGLKNNCLELKKKNHKEEFQKELHLDDHKLSNRELEEKYGTDIIMGLSSTRAAELLARDGPNSLTPPKQTPEIVKFLKQMVGGFSILLWVGAFLCWIAYGIQYSSDKSASLNNVYLGCVLGLVVILTGIFAYYQEAKSTNIMSSFNKMIPQQALVIRDSEKKTIPSEQLVVGDIVEVKGGDQIPADIRVLSSQGCRVDNSSLTGESEPQPRSSEFTHENPLETKNICFYSTTCLEGTVTGMVINTGDRTIIGHIASLASGVGNEKTPIAIEIEHFVHIVAGVAVSIGILFFIIAVSLKYQVLDSIIFLIGIIVANVPEGLLATVTVTLSLTAKRMAKKNCLVKNLEAVETLGSTSIICSDKTGTLTQNRMTVAHLWFDNQIFVADTSEDHSNQVFDQSSRTWASLSKIITLCNRAEFKPGQENVPIMKKAVIGDASETALLKFSEVILGDVMEIRKRNRKVAEIPFNSTNKFQLSIHEMDDPHGKRFLMVMKGAPERILEKCSTIMINGEEHPLDKSTAKTFHTAYMELGGLGERVLGFCHLYLPADEFPETYSFDIDAMNFPTSNLCFVGLLSMIDPPRSTVPDAVTKCRSAGIKVIMVTGDHPITAKAIAKSVGIISANSETVEDIAHRLNIAVEQVNKRDAKAAVVTGMELKDMSSEQLDEILANYQEIVFARTSPQQKLIIVEGCQRQDAVVAVTGDGVNDSPALKKADIGIAMGIAGSDAAKNAADMVLLDDNFASIVTGVEEGRLIFDNLKKTIAYSLTKNIAELCPFLIYIIVGLPLPIGTITILFIDLGTDIIPSIALAYEKAESDIMNRKPRHKNKDRLVNQPLAVYSYLHIGLMQALGAFLVYFTVYAQEGFLPRTLINLRVEWEKDYVNDLKDSYGQEWTRYQREYLEWTGYTAFFVGILVQQIADLIIRKTRRNSIFQQGLFRNKVIWVGITSQIIIGLILSYGLGSVTALSFTMLRAQYWFVAVPHAILIWVYDEVRKLFIRLYPGSWWDKNMYY

SEQ ID NO: 492 - protein, 1204 aa, unidentified
MAAAAAVGNAVPCGARPCGVRPDGQPKPGPQPRALLAAGPALIANGDELVAAVWPYRRLALLRRLTVLPFAGLLYPAWLGAAAAGCWGWGSSWVQIPEAALLVLATICLAHALTVLSGHWSVHAHCALTCTPEYDPSKATFVKVVPTPNNGSTELVALHRNEGEDGLEVLSFEFQKIKYSYDALEKKQFLPVAFPVGNAFSYYQSNRGFQEDSEIRAAEKKFGSNKAEMVVPDFSELFKERATAPFFVFQVFCVGLWCLDEYWYYSVFTLSMLVAFEASLVQQQMRNMSEIRKMGNKPHMIQVYRSRKWRPIASDEIVPGDIVSIGRSPQENLVPCDVLLLRGRCIVDEAMLTGESVPQMKEPIEDLSPDRVLDLQADSRLHVIFGGTKVVQHIPPQKATTGLKPVDSGCVAYVLRTGFNTSQGKLLRTILFGVKRVTANNLETFIFILFLLVFAIAAAAYVWIEGTKDPSRNRYKLFLECTLILTSVVPPELPIELSLAVNTSLIALAKLYMYCTEPFRIPFAGKVEVCCFDKTGTLTSDSLVVRGVAGLRDGKEVTPVSSIPVETHRALASCHSLMQLDDGTLVGDPLEKAMLTAVDWTLTKDEKVFPRSIKTQGLKIHQRFHFASALKRMSVLASYEKLGSTDLCYIAAVKGAPETLHSMFSQCPPDYHHIHTEISREGARVLALGYKELGHLTHQQAREVKREALECSLKFVGFIVVSCPLKADSKAVIREIQNASHRVVMITGDNPLTACHVAQELHFIEKAHTLILQPPSEKGRQCEWRSIDGSIVLPLARGSPKALALEYALCLTGDGLAHLQATDPQQLLRLIPHVQVFARVAPKQKEFVITSLKELGYVTLMCGDGTNDVGALKHADVGVALLANAPERVVERRRRPRDSPTLSNSGIRATSRTAKQRSGLPPSEEQPTSQRDRLSQVLRDLEDESTPIVKLGDASIAAPFTSKLSSIQCICHVIKQGRCTLVTTLQMFKILALNALILAYSQSVLYLEGVKFSDFQATLQGLLLAGCFLFISRSKPLKTLSRERPLPNIFNLYTILTVMLQFFVHFLSLVYLYREAQARSPEKQEQFVDLYKEFEPSLVNSTVYIMAMAMQMATFAINYKGPPFMESLPENKPLVWSLAVSLLAIIGLLLGSSPDFNSQFGLVDIPVEFKLVIAQVLLLDFCLALLADRVLQFFLGTPKLKVPS

SEQ ID NO: 493 - protein, 1180 aa, unidentified
MSADSSPLVGSTPTGYGTLTIGTSIDPLSSSVSSVRLSGYCGSPWRVIGYHVVVWMMAGIPLLLFRWKPLWGVRLRLRPCNLAHAETLVIEIRDKEDSSWQLFTVQVQTEAIGEGSLEPSPQSQAEDGRSQAAVGAVPEGAWKDTAQLHKSEEAVSVGQKRVLRYYLFQGQRYIWIETQQAFYQVSLLDHGRSCDDVHRSRHGLSLQDQMVRKAIYGPNVISIPVKSYPQLLVDEALNPYYGFQAFSIALWLADHYYWYALCIFLISSISICLSLYKTRKQSQTLRDMVKLSMRVCVCRPGGEEEWVDSSELVPGDCLVLPQEGGLMPCDAALVAGECMVNESSLTGESIPVLKTALPEGLGPYCAETHRRHTLFCGTLILQARAYVGPHVLAVVTRTGFCTAKGGLVSSILHPRPINFKFYKHSMKFVAALSVLALLGTIYSIFILYRNRVPLNEIVIRALDLVTVVVPPALPAAMTVCTLYAQSRLRRQGIFCIHPLRINLGGKLQLVCFDKTGTLTEDGLDVMGVVPLKGQAFLPLVPEPRRLPVGPLLRALATCHALSRLQDTPVGDPMDLKMVESTGWVLEEEPAADSAFGTQVLAVMRPPLWEPQLQAMEEPPVPVSVLHRFPFSSALQRMSVVVAWPGATQPEAYVKGSPELVAGLCNPETVPTDFAQMLQSYTAAGYRVVALASKPLPTVPSLEAAQQLTRDTVEGDLSLLGLLVMRNLLKPQTTPVIQALRRTRIRAVMVTGDNLQTAVTVARGCGMVAPQEHLIIVHATHPERGQPASLEFLPMESPTAVNGVKDPDQAASYTVEPDPRSRHLALSGPTFGIIVKHFPKLLPKVLVQGTVFARMAPEQKTELVCELQKLQYCVGMCGDGANDCGALKAADVGISLSQAEASVVSPFTSSMASIECVPMVIREGRCSLDTSFSVFKYMALYSLTQFISVLILYTINTNLGDLQFLAIDLVITTTVAVLMSRTGPALVLGRVRPPGALLSVPVLSSLLLQMVLVTGVQLGGYFLTLAQPWFVPLNRTVAAPDNLPNYENTVVFSLSSFQYLILAAAVSKGAPFRRPLYTNVPFLVALALLSSVLVGLVLVPGLLQGPLALRNITDTGFKLLLLGLVTLNFVGAFMLESVLDQCLPACLRRLRPKRASKKRFKQLERELAEQPWPPLPAGPLR

SEQ ID NO: 494 - protein, 1226 aa, unidentified
MDREERKTINQGQEDEMEIYGYNLSRWKLAIVSLGVICSGGFLLLLLYWMPEWRVKATCVRAAIKDCEVVLLRTTDEFKMWFCAKIRVLSLETYPVSSPKSMSNKLSNGHAVCLIENPTEENRHRISKYSQTESQQIRYFTHHSVKYFWNDTIHNFDFLKGLDEGVSCTSIYEKHSAGLTKGMHAYRKLLYGVNEIAVKVPSVFKLLIKEVLNPFYIFQLFSVILWSTDEYYYYALAIVVMSIVSIVSSLYSIRKQYVMLHDMVATHSTVRVSVCRVNEEIEEIFSTDLVPGDVMVIPLNGTIMPCDAVLINGTCIVNESMLTGESVPVTKTNLPNPSVDVKGIGDELYNPETHKRHTLFCGTTVIQTRFYTGELVKAIVVRTGFSTSKGQLVRSILYPKPTDFKLYRDAYLFLLCLVAVAGIGFIYTIINSILNEVQVGVIIIESLDIITITVPPALPAAMTAGIVYAQRRLKKIGIFCISPQRINICGQLNLVCFDKTGTLTEDGLDLWGIQRVENARFLSPEENVCNEMLVKSQFVACMATCHSLTKIEGVLSGDPLDLKMFEAIGWILEEATEEETALHNRIMPTVVRPPKQLLPESTPAGNQEMELFELPATYEIGIVRQFPFSSALQRMSVVARVLGDRKMDAYMKGAPEAIAGLCKPETVPVDFQNVLEDFTKQGFRVIALAHRKLESKLTWHKVQNISRDAIENNMDFMGLIIMQNKLKQETPAVLEDLHKANIRTVMVTGDSMLTAVSVARDCGMILPQDKVIIAEALPPKDGKVAKINWHYADSLTQCSHPSAIDPEAIPVKLVHDSLEDLQMTRYHFAMNGKSFSVILEHFQDLVPKLMLHGTVFARMAPDQKTQLIEALQNVDYFVGMCGDGANDCGALKRAHGGISLSELEASVASPFTSKTPSISCVPNLIREGRAALITSFCVFKFMALYSIIQYFSVTLLYSILSNLGDFQFLFIDLAIILVVVFTMSLNPAWKELVAQRPPSGLISGALLFSVLSQIIICIGFQSLGFFWVKQQPWYEVWHPKSDACNTTGSGFWNSSHVDNETELDEHNIQNYENTTVFFISSFQYLIVAIAFSKGKPFRQPCYKNYFFVFSVIFLYIFILFIMLYPVASVDQVLQIVCVPYQWRVTMLIIVLVNAFVSITVEESVDRWGKCCLPWALGCRKKTPKAKYMYLAQELLVDPEWPPKPQTTTEAKALVKENGSCQIITIT

SEQ ID NO: 495 - protein, 1196 aa, unidentified
MGHFEKGQHALLNEGEENEMEIFGYRTQGCRKSLCLAGSIFSFGILPLVFYWRPAWHVWAHCVPCSLQEADTVLLRTTDEFQIYSWKKVIWIYLSALNSAFGLTPDHPLMTDEEYIINRAIRKPDLKVRCIKVQKIRYVWNYLEGQFQKIGSLEDWLSSAKIHQKFGSGLTREEQEIRRLICGPNTIDVEVTPIWKLLIKEVLNPFYIFQLFSVCLWFSEDYKEYAFAIIIMSIISISLTVYDLREQSVKLHHLVESHNSITVSVCGRKAGVQELESRVLVPGDLLILTGNKVLMPCDAVLIEGSCVVDEGMLTGESIPVTKTPLPKMDSSVPWKTQSEADYKRHVLFCGTEVIQAKAACSGTVRAVVLQTGFNTAKGDLVRSILYPKPVNFQLYRDAIRFLLCLVGTATIGMIYTLCVYVLSGEPPEEVVRKALDVITIAVPPALPAALTTGIIYAQRRLKKRGIFCISPQRINVCGQLNLVCFDKTGTLTRDGLDLWGVVSCDRNGFQEVHSFASGQALPWGPLCAAMASCHSLILLDGTIQGDPLDLKMFEATTWEMAFSGDDFHIKGVPAHAMVVKPCRTASQVPVEGIAILHQFPFSSALQRMTVIVQEMGGDRLAFMKGAPERVASFCQPETVPTSFVSELQIYTTQGFRVIALAYKKLENDHHATTLTRETVESDLIFLGLLILENRLKEETKPVLEELISARIRTVMITGDNLQTAITVARKSGMVSESQKVILIEANETTGSSSASISWTLVEEKKHIMYGNQDNYINIRDEVSDKGREGSYHFALTGKSFHVISQHFSSLLPKILINGTIFARMSPGQKSSLVEEFQKLDYFVGMCGDGANDCGALKMAHVGISLSEQEASVASPFTSKTPNIECVPHLIKEGRAALVTSFCMFKYMALYSMIQYVGVLLLYWETNSLSNYQFLFQDLAITTLIGVTMNLNGAYPKLVPFRPAGRLISPPLLLSVIFNILLSLAMHIAGFILVQRQPWYSVEIHSACTVQNESISELTMSPTAPEKMESNSTFTSFENTTVWFLGTINCITVALVFSKGKPFRQPTYTNYIFVLVLIIQLGVCLFILFADIPELYRRLDLLCTPVLWRASIVIMLSLNFIVSLVAEEAVIENRALWMMIKRCFGYQSKSQYRIWQRDLANDPSWPPLNQTSHSDMPECGRGVSYSNPVFESNEEQL

SEQ ID NO: 496 - protein, 1218 aa, unidentified
MEENSKKDHRALLNQGEEDELEVFGYRDHNVRKAFCLVASVLTCGGLLLVFYWRPQWRVWANCIPCPLQEADTVLLRTTDEFQRYMRKKVFCLYLSTLKFPVSKKWEESLVADRHSVINQALIKPELKLRCMEVQKIRYVWNDLEKRFQKVGLLEDSNSCSDIHQTFGLGLTSEEQEVRRLVCGPNAIEVEIQPIWKLLVKQVLNPFYVFQAFTLTLWLSQGYIEYSVAIIILTVISIVLSVYDLRQQSVKLHNLVEDHNKVQVTIIVKDKGLEELESRLLVPGDILILPGKFSLPCDAVLIDGSCVVNEGMLTGESIPVTKTPLPQMENTMPWKCHSLEDYRKHVLFCGTEVIQVKPSGQGPVRAVVLQTGYNTAKGDLVRSILYPRPLNFKLYSDAFKFIVFLACLGVMGFFYALGVYMYHGVPPKDTVTMALILLTVTVPPVLPAALTIGNVYAQKRLKKKKIFCISPQRINMCGQINLVCFDKTGTLTEDGLDLWGTVPTADNCFQEAHSFASGQAVPWSPLCAAMASCHSLILLNGTIQGDPLDLKMFEGTAWKMEDCIVDSCKFGTSVSNIIKPGPKASKSPVEAIITLCQFPFSSSLQRMSVIAQLAGENHFHVYMKGAPEMVARFCRSETVPKNFPQELRSYTVQGFRVIALAHKTLKMGNLSEVEHLAREKVESELTFLGLLIMENRLKKETKLVLKELSEARIRTVMITGDNLQTAITVAKNSEMIPPGSQVIIVEADEPEEFVPASVTWQLVENQETGPGKKEIYMHTGNSSTPRGEGGSCYHFAMSGKSYQVIFQHFNSLLPKILVNGTVFARMSPGQKSSLIEEFQKLNYYVGMCGDGANDCGALKAAHAGISLSEQEASVASPFTSKTTNIQCVPHLIREGRAALVSSFGVFKYLTMYGIIQFISALLLYWQLQLFGNYQYLMQDVAITLMVCLTMSSTHAYPKLAPYRPAGQLLSPPLLLSIFLNSCFSCIVQISAFLYVKQQPWYCEVYQYSECFLANQSNFSTNVSLERNWTGNATLIPGSILSFETTTLWPITTINYITVAFIFSKGKPFRKPIYTNYIFSFLLLAALGLTIFILFSDFQVIYRGMELIPTITSWRVLILVVALTQFCVAFFVEDSILQNHELWLLIKREFGFYSKSQYRTWQKKLAEDSTWPPINRTDYSGDGKNGFYINGGYESHEQIPKRKLKLGGQPTEQHFWARL

SEQ ID NO: 497 - protein, 1023 aa, unidentified
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 498 - protein, 1020 aa, unidentified
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 499 - protein, 1013 aa, unidentified
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 500 - protein, 1029 aa, unidentified
MGLWGKKGTVAPHDQSPRRRPKKGLIKKKMVKREKQKRNMEELKKEVVMDDHKLTLEELSTKYSVDLTKGHSHQRAKEILTRGGPNTVTPPPTTPEWVKFCKQLFGGFSLLLWTGAILCFVAYSIQIYFNEEPTKDNLYLSIVLSVVVIVTGCFSYYQEAKSSKIMESFKNMVPQQALVIRGGEKMQINVQEVVLGDLVEIKGGDRVPADLRLISAQGCKVDNSSLTGESEPQSRSPDFTHENPLETRNICFFSTNCVEGTARGIVIATGDSTVMGRIASLTSGLAVGQTPIAAEIEHFIHLITVVAVFLGVTFFALSLLLGYGWLEAIIFLIGIIVANVPEGLLATVTVCLTLTAKRMARKNCLVKNLEAVETLGSTSTICSDKTGTLTQNRMTVAHMWFDMTVYEADTTEEQTGKTFTKSSDTWFMLARIAGLCNRADFKANQEILPIAKRATTGDASESALLKFIEQSYSSVAEMREKNPKVAEIPFNSTNKYQMSIHLREDSSQTHVLMMKGAPERILEFCSTFLLNGQEYSMNDEMKEAFQNAYLELGGLGERVLGFCFLNLPSSFSKGFPFNTDEINFPMDNLCFVGLISMIDPPRAAVPDAVSKCRSAGIKVIMVTGDHPITAKAIAKGVGIISEGTETAEEVAARLKIPISKVDASAAKAIVVHGAELKDIQSKQLDQILQNHPEIVFARTSPQQKLIIVEGCQRLGAVVAVTGDGVNDSPALKKADIGIAMGISGSDVSKQAADMILLDDNFASIVTGVEEGRLIFDNLKKSIMYTLTSNIPEITPFLMFIILGIPLPLGTITILCIDLGTDMVPAISLAYESAESDIMKRLPRNPKTDNLVNHRLIGMAYGQIGMIQALAGFFTYFVILAENGFRPVDLLGIRLHWEDKYLNDLEDSYGQQWTYEQRKVVEFTCQTAFFVTIVVVQWADLIISKTRRNSLFQQGMRNKVLIFGILEETLLAAFLSYTPGMDVALRMYPLKITWWLCAIPYSILIFVYDEIRKLLIRQHPDGWVERETYY

SEQ ID NO: 501 - protein, 303 aa, unidentified
MARGKAKEEGSWKKFIWNSEKKEFLGRTGGSWFKILLFYVIFYGCLAGIFIGTIQVMLLTISEFKPTYQDRVAPPGLTQIPQIQKTEISFRPNDPKSYEAYVLNIVRFLEKYKDSAQRDDMIFEDCGDVPSEPKERGDFNHERGERKVCRFKLEWLGNCSGLNDETYGYKEGKPCIIIKLNRVLGFKPKPPKNESLETYPVMKYNPNVLPVQCTGKRDEDKDKVGNVEYFGLGNSPGFPLQYYPYYGKLLQPKYLQPLLAVQFTNLTMDTEIRIECKAYGENIGYSEKDRFQGRFDVKIEVKS

SEQ ID NO: 502 - protein, 290 aa, unidentified
MVIQKEKKSCGQVVEEWKEFVWNPRTHQFMGRTGTSWAFILLFYLVFYGFLTAMFTLTMWVMLQTVSDHTPKYQDRLATPGLMIRPKTENLDVIVNVSDTESWDQHVQKLNKFLEPYNDSIQAQKNDVCRPGRYYEQPDNGVLNYPKRACQFNRTQLGNCSGIGDSTHYGYSTGQPCVFIKMNRVINFYAGANQSMNVTCAGKRDEDAENLGNFVMFPANGNIDLMYFPYYGKKFHVNYTQPLVAVKFLNVTPNVEVNVECRINAANIATDDERDKFAGRVAFKLRINKT

SEQ ID NO: 503 - protein, 279 aa, unidentified
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 504 - protein, 357 aa, unidentified
MRRQLRSRRAPSFPYSYRYRLDDPDEANQNYLADEEEEAEEEARVTVVPKSEEEEEEEEKEEEEEEEKEEEEGQGQPTGNAWWQKLQIMSEYLWDPERRMFLARTGQSWSLILLIYFFFYASLAAVITLCMYTLFLTISPYIPTFTERVKPPGVMIRPFAHSLNFNFNVSEPDTWQHYVISLNGFLQGYNDSLQEEMNVDCPPGQYFIQDGNEDEDKKACQFKRSFLKNCSGLEDPTFGYSTGQPCILLKMNRIVGFRPELGDPVKVSCKVQRGDENDIRSISYYPESASFDLRYYPYYGKLTHVNYTSPLVAMHFTDVVKNQAVPVQCQLKGKGVINDVINDRFVGRVIFTLNIET

SEQ ID NO: 505 - protein, 1001 aa, unidentified
MEAAHAKTTEECLAYFGVSETTGLTPDQVKRNLEKYGLNELPAEEGKTLWELVIEQFEDLLVRILLLAACISFVLAWFEEGEETITAFVEPFVILLILIANAIVGVWQERNAENAIEALKEYEPEMGKVYRADRKSVQRIKARDIVPGDIVEVAVGDKVPADIRILAIKSTTLRVDQSILTGESVSVIKHTEPVPDPRAVNQDKKNMLFSGTNIAAGKALGIVATTGVGTEIGKIRDQMAATEQDKTPLQQKLDEFGEQLSKVISLICVAVWLINIGHFNDPVHGGSWFRGAIYYFKIAVALAVAAIPEGLPAVITTCLALGTRRMAKKNAIVRSLPSVETLGCTSVICSDKTGTLTTNQMSVCKMFIIDKVDGDICLLNEFSITGSTYAPEGEVLKNDKPVRPGQYDGLVELATICALCNDSSLDFNEAKGVYEKVGEATETALTTLVEKMNVFNTDVRSLSKVERANACNSVIRQLMKKEFTLEFSRDRKSMSVYCSPAKSSRAAVGNKMFVKGAPEGVIDRCNYVRVGTTRVPLTGPVKEKIMAVIKEWGTGRDTLRCLALATRDTPPKREEMVLDDSARFLEYETDLTFVGVVGMLDPPRKEVTGSIQLCRDAGIRVIMITGDNKGTAIAICRRIGIFGENEEVADRAYTGREFDDLPLAEQREACRRACCFARVEPSHKSKIVEYLQSYDEITAMTGDGVNDAPALKKAEIGIAMGSGTAVAKTASEMVLADDNFSTIVAAVEEGRAIYNNMKQFIRYLISSNVGEVVCIFLTAALGLPEALIPVQLLWVNLVTDGLPATALGFNPPDLDIMDRPPRSPKEPLISGWLFFRYMAIGGYVGAATVGAAAWWFLYAEDGPHVNYSQLTHFMQCTEDNTHFEGIDCEVFEAPEPMTMALSVLVTIEMCNALNSLSENQSLLRMPPWVNIWLLGSICLSMSLHFLILYVDPLPMIFKLRALDLTQWLMVLKISLPVIGLDEILKFVARNYLEDPEDERRK

SEQ ID NO: 506 - protein, 1042 aa, unidentified
MENAHTKTVEEVLGHFGVNESTGLSLEQVKKLKERWGSNELPAEEGKTLLELVIEQFEDLLVRILLLAACISFVLAWFEEGEETITAFVEPFVILLILVANAIVGVWQERNAENAIEALKEYEPEMGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGKECVQPATKSCSFSACTDGISWPFVLLIMPLVIWVYSTDTNFSDMFWS

SEQ ID NO: 507 - protein, 1043 aa, unidentified
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGRNEPEVSAGNRVESPVCTSD

SEQ ID NO: 508 - protein, 1220 aa, unidentified
MGDMANNSVAYSGVKNSLKEANHDGDFGITLAELRALMELRSTDALRKIQESYGDVYGICTKLKTSPNEGLSGNPADLERREAVFGKNFIPPKKPKTFLQLVWEALQDVTLIILEIAAIVSLGLSFYQPPEGDNALCGEVSVGEEEGEGETGWIEGAAILLSVVCVVLVTAFNDWSKEKQFRGLQSRIEQEQKFTVIRGGQVIQIPVADITVGDIAQVKYGDLLPADGILIQGNDLKIDESSLTGESDHVKKSLDKDPLLLSGTHVMEGSGRMVVTAVGVNSQTGIIFTLLGAGGEEEEKKDEKKKEKKNKKQDGAIENRNKAKAQDGAAMEMQPLKSEEGGDGDEKDKKKANLPKKEKSVLQGKLTKLAVQIGKAGLLMSAITVIILVLYFVIDTFWVQKRPWLAECTPIYIQYFVKFFIIGVTVLVVAVPEGLPLAVTISLAYSVKKMMKDNNLVRHLDACETMGNATAICSDKTGTLTMNRMTVVQAYINEKHYKKVPEPEAIPPNILSYLVTGISVNCAYTSKILPPEKEGGLPRHVGNKTECALLGLLLDLKRDYQDVRNEIPEEALYKVYTFNSVRKSMSTVLKNSDGSYRIFSKGASEIILKKCFKILSANGEAKVFRPRDRDDIVKTVIEPMASEGLRTICLAFRDFPAGEPEPEWDNENDIVTGLTCIAVVGIEDPVRPEVPDAIKKCQRAGITVRMVTGDNINTARAIATKCGILHPGEDFLCLEGKDFNRRIRNEKGEIEQERIDKIWPKLRVLARSSPTDKHTLVKGIIDSTVSDQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTLASLALATEPPTESLLLRKPYGRNKPLISRTMMKNILGHAFYQLVVVFTLLFAGEKFFDIDSGRNAPLHAPPSEHYTIVFNTFVLMQLFNEINARKIHGERNVFEGIFNNAIFCTIVLGTFVVQIIIVQFGGKPFSCSELSIEQWLWSIFLGMGTLLWGQLISTIPTSRLKFLKEAGHGTQKEEIPEEELAEDVEEIDHAERELRRGQILWFRGLNRIQTQIRVVNAFRSSLYEGLEKPESRSSIHNFMTHPEFRIEDSEPHIPLIDDTDAEDDAPTKRNSSPPPSPNKNNNAVDSGIHLTIEMNKSATSSSPGSPLHSLETSL

SEQ ID NO: 509 - protein, 1243 aa, unidentified [sequence omitted]

SEQ ID NO: 510 - protein, 1220 aa, unidentified
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQIRVVKAFRSSLYEGLEKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 511 - protein, 1241 aa, unidentified
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYIKVVKAFHSSLHESIQKPYNQKSIHSFMTHPEFAIEEELPRTPLLDEEEEENPDKASKFGTRVLLLDGEVTPYANTNNNAVDCNQVQLPQSDSSLQSLETSV

SEQ ID NO: 512 - protein, 919 aa, unidentified
MKVARFQKIPNGENETMIPVLTSKKASELPVSEVASILQADLQNGLNKCEVSHRRAFHGWNEFDISEDEPLWKKYISQFKNPLIMLLLASAVISVLMHQFDDAVSITVAILIVVTVAFVQEYRSEKSLEELSKLVPPECHCVREGKLEHTLARDLVPGDTVCLSVGDRVPADLRLFEAVDLSIDESSLTGETTPCSKVTAPQPAATNGDLASRSNIAFMGTLVRCGKAKGVVIGTGENSEFGEVFKMMQAEEAPKTPLQKSMDLLGKQLSFYSFGIIGIIMLVGWLLGKDILEMFTISVSLAVAAIPEGLPIVVTVTLALGVMRMVKKRAIVKKLPIVETLGCCNVICSDKTGTLTKNEMTVTHIFTSDGLHAEVTGVGYNQFGEVIVDGDVVHGFYNPAVSRIVEAGCVCNDAVIRNNTLMGKPTEGALIALAMKMGLDGLQQDYIRKAEYPFSSEQKWMAVKCVHRTQQDRPEICFMKGAYEQVIKYCTTYQSKGQTLTLTQQQRDVYQQEKARMGSAGLRVLALASGPELGQLTFLGLVGIIDPPRTGVKEAVTTLIASGVSIKMITGDSQETAVAIASRLGLYSKTSQSVSGEEIDAMDVQQLSQIVPKVAVFYRASPRHKMKIIKSLQKNGSVVAMTGDGVNDAVALKAADIGVAMGQTGTDVCKEAADMILVDDDFQTIMSAIEEGKGIYNNIKNFVRFQLSTSIAALTLISLATLMNFPNPLNAMQILWINIIMDGPPAQSLGVEPVDKDVIRKPPRNWKDSILTKNLILKILVSSIIIVCGTLFVFWRELRDNVITPRDTTMTFTCFVFFDMFNALSSRSQTKSVFEIGLCSNRMFCYAVLGSIMGQLLVIYFPPLQKVFQTESLSILDLLFLLGLTSSVCIVAEIIKKVERSREKIQKHVSSTSSSFLEV

SEQ ID NO: 513 - protein, 946 aa, unidentified
MVEGRVSEFLKKLGFSGGGRQYQALEKDEEEALIDEQSELKAIEKEKKVTALPPKEACKCQKEDLARAFCVDLHTGLSEFSVTQRRLAHGWNEFVADNSEPVWKKYLDQFKNPLILLLLGSALVSVLTKEYEDAVSIATAVLVVVTVAFIQEYRSEKSLEELTKLVPPECNCLREGKLQHLLARELVPGDVVSLSIGDRIPADIRLTEVTDLLVDESSFTGEAEPCSKTDSPLTGGGDLTTLSNIVFMGTLVQYGRGQGVVIGTGESSQFGEVFKMMQAEETPKTPLQKSMDRLGKQLTLFSFGIIGLIMLIGWSQGKQLLSMFTIGVSLAVAAIPEGLPIVVMVTLVLGVLRMAKKRVIVKKLPIVETLGCCSVLCSDKTGTLTANEMTVTQLVTSDGLRAEVSGVGYDGQGTVCLLPSKEVIKEFSNVSVGKLVEAGCVANNAVIRKNAVMGQPTEGALMALAMKMDLSDIKNSYIRKKEIPFSSEQKWMAVKCSLKTEDQEDIYFMKGALEEVIRYCTMYNNGGIPLPLTPQQRSFCLQEEKRMGSLGLRVLALASGPELGRLTFLGLVGIIDPPRVGVKEAVQVLSESGVSVKMITGDALETALAIGRNIGLCNGKLQAMSGEEVDSVEKGELADRVGKVSVFFRTSPKHKLKIIKALQESGAIVAMTGDGVNDAVALKSADIGIAMGQTGTDVSKEAANMILVDDDFSAIMNAVEEGKGIFYNIKNFVRFQLSTSISALSLITLSTVFNLPSPLNAMQILWINIIMDGPPAQSLGVEPVDKDAFRQPPRSVRDTILSRALILKILMSAAIIISGTLFIFWKEMPEDRASTPRTTTMTFTCFVFFDLFNALTCRSQTKLIFEIGFLRNHMFLYSVLGSILGQLAVIYIPPLQRVFQTENLGALDLLFLTGLASSVFILSELLKLCEKYCCSPKRVQMHPEDV

SEQ ID NO: 514 - protein, 1035 aa, unidentified
MGKAENYELYSVELGPGPGGDMAAKMSKKKKAGGGGGKRKEKLENMKKEMEINDHQLSVAELEQKYQTSATKGLSASLAAELLLRDGPNALRPPRGTPEYVKFARQLAGGLQCLMWVAAAICLIAFAIQASEGDLTTDDNLYLAIALIAVVVVTGCFGYYQEFKSTNIIASFKNLVPQQATVIRDGDKFQINADQLVVGDLVEMKGGDRVPADIRILAAQGCKVDNSSLTGESEPQTRSPECTHESPLETRNIAFFSTMCLEGTVQGLVVNTGDRTIIGRIASLASGVENEKTPIAIEIEHFVDIIAGLAILFGATFFIVAMCIGYTFLRAMVFFMAIVVAYVPEGLLATVTVCLSLTAKRLASKNCVVKNLEAVETLGSTSVICSDKTGTLTQNRMTVSHLWFDNHIHTADTTEDQSGQTFDQSSETWRALCRVLTLCNRAAFKSGQDAVPVPKRIVIGDASETALLKFSELTLGNAMGYRDRFPKVCEIPFNSTNKFQLSIHTLEDPRDPRHLLVMKGAPERVLERCSSILIKGQELPLDEQWREAFQTAYLSLGGLGERVLGFCQLYLNEKDYPPGYAFDVEAMNFPSSGLCFAGLVSMIDPPRATVPDAVLKCRTAGIRVIMVTGDHPITAKAIAASVGIISEGSETVEDIAARLRVPVDQVNRKDARACVINGMQLKDMDPSELVEALRTHPEMVFARTSPQQKLVIVESCQRLGAIVAVTGDGVNDSPALKKADIGVAMGIAGSDAAKNAADMILLDDNFASIVTGVEQGRLIFDNLKKSIAYTLTKNIPELTPYLIYITVSVPLPLGCITILFIELCTDIFPSVSLAYEKAESDIMHLRPRNPKRDRLVNEPLAAYSYFQIGAIQSFAGFTDYFTAMAQEGWFPLLCVGLRAQWEDHHLQDLQDSYGQEWTFGQRLYQQYTCYTVFFISIEVCQIADVLIRKTRRLSAFQQGFFRNKILVIAIVFQVCIGCFLCYCPGMPNIFNFMPIRFQWWLVPLPYGILIFVYDEIRKLGVRCCPGSWWDQELYY

SEQ ID NO: 515 - protein, 291 aa, unidentified
MAALQEKKTCGQRMEEFQRYCWNPDTGQMLGRTLSRWVWISLYYVAFYVVMTGLFALCLYVLMQTVDPYTPDYQDQLRSPGVTLRPDVYGEKGLEIVYNVSDNRTWADLTQTLHAFLAGYSPAAQEDSINCTSEQYFFQESFRAPNHTKFSCKFTADMLQNCSGLADPNFGFEEGKPCFIIKMNRIVKFLPSNGSAPRVDCAFLDQPRELGQPLQVKYYPPNGTFSLHYFPYYGKKAQPHYSNPLVAAKLLNIPRNAEVAIVCKVMAEHVTFNNPHDPYEGKVEFKLKIEK

SEQ ID NO: 516 - protein, 256 aa, unidentified
MLSRVVLSAAATAAPSLKNAAFLGPGVLQATRTFHTGQPHLVPVPPLPEYGGKVRYGLIPEEFFQFLYPKTGVTGPYVLGTGLILYALSKEIYVISAETFTALSVLGVMVYGIKKYGPFVADFADKLNEQKLAQLEEAKQASIQHIQNAIDTEKSQQALVQKRHYLFDVQRNNIAMALEVTYRERLYRVYKEVKNRLDYHISVQNMMRRKEQEHMINWVEKHVVQSISTQQEKETIAKCIADLKLLAKKAQAQPVM

SEQ ID NO: 517 - protein, 136 aa, unidentified
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 518 - protein, 141 aa, unidentified
MFACSKFVSTPSLVKSTSQLLSRPLSAVVLKRPEILTDESLSSLAVSCPLTSLVSSRSFQTSAISRDIDTAAKFIGAGAATVGVAGSGAGIGTVFGSLIIGYARNPSLKQQLFSYAILGFALSEAMGLFCLMVAFLILFAM

SEQ ID NO: 519 - protein, 142 aa, unidentified
MFACAKLACTPSLIRAGSRVAYRPISASVLSRPEASRTGEGSTVFNGAQNGVSQLIQREFQTSAISRDIDTAAKFIGAGAATVGVAGSGAGIGTVFGSLIIGYARNPSLKQQLFSYAILGFALSEAMGLFCLMVAFLILFAM

SEQ ID NO: 520 - protein, 94 aa, unidentified
MASVGECPAPVPVKDKKLLEVKLGELPSWILMRDFSPSGIFGAFQRGYYRYYNKYINVKKGSISGITMVLACYVLFSYSFSYKHLKHERLRKYH

SEQ ID NO: 521 - protein, 103 aa, unidentified
MAQFVRNLVEKTPALVNAAVTYSKPRLATFWYYAKVELVPPTPAEIPRAIQSLKKIVNSAQTGSFKQLTVKEAVLNGLVATEVLMWFYVGEIIGKRGIIGYDV

SEQ ID NO: 522 - protein, 470 aa, unidentified
MMAAMATARVRMGPRCAQALWRMPWLPVFLSLAAAAAAAAAEQQVPLVLWSSDRDLWAPAADTHEGHITSDLQLSTYLDPALELGPRNVLLFLQDKLSIEDFTAYGGVFGNKQDSAFSNLENALDLAPSSLVLPAVDWYAVSTLTTYLQEKLGASPLHVDLATLRELKLNASLPALLLIRLPYTASSGLMAPREVLTGNDEVIGQVLSTLKSEDVPYTAALTAVRPSRVARDVAVVAGGLGRQLLQKQPVSPVIHPPVSYNDTAPRILFWAQNFSVAYKDQWEDLTPLTFGVQELNLTGSFWNDSFARLSLTYERLFGTTVTFKFILANRLYPVSARHWFTMERLEVHSNGSVAYFNASQVTGPSIYSFHCEYVSSLSKKGSLLVARTQPSPWQMMLQDFQIQAFNVMGEQFSYASDCASFFSPGIWMGLLTSLFMLFIFTYGLHMILSLKTMDRFDDHKGPTISLTQIV

SEQ ID NO: 523 - protein, 224 aa, unidentified
MRLWKARVLKLVLKTAKDSRLGLNSKWLSLKLGDAGNPRSLAIRFILTNYNKLSIQSWFSLRRVEIISNNSIQAVFNPTGVYAPSGYSYRCQRVGSLQQDQALLLPSDTDDGSSLWEVTFIDFQIQGFAIKGGRFTKAQDCASSFSPAFLIGLAMSLILLLVLAYALHMLIYLRYLDQQYDLIASPAHFSQLKARDTAEEKELLRSQGAECYKLRSQQISKIYV

SEQ ID NO: 524 - protein, 350 aa, unidentified
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLYGGNAVVELVTVKSFDTSLIRKTRTILEAKQAKNPASPYNLAYKYNFEYSVVFNMVLWIMIALALAVIITSYNIWNMDPGYDSIIYRMTNQKIRMD

SEQ ID NO: 525 - protein, 837 aa, unidentified
MGELFRSEEMTLAQLFLQSEAAYCCVSELGELGKVQFRDLNPDVNVFQRKFVNEVRRCEEMDRKLRFVEKEIRKANIPIMDTGENPEVPFPRDMIDLEANFEKIENELKEINTNQEALKRNFLELTELKFILRKTQQFFDEMADPDLLEESSSLLEPSEMGRGTPLRLGFVAGVINRERIPTFERMLWRVCRGNVFLRQAEIENPLEDPVTGDYVHKSVFIIFFQGDQLKNRVKKICEGFRASLYPCPETPQERKEMASGVNTRIDDLQMVLNQTEDHRQRVLQAAAKNIRVWFIKVRKMKAIYHTLNLCNIDVTQKCLIAEVWCPVTDLDSIQFALRRGTEHSGSTVPSILNRMQTNQTPPTYNKTNKFTYGFQNIVDAYGIGTYREINPAPYTIITFPFLFAVMFGDFGHGILMTLFAVWMVLRESRILSQKNENEMFSTVFSGRYIILLMGVFSMYTGLIYNDCFSKSLNIFGSSWSVRPMFTYNWTEETLRGNPVLQLNPALPGVFGGPYPFGIDPIWNIATNKLTFLNSFKMKMSVILGIIHMLFGVSLSLFNHIYFKKPLNIYFGFIPEIIFMTSLFGYLVILIFYKWTAYDAHTSENAPSLLIHFINMFLFSYPESGYSMLYSGQKGIQCFLVVVALLCVPWMLLFKPLVLRRQYLRRKHLGTLNFGGIRVGNGPTEEDAEIIQHDQLSTHSEDADEPSEDEVFDFGDTMVHQAIHTIEYCLGCISNTASYLRLWALSLAHAQLSEVLWTMVIHIGLSVKSLAGGLVLFFFFTAFATLTVAILLIMEGLSAFLHALRLHWVEFQNKFYSGTGFKFLPFSFEHIREGKFEE

SEQ ID NO: 526 - protein, 856 aa, unidentified
MGSLFRSETMCLAQLFLQSGTAYECLSALGEKGLVQFRDLNQNVSSFQRKFVGEVKRCEELERILVYLVQEINRADIPLPEGEASPPAPPLKQVLEMQEQLQKLEVELREVTKNKEKLRKNLLELIEYTHMLRVTKTFVKRNVEFEPTYEEFPSLESDSLLDYSCMQRLGAKLGFVSGLINQGKVEAFEKMLWRVCKGYTIVSYAELDESLEDPETGEVIKWYVFLISFWGEQIGHKVKKICDCYHCHVYPYPNTAEERREIQEGLNTRIQDLYTVLHKTEDYLRQVLCKAAESVYSRVIQVKKMKAIYHMLNMCSFDVTNKCLIAEVWCPEADLQDLRRALEEGSRESGATIPSFMNIIPTKETPPTRIRTNKFTEGFQNIVDAYGVGSYREVNPALFTIITFPFLFAVMFGDFGHGFVMFLFALLLVLNENHPRLNQSQEIMRMFFNGRYILLLMGLFSVYTGLIYNDCFSKSVNLFGSGWNVSAMYSSSHPPAEHKKMVLWNDSVVRHNSILQLDPSIPGVFRGPYPLGIDPIWNLATNRLTFLNSFKMKMSVILGIIHMTFGVILGIFNHLHFRKKFNIYLVSIPELLFMLCIFGYLIFMIFYKWLVFSAETSRVAPSILIEFINMFLFPASKTSGLYTGQEYVQRVLLVVTALSVPVLFLGKPLFLLWLHNGRSCFGVNRSGYTLIRKDSEEEVSLLGSQDIEEGNHQVEDGCREMACEEFNFGEILMTQVIHSIEYCLGCISNTASYLRLWALSLAHAQLSDVLWAMLMRVGLRVDTTYGVLLLLPVIALFAVLTIFILLIMEGLSAFLHAIRLHWVEFQNKFYVGAGTKFVPFSFSLLSSKFNNDDSVA

SEQ ID NO: 527 - protein, 840 aa, unidentified
MVSVFRSEEMCLSQLFLQVEAAYCCVAELGELGLVQFKDLNMNVNSFQRKFVNEVRRCESLERILRFLEDEMQNEIVVQLLEKSPLTPLPREMITLETVLEKLEGELQEANQNQQALKQSFLELTELKYLLKKTQDFFETETNLADDFFTEDTSGLLELKAVPAYMTGKLGFIAGVINRERMASFERLLWRICRGNVYLKFSEMDAPLEDPVTKEEIQKNIFIIFYQGEQLRQKIKKICDGFRATVYPCPEPAVERREMLESVNVRLEDLITVITQTESHRQRLLQEAAANWHSWLIKVQKMKAVYHILNMCNIDVTQQCVIAEIWFPVADATRIKRALEQGMELSGSSMAPIMTTVQSKTAPPTFNRTNKFTAGFQNIVDAYGVGSYREINPAPYTIITFPFLFAVMFGDCGHGTVMLLAALWMILNERRLLSQKTDNEIWNTFFHGRYLILLMGIFSIYTGLIYNDCFSKSLNIFGSSWSVQPMFRNGTWNTHVMEESLYLQLDPAIPGVYFGNPYPFGIDPIWNLASNKLTFLNSYKMKMSVILGIVQMVFGVILSLFNHIYFRRTLNIILQFIPEMIFILCLFGYLVFMIIFKWCCFDVHVSQHAPSILIHFINMFLFNYSDSSNAPLYKHQQEVQSFFVVMALISVPWMLLIKPFILRASHRKSQLQASRIQEDATENIEGDSSSPSSRSGQRTSADTHGALDDHGEEFNFGDVFVHQAIHTIEYCLGCISNTASYLRLWALSLAHAQLSEVLWTMVMNSGLQTRGWGGIVGVFIIFAVFAVLTVAILLIMEGLSAFLHALRLHWVEFQNKFYVGDGYKFSPFSFKHILDGTAEE

SEQ ID NO: 528 - protein, 205 aa, unidentified
MTGLALLYSGVFVAFWACALAVGVCYTIFDLGFRFDVAWFLTETSPFMWSNLGIGLAISLSVVGAAWGIYITGSSIIGGGVKAPRIKTKNLVSIIFCEAVAIYGIIMAIVISNMAEPFSATDPKAIGHRNYHAGYSMFGAGLTVGLSNLFCGVCVGIVGSGAALADAQNPSLFVKILIVEIFGSAIGLFGVIVAILQTSRVKMGD

SEQ ID NO: 529 - protein, 155 aa, unidentified
MSESKSGPEYASFFAVMGASAAMVFSALGAAYGTAKSGTGIAAMSVMRPEQIMKSIIPVVMAGIIAIYGLVVAVLIANSLNDDISLYKSFLQLGAGLSVGLSGLAAGFAIGIVGDAGVRGTAQQPRLFVGMILILIFAEVLGLYGLIVALILSTK

SEQ ID NO: 530 - protein, 81 aa, unidentified [sequence omitted]

SEQ ID NO: 531 - protein, 81 aa, unidentified
MTAHSFALPVIIFTTFWGLVGIAGPWFVPKGPNRGVIITMLVATAVCCYLFWLIAILAQLNPLFGPQLKNETIWYVRFLWE

SEQ ID NO: 532 - protein, 1500 aa, unidentified
MDPSMGVNSVTISVEGMTCNSCVWTIEQQIGKVNGVHHIKVSLEEKNATIIYDPKLQTPKTLQEAIDDMGFDAVIHNPDPLPVLTDTLFLTVTASLTLPWDHIQSTLLKTKGVTDIKIYPQKRTVAVTIIPSIVNANQIKELVPELSLDTGTLEKKSGACEDHSMAQAGEVVLKMKVEGMTCHSCTSTIEGKIGKLQGVQRIKVSLDNQEATIVYQPHLISVEEMKKQIEAMGFPAFVKKQPKYLKLGAIDVERLKNTPVKSSEGSQQRSPSYTNDSTATFIIDGMHCKSCVSNIESTLSALQYVSSIVVSLENRSAIVKYNASSVTPESLRKAIEAVSPGLYRVSITSEVESTSNSPSSSSLQKIPLNVVSQPLTQETVINIDGMTCNSCVQSIEGVISKKPGVKSIRVSLANSNGTVEYDPLLTSPETLRGAIEDMGFDATLSDTNEPLVVIAQPSSEMPLLTSTNEFYTKGMTPVQDKEEGKNSSKCYIQVTGMTCASCVANIERNLRREEGIYSILVALMAGKAEVRYNPAVIQPPMIAEFIRELGFGATVIENADEGDGVLELVVRGMTCASCVHKIESSLTKHRGILYCSVALATNKAHIKYDPEIIGPRDIIHTIESLGFEASLVKKDRSASHLDHKREIRQWRRSFLVSLFFCIPVMGLMIYMMVMDHHFATLHHNQNMSKEEMINLHSSMFLERQILPGLSVMNLLSFLLCVPVQFFGGWYFYIQAYKALKHKTANMDVLIVLATTIAFAYSLIILLVAMYERAKVNPITFFDTPPMLFVFIALGRWLEHIAKGKTSEALAKLISLQATEATIVTLDSDNILLSEEQVDVELVQRGDIIKVVPGGKFPVDGRVIEGHSMVDESLITGEAMPVAKKPGSTVIAGSINQNGSLLICATHVGADTTLSQIVKLVEEAQTSKAPIQQFADKLSGYFVPFIVFVSIATLLVWIVIGFLNFEIVETYFPGYNRSISRTETIIRFAFQASITVLCIACPCSLGLATPTAVMVGTGVGAQNGILIKGGEPLEMAHKVKVVVFDKTGTITHGTPVVNQVKVLTESNRISHHKILAIVGTAESNSEHPLGTAITKYCKQELDTETLGTCIDFQVVPGCGISCKVTNIEGLLHKNNWNIEDNNIKNASLVQIDASNEQSSTSSSMIIDAQISNALNAQQYKVLIGNREWMIRNGLVINNDVNDFMTEHERKGRTAVLVAVDDELCGLIAIADTVKPEAELAIHILKSMGLEVVLMTGDNSKTARSIASQVGITKVFAEVLPSHKVAKVKQLQEEGKRVAMVGDGINDSPALAMANVGIAIGTGTDVAIEAADVVLIRNDLLDVVASIDLSRKTVKRIRINFVFALIYNLVGIPIAAGVFMPIGLVLQPWMGSAAMAASSVSVVLSSLFLKLYRKPTYESYELPARSQIGQKSPSEISVHVGIDDTSRNSPKLGLLDRIVNYSRASINSLLSDKRSLNSVVTSEPDKHSLLVGDFREDDDTAL

SEQ ID NO: 533 - protein, 1465 aa, unidentified
MPEQERQITAREGASRKILSKLSLPTRAWEPAMKKSFAFDNVGYEGGLDGLGPSSQVATSTVRILGMTCQSCVKSIEDRISNLKGIISMKVSLEQGSATVKYVPSVVCLQQVCHQIGDMGFEASIAEGKAASWPSRSLPAQEAVVKLRVEGMTCQSCVSSIEGKVRKLQGVVRVKVSLSNQEAVITYQPYLIQPEDLRDHVNDMGFEAAIKSKVAPLSLGPIDIERLQSTNPKRPLSSANQNFNNSETLGHQGSHVVTLQLRIDGMHCKSCVLNIEENIGQLLGVQSIQVSLENKTAQVKYDPSCTSPVALQRAIEALPPGNFKVSLPDGAEGSGTDHRSSSSHSPGSPPRNQVQGTCSTTLIAIAGMTCASCVHSIEGMISQLEGVQQISVSLAEGTATVLYNPSVISPEELRAAIEDMGFEASVVSESCSTNPLGNHSAGNSMVQTTDGTPTSVQEVAPHTGRLPANHAPDILAKSPQSTRAVAPQKCFLQIKGMTCASCVSNIERNLQKEAGVLSVLVALMAGKAEIKYDPEVIQPLEIAQFIQDLGFEAAVMEDYAGSDGNIELTITGMTCASCVHNIESKLTRTNGITYASVALATSKALVKFDPEIIGPRDIIKIIEEIGFHASLAQRNPNAHHLDHKMEIKQWKKSFLCSLVFGIPVMALMIYMLIPSNEPHQSMVLDHNIIPGLSILNLIFFILCTFVQLLGGWYFYVQAYKSLRHRSANMDVLIVLATSIAYVYSLVILVVAVAEKAERSPVTFFDTPPMLFVFIALGRWLEHLAKSKTSEALAKLMSLQATEATVVTLGEDNLIIREEQVPMELVQRGDIVKVVPGGKFPVDGKVLEGNTMADESLITGEAMPVTKKPGSTVIAGSINAHGSVLIKATHVGNDTTLAQIVKLVEEAQMSKAPIQQLADRFSGYFVPFIIIMSTLTLVVWIVIGFIDFGVVQRYFPNPNKHISQTEVIIRFAFQTSITVLCIACPCSLGLATPTAVMVGTGVAAQNGILIKGGKPLEMAHKIKTVMFDKTGTITHGVPRVMRVLLLGDVATLPLRKVLAVVGTAEASSEHPLGVAVTKYCKEELGTETLGYCTDFQAVPGCGIGCKVSNVEGILAHSERPLSAPASHLNEAGSLPAEKDAVPQTFSVLIGNREWLRRNGLTISSDVSDAMTDHEMKGQTAILVAIDGVLCGMIAIADAVKQEAALAVHTLQSMGVDVVLITGDNRKTARAIATQVGINKVFAEVLPSHKVAKVQELQNKGKKVAMVGDGVNDSPALAQADMGVAIGTGTDVAIEAADVVLIRNDLLDVVASIHLSKRTVRRIRINLVLALIYNLVGIPIAAGVFMPIGIVLQPWMGSAAMAASSVSVVLSSLQLKCYKKPDLERYEAQAHGHMKPLTASQVSVHIGMDDRWRDSPRATPWDQVSYVSQVSLSSLTSDKPSRHSAAADDDGDKWSLLLNGRDEEQYI

SEQ ID NO: 534 - protein, 1164 aa, unidentified
MPTMRRTVSEIRSRAEGYEKTDDVSEKTSLADQEEVRTIFINQPQLTKFCNNHVSTAKYNIITFLPRFLYSQFRRAANSFFLFIALLQQIPDVSPTGRYTTLVPLLFILAVAAIKEIIEDIKRHKADNAVNKKQTQVLRNGAWEIVHWEKVAVGEIVKVTNGEHLPADLISLSSSEPQAMCYIETSNLDGETNLKIRQGLPATSDIKDVDSLMRISGRIECESPNRHLYDFVGNIRLDGHGTVPLGADQILLRGAQLRNTQWVHGIVVYTGHDTKLMQNSTSPPLKLSNVERITNVQILILFCILIAMSLVCSVGSAIWNRRHSGKDWYLNLNYGGASNFGLNFLTFIILFNNLIPISLLVTLEVVKFTQAYFINWDLDMHYEPTDTAAMARTSNLNEELGQVKYIFSDKTGTLTCNVMQFKKCTIAGVAYGHVPEPEDYGCSPDEWQNSQFGDEKTFSDSSLLENLQNNHPTAPIICEFLTMMAVCHTAVPEREGDKIIYQAASPDEGALVRAAKQLNFVFTGRTPDSVIIDSLGQEERYELLNVLEFTSARKRMSVIVRTPSGKLRLYCKGADTVIYDRLAETSKYKEITLKHLEQFATEGLRTLCFAVAEISESDFQEWRAVYQRASTSVQNRLLKLEESYELIEKNLQLLGATAIEDKLQDQVPETIETLMKADIKIWILTGDKQETAINIGHSCKLLKKNMGMIVINEGSLDGTRETLSRHCTTLGDALRKENDFALIIDGKTLKYALTFGVRQYFLDLALSCKAVICCRVSPLQKSEVVEMVKKQVKVVTLAIGDGANDVSMIQTAHVGVGISGNEGLQAANSSDYSIAQFKYLKNLLMIHGAWNYNRVSKCILYCFYKNIVLYIIEIWFAFVNGFSGQILFERWCIGLYNVMFTAMPPLTLGIFERSCRKENMLKYPELYKTSQNALDFNTKVFWVHCLNGLFHSVILFWFPLKALQYGTAFGNGKTSDYLLLGNFVYTFVVITVCLKAGLETSYWTWFSHIAIWGSIALWVVFFGIYSSLWPAIPMAPDMSGEAAMLFSSGVFWMGLLFIPVASLLLDVVYKVIKRTAFKTLVDEVQELEAKSQDPGAVVLGKSLTERAQLLKNVFKKNHVNLYRSESLQQNLLHGYAFSQDENGIVSQSEVIRAYDTTKQRPDEW

SEQ ID NO: 535 - protein, 1188 aa, unidentified
MLNGAGLDKALKMSLPRRSRIRSSVGPVRSSLGYKKAEDEMSRATSVGDQLEAPARTIYLNQPHLNKFRDNQISTAKYSVLTFLPRFLYEQIRRAANAFFLFIALLQQIPDVSPTGRYTTLVPLIIILTIAGIKEIVEDFKRHKADNAVNKKKTIVLRNGMWHTIMWKEVAVGDIVKVVNGQYLPADVVLLSSSEPQAMCYVETANLDGETNLKIRQGLSHTADMQTREVLMKLSGTIECEGPNRHLYDFTGNLNLDGKSLVALGPDQILLRGTQLRNTQWVFGIVVYTGHDTKLMQNSTKAPLKRSNVEKVTNVQILVLFGILLVMALVSSAGALYWNRSHGEKNWYIKKMDTTSDNFGYNLLTFIILYNNLIPISLLVTLEVVKYTQALFINWDTDMYYIGNDTPAMARTSNLNEELGQVKYLFSDKTGTLTCNIMNFKKCSIAGVTYGHFPELAREPSSDDFCRMPPPCSDSCDFDDPRLLKNIEDRHPTAPCIQEFLTLLAVCHTVVPEKDGDNIIYQASSPDEAALVKGAKKLGFVFTARTPFSVIIEAMGQEQTFGILNVLEFSSDRKRMSVIVRTPSGRLRLYCKGADNVIFERLSKDSKYMEETLCHLEYFATEGLRTLCVAYADLSENEYEEWLKVYQEASTILKDRAQRLEECYEIIEKNLLLLGATAIEDRLQAGVPETIATLLKAEIKIWVLTGDKQETAINIGYSCRLVSQNMALILLKEDSLDATRAAITQHCTDLGNLLGKENDVALIIDGHTLKYALSFEVRRSFLDLALSCKAVICCRVSPLQKSEIVDVVKKRVKAITLAIGDGANDVGMIQTAHVGVGISGNEGMQATNNSDYAIAQFSYLEKLLLVHGAWSYNRVTKCILYCFYKNVVLYIIELWFAFVNGFSGQILFERWCIGLYNVIFTALPPFTLGIFERSCTQESMLRFPQLYKITQNGEGFNTKVFWGHCINALVHSLILFWFPMKALEHDTVLTSGHATDYLFVGNIVYTYVVVTVCLKAGLETTAWTKFSHLAVWGSMLTWLVFFGIYSTIWPTIPIAPDMRGQATMVLSSAHFWLGLFLVPTACLIEDVAWRAAKHTCKKTLLEEVQELETKSRVLGKAVLRDSNGKRLNERDRLIKRLGRKTPPTLFRGSSLQQGVPHGYAFSQEEHGAVSQEEVIRAYDTTKKKSRKK

SEQ ID NO: 536 - protein, 1251 aa, unidentified
MSTERDSETTFDEDSQPNDEVVPYSDDETEDELDDQGSAVEPEQNRVNREAEENREPFRKECTWQVKANDRKYHEQPHFMNTKFLCIKESKYANNAIKTYKYNAFTFIPMNLFEQFKRAANLYFLALLILQAVPQISTLAWYTTLVPLLVVLGVTAIKDLVDDVARHKMDKEINNRTCEVIKDGRFKVAKWKEIQVGDVIRLKKNDFVPADILLLSSSEPNSLCYVETAELDGETNLKFKMSLEITDQYLQREDTLATFDGFIECEEPNNRLDKFTGTLFWRNTSFPLDADKILLRGCVIRNTDFCHGLVIFAGADTKIMKNSGKTRFKRTKIDYLMNYMVYTIFVVLILLSAGLAIGHAYWEAQVGNSSWYLYDGEDDTPSYRGFLIFWGYIIVLNTMVPISLYVSVEVIRLGQSHFINWDLQMYYAEKDTPAKARTTTLNEQLGQIHYIFSDKTGTLTQNIMTFKKCCINGQIYGDHRDASQHNHNKIEQVDFSWNTYADGKLAFYDHYLIEQIQSGKEPEVRQFFFLLAVCHTVMVDRTDGQLNYQAASPDEGALVNAARNFGFAFLARTQNTITISELGTERTYNVLAILDFNSDRKRMSIIVRTPEGNIKLYCKGADTVIYERLHRMNPTKQETQDALDIFANETLRTLCLCYKEIEEKEFTEWNKKFMAASVASTNRDEALDKVYEEIEKDLILLGATAIEDKLQDGVPETISKLAKADIKIWVLTGDKKETAENIGFACELLTEDTTICYGEDINSLLHARMENQRNRGGVYAKFAPPVQESFFPPGGNRALIITGSWLNEILLEKKTKRNKILKLKFPRTEEERRMRTQSKRRLEAKKEQRQKNFVDLACECSAVICCRVTPKQKAMVVDLVKRYKKAITLAIGDGANDVNMIKTAHIGVGISGQEGMQAVMSSDYSFAQFRYLQRLLLVHGRWSYIRMCKFLRYFFYKNFAFTLVHFWYSFFNGYSAQTAYEDWFITLYNVLYTSLPVLLMGLLDQDVSDKLSLRFPGLYIVGQRDLLFNYKRFFVSLLHGVLTSMILFFIPLGAYLQTVGQDGEAPSDYQSFAVTIASALVITVNFQIGLDTSYWTFVNAFSIFGSIALYFGIMFDFHSAGIHVLFPSAFQFTGTASNALRQPYIWLTIILAVAVCLLPVVAIRFLSMTIWPSESDKIQKHRKRLKAEEQWQRRQQVFRRGVSTRRSAYAFSHQRGYADLISSGRSIRKKRSPLDAIVADGTAEYRRTGDS

SEQ ID NO: 537 - protein, 1209 aa, unidentified
MTVPKEMPEKWARAQAPPSWSRKKPSWGTEEERRARANDREYNEKFQYASNCIKTSKYNILTFLPVNLFEQFQEVANTYFLFLLILQLIPQISSLSWFTTIVPLVLVLTITAVKDATDDYFRHKSDNQVNNRQSQVLINGILQQEQWMNVCVGDIIKLENNQFVAADLLLLSSSEPHGLCYIETAELDGETNMKVRQAIPVTSELGDISKLAKFDGEVICEPPNNKLDKFSGTLYWKENKFPLSNQNMLLRGCVLRNTEWCFGLVIFAGPDTKLMQNSGRTKFKRTSIDRLMNTLVLWIFGFLVCMGVILAIGNAIWEHEVGMRFQVYLPWDEAVDSAFFSGFLSFWSYIIILNTVVPISLYVSVEVIRLGHSYFINWDKKMFCMKKRTPAEARTTTLNEELGQVEYIFSDKTGTLTQNIMVFNKCSINGHSYGDVFDVLGHKAELGERPEPVDFSFNPLADKKFLFWDPSLLEAVKIGDPHTHEFFRLLSLCHTVMSEEKNEGELYYKAQSPDEGALVTAARNFGFVFRSRTPKTITVHEMGTAITYQLLAILDFNNIRKRMSVIVRNPEGKIRLYCKGADTILLDRLHHSTQELLNTTMDHLNEYAGEGLRTLVLAYKDLDEEYYEEWAERRLQASLAQDSREDRLASIYEEVENNMMLLGATAIEDKLQQGVPETIALLTLANIKIWVLTGDKQETAVNIGYSCKMLTDDMTEVFIVTGHTVLEVREELRKAREKMMDSSRSVGNGFTYQDKLSSSKLTSVLEAVAGEYALVINGHSLAHALEADMELEFLETACACKAVICCRVTPLQKAQVVELVKKYKKAVTLAIGDGANDVSMIKTAHIGVGISGQEGIQAVLASDYSFSQFKFLQRLLLVHGRWSYLRMCKFLCYFFYKNFAFTMVHFWFGFFCGFSAQTVYDQYFITLYNIVYTSLPVLAMGVFDQDVPEQRSMEYPKLYEPGQLNLLFNKREFFICIAQGIYTSVLMFFIPYGVFADATRDDGTQLADYQSFAVTVATSLVIVVSVQIGLDTGYWTAINHFFIWGSLAVYFAILFAMHSNGLFDMFPNQFRFVGNAQNTLAQPTVWLTIVLTTVVCIMPVVAFRFLRLNLKPDLSDTVRYTQLVRKKQKAQHRCMRRVGRTGSRRSGYAFSHQEGFGELIMSGKNMRLSSLALSSFTTRSSSSWIESLRRKKSDSASSPSGGADKPLKG

SEQ ID NO: 538 - protein, 1300 aa, unidentified
MGTGPAQTPRSTRAGPEPSPAPPGPGDTGDSDVTQEGSGPAGIRGGETVIRAGMGDSPGRGAPERRHKAQPGRARKYEWRPEGPTSMGSLGQREDLQDEDRNSAFTWKVQANNRAYNGQFKEKVILCWQRKKYKTNVIRTAKYNFYSFLPLNLYEQFHRVSNLFFLIIIILQSIPDISTLPWFSLSTPMVCLLFIRATRDLVDDMGRHKSDRAINNRPCQILMGKSFKQKKWQDLCVGDVVCLRKDNIVPADMLLLASTEPSSLCYVETVDIDGETNLKFRQALMVTHKELATIKKMASFQGTVTCEAPNSRMHHFVGCLEWNDKKYSLDIGNLLLRGCRIRNTDTCYGLVIYAGFDTKIMKNCGKIHLKRTKLDLLMNKLVVVIFISVVLVCLVLAFGFGFSVKEFKDHHYYLSGVHGSSVAAESFFVFWSFLILLSVTIPMSMFILSEFIYLGNSVFIDWDVQMYYKPQDVPAKARSTSLNDHLGQVEYIFSDKTGTLTQNILTFNKCCISGRVYGPDSEATTRPKENPYLWNKFADGKLLFHNAALLHLVRTNGDEAVREFWRLLAICHTVMVRESPRERPDQLLYQAASPDEGALVTAARNFGYVFLSRTQDTVTIMELGEERVYQVLAIMDFNSTRKRMSVLVRKPEGAICLYTKGADTVIFERLHRRGAMEFATEEALAAFAQETLRTLCLAYREVAEDIYEDWQQRHQEASLLLQNRAQALQQLLGATAIEDRLQDGVPETIKCLKKSNIKIWVLTGDKQETAVNIGFACELLSENMLILEEKEISRILETYWENSNNLLTRESLSQVKLALVINGDFLDKLLVSLRKEPRALAQNVNMDEAWQELGQSRRDFLYARRLSLLCRRFGLPLAAPPAQDSRARRSSEVLQERAFVDLASKCQAVICCRVTPKQKALIVALVKKYHQVVTLAIGDGANDINMIKTADVGVGLAGQEGMQAVQNSDFVLGQFCFLQRLLLVHGRWSYVRICKFLRYFFYKSMASMMVQVWFACYNGFTGQPLYEGWFLALFNLLYSTLPVLYIGLFEQDVSAEQSLEKPELYVVGQKDELFNYWVFVQAIAHGVTTSLVNFFMTLWISRDTAGPASFSDHQSFAVVVALSCLLSITMEVILIIKYWTALCVATILLSLGFYAIMTTTTQSFWLFRVSPTTFPFLYADLSVMSSPSILLVVLLSVSINTFPVLALRVIFPALKELRAKEEKVEEGPSEEIFTMEPLPHVHRESRARRSSYAFSHREGYANLITQGTILRRGPGVSSDIASESLDPSDEEAASSPKESQ

SEQ ID NO: 539 - protein, 1192 aa, unidentified
MFCSEKKLREVERIVKANDREYNEKFQYADNRIHTSKYNILTFLPINLFEQFQRVANAYFLCLLILQLIPEISSLTWFTTIVPLVLVITMTAVKDATDDYFRHKSDNQVNNRQSEVLINSKLQNEKWMNVKVGDIIKLENNQFVAADLLLLSSSEPHGLCYVETAELDGETNLKVRHALSVTSELGADISRLAGFDGIVVCEVPNNKLDKFMGILSWKDSKHSLNNEKIILRGCILRNTSWCFGMVIFAGPDTKLMQNSGKTKFKRTSIDRLMNTLVLWIFGFLICLGIILAIGNSIWESQTGDQFRTFLFWNEGEKSSVFSGFLTFWSYIIILNTVVPISLYVSVEVIRLGHSYFINWDRKMYYSRKAIPAVARTTTLNEELGQIEYIFSDKTGTLTQNIMTFKRCSINGRIYGEVHDDLDQKTEITQEKEPVDFSVKSQADREFQFFDHHLMESIKMGDPKVHEFLRLLALCHTVMSEENSAGELIYQVQSPDEGALVTAARNFGFIFKSRTPETITIEELGTLVTYQLLAFLDFNNTRKRMSVIVRNPEGQIKLYSKGADTILFEKLHPSNEVLLSLTSDHLSEFAGEGLRTLAIAYRDLDDKYFKEWHKMLEDANAATEERDERIAGLYEEIERDLMLLGATAVEDKLQEGVIETVTSLSLANIKIWVLTGDKQETAINIGYACNMLTDDMNDVFVIAGNNAVEVREELRKAKQNLFGQNRNFSNGHVVCEKKQQLELDSIVEETITGDYALIINGHSLAHALESDVKNDLLELACMCKTVICCRVTPLQKAQVVELVKKYRNAVTLAIGDGANDVSMIKSAHIGVGISGQEGLQAVLASDYSFAQFRYLQRLLLVHGRWSYFRMCKFLCYFFYKNFAFTLVHFWFGFFCGFSAQTVYDQWFITLFNIVYTSLPVLAMGIFDQDVSDQNSVDCPQLYKPGQLNLLFNKRKFFICVLHGIYTSLVLFFIPYGAFYNVAGEDGQHIADYQSFAVTMATSLVIVVSVQIALDTSYWTFINHVFIWGSIAIYFSILFTMHSNGIFGIFPNQFPFVGNARHSLTQKCIWLVILLTTVASVMPVVAFRFLKVDLYPTLSDQIRRWQKAQKKARPPSSRRPRTRRSSSRRSGYAFAHQEGYGELITSGKNMRAKNPPPTSGLEKTHYNSTSWIENLCKKTTDTVSSFSQDKTVKL

SEQ ID NO: 540 - protein, 1047 aa, unidentified
MTDNIPLQPVRQKKRMDSRPRAGCCEWLRCCGGGEARPRTVWLGHPEKRDQRYPRNVINNQKYNFFTFLPGVLFNQFKYFFNLYFLLLACSQFVPEMRLGALYTYWVPLGFVLAVTVIREAVEEIRCYVRDKEVNSQVYSRLTARGTVKVKSSNIQVGDLIIVEKNQRVPADMIFLRTSEKNGSCFLRTDQLDGETDWKLRLPVACTQRLPTAADLLQIRSYVYAEEPNIDIHNFVGTFTREDSDPPISESLSIENTLWAGTVVASGTVVGVVLYTGRELRSVMNTSNPRSKIGLFDLEVNCLTKILFGALVVVSLVMVALQHFAGRWYLQIIRFLLLFSNIIPISLRVNLDMGKIVYSWVIRRDSKIPGTVVRSSTIPEQLGRISYLLTDKTGTLTQNEMIFKRLHLGTVAYGLDSMDEVQSHIFSIYTQQSQDPPAQKGPTLTTKVRRTMSSRVHEAVKAIALCHNVTPVYESNGVTDQAEAEKQYEDSCRVYQASSPDEVALVQWTESVGLTLVGRDQSSMQLRTPGDQILNFTILQIFPFTYESKRMGIIVRDESTGEITFYMKGADVVMAGIVQYNDWLEEECGNMAREGLRVLVVAKKSLAEEQYQDFEARYVQAKLSVHDRSLKVATVIESLEMEMELLCLTGVEDQLQADVRPTLETLRNAGIKVWMLTGDKLETATCTAKNAHLVTRNQDIHVFRLVTNRGEAHLELNAFRRKHDCALVISGDSLEVCLKYYEYEFMELACQCPAVVCCRCAPTQKAQIVRLLQERTGKLTCAVGDGGNDVSMIQESDCGVGVEGKEGKQASLAADFSITQFKHLGRLLMVHGRNSYKRSAALSQFVIHRSLCISTMQAVFSSVFYFASVPLYQGFLIIGYSTIYTMFPVFSLVLDKDVKSEVAMLYPELYKDLLKGRPLSYKTFLIWVLISIYQGSTIMYGALLLFESEFVHIVAISFTSLILTELLMVALTIQTWHWLMTVAELLSLACYIASLVFLHEFIDVYFIATLSFLWKVSVITLVSCLPLYVLKYLRRRFSPPSYSKLTS

SEQ ID NO: 541 - protein, 1147 aa, unidentified
MADQIPLYPVRSAAAAAANRKRAAYYSAAGPRPGADRHSRYQLEDESAHLDEMPLMMSEEGFENEESDYHTLPRARIMQRKRGLEWFVCDGWKFLCTSCCGWLINICRRKKELKARTVWLGCPEKCEEKHPRNSIKNQKYNVFTFIPGVLYEQFKFFLNLYFLVISCSQFVPALKIGYLYTYWAPLGFVLAVTMTREAIDEFRRFQRDKEVNSQLYSKLTVRGKVQVKSSDIQVGDLIIVEKNQRIPSDMVFLRTSEKAGSCFIRTDQLDGETDWKLKVAVSCTQQLPALGDLFSISAYVYAQKPQMDIHSFEGTFTREDSDPPIHESLSIENTLWASTIVASGTVIGVVIYTGKETRSVMNTSNPKNKVGLLDLELNRLTKALFLALVALSIVMVTLQGFVGPWYRNLFRFLLLFSYIIPISLRVNLDMGKAVYGWMMMKDENIPGTVVRTSTIPEELGRLVYLLTDKTGTLTQNEMIFKRLHLGTVSYGADTMDEIQSHVRDSYSQMQSQAGGNNTGSTPLRKAQSSAPKVRKSVSSRIHEAVKAIVLCHNVTPVYESRAGVTEETEFAEADQDFSDENRTYQASSPDEVALVQWTESVGLTLVSRDLTSMQLKTPSGQVLSFCILQLFPFTSESKRMGVIVRDESTAEITFYMKGADVAMSPIVQYNDWLEEECGNMAREGLRTLVVAKKALTEEQYQDFESRYTQAKLSMHDRSLKVAAVVESLEREMELLCLTGVEDQLQADVRPTLEMLRNAGIKIWMLTGDKLETATCIAKSSHLVSRTQDIHIFRQVTSRGEAHLELNAFRRKHDCALVISGDSLEVCLKYYEHEFVELACQCPAVVCCRCSPTQKARIVTLLQQHTGRRTCAIGDGGNDVSMIQAADCGIGIEGKEGKQASLAADFSITQFRHIGRLLMVHGRNSYKRSAALGQFVMHRGLIISTMQAVFSSVFYFASVPLYQGFLMVGYATIYTMFPVFSLVLDQDVKPEMAMLYPELYKDLTKGRSLSFKTFLIWVLISIYQGGILMYGALVLFESEFVHVVAISFTALILTELLMVALTVRTWHWLMVVAEFLSLGCYVSSLAFLNEYFGIGRVSFGAFLDVAFITTVTFLWKVSAITVVSCLPLYVLKYLRRKLSPPSYCKLAS

SEQ ID NO: 542 - protein, 2644 aa, unidentified
MGEHGLELASMIPALRELGSATPEEYNTVVQKPRQILCQFIDRILTDVNVVAVELVKKTDSQPTSVMLLDFIQHIMKSSPLMFVNVSGSHEAKGSCIEFSNWIITRLLRIAATPSCHLLHKKICEVICSLLFLFKSKSPAIFGVLTKELLQLFEDLVYLHRRNVMGHAVEWPVVMSRFLSQLDEHMGYLQSAPLQLMSMQNLEFIEVTLLMVLTRIIAIVFFRRQELLLWQIGCVLLEYGSPKIKSLAISFLTELFQLGGLPAQPASTFFSSFLELLKHLVEMDTDQLKLYEEPLSKLIKTLFPFEAEAYRNIEPVYLNMLLEKLCVMFEDGVLMRLKSDLLKAALCHLLQYFLKFVPAGYESALQVRKVYVRNICKALLDVLGIEVDAEYLLGPLYAALKMESMEIIEEIQCQTQQENLSSNSDGISPKRRRLSSSLNPSKRAPKQTEEIKHVDMNQKSILWSALKQKAESLQISLEYSGLKNPVIEMLEGIAVVLQLTALCTVHCSHQNMNCRTFKDCQHKSKKKPSVVITWMSLDFYTKVLKSCRSLLESVQKLDLEATIDKVVKIYDALIYMQVNSSFEDHILEDLCGMLSLPWIYSHSDDGCLKLTTFAANLLTLSCRISDSYSPQAQSRCVFLLTLFPRRIFLEWRTAVYNWALQSSHEVIRASCVSGFFILLQQQNSCNRVPKILIDKVKDDSDIVKKEFASILGQLVCTLHGMFYLTSSLTEPFSEHGHVDLFCRNLKATSQHECSSSQLKASVCKPFLFLLKKKIPSPVKLAFIDNLHHLCKHLDFREDETDVKAVLGTLLNLMEDPDKDVRVAFSGNIKHILESLDSEDGFIKELFVLRMKEAYTHAQISRNNELKDTLILTTGDIGRAAKGDLVPFALLHLLHCLLSKSASVSGAAYTEIRALVAAKSVKLQSFFSQYKKPICQFLVESLHSSQMTALPNTPCQNADVRKQDVAHQREMALNTLSEIANVFDFPDLNRFLTRTLQVLLPDLAAKASPAASALIRTLGKQLNVNRREILINNFKYIFSHLVCSCSKDELERALHYLKNETEIELGSLLRQDFQGLHNELLLRIGEHYQQVFNGLSILASFASSDDPYQGPRDIISPELMADYLQPKLLGILAFFNMQLLSSSVGIEDKKMALNSLMSLMKLMGPKHVSSVRVKMMTTLRTGLRFKDDFPELCCRAWDCFVRCLDHACLGSLLSHVIVALLPLIHIQPKETAAIFHYLIIENRDAVQDFLHEIYFLPDHPELKKIKAVLQEYRKETSESTDLQTTLQLSMKAIQHENVDVRIHALTSLKETLYKNQEKLIKYATDSETVEPIISQLVTVLLKGCQDANSQARLLCGECLGELGAIDPGRLDFSTTETQGKDFTFVTGVEDSSFAYGLLMELTRAYLAYADNSRAQDSAAYAIQELLSIYDCREMETNGPGHQLWRRFPEHVREILEPHLNTRYKSSQKSTDWSGVKKPIYLSKLGSNFAEWSASWAGYLITKVRHDLASKIFTCCSIMMKHDFKVTIYLLPHILVYVLLGCNQEDQQEVYAEIMAVLKHDDQHTINTQDIASDLCQLSTQTVFSMLDHLTQWARHKFQALKAEKCPHSKSNRNKVDSMVSTVDYEDYQSVTRFLDLIPQDTLAVASFRSKAYTRAVMHFESFITEKKQNIQEHLGFLQKLYAAMHEPDGVAGVSAIRKAEPSLKEQILEHESLGLLRDATACYDRAIQLEPDQIIHYHGVVKSMLGLGQLSTVITQVNGVHANRSEWTDELNTYRVEAAWKLSQWDLVENYLAADGKSTTWSVRLGQLLLSAKKRDITAFYDSLKLVRAEQIVPLSAASFERGSYQRGYEYIVRLHMLCELEHSIKPLFQHSPGDSSQEDSLNWVARLEMTQNSYRAKEPILALRRALLSLNKRPDYNEMVGECWLQSARVARKAGHHQTAYNALLNAGESRLAELYVERAKWLWSKGDVHQALIVLQKGVELCFPENETPPEGKNMLIHGRAMLLVGRFMEETANFESNAIMKKYKDVTACLPEWEDGHFYLAKYYDKLMPMVTDNKMEKQGDLIRYIVLHFGRSLQYGNQFIYQSMPRMLTLWLDYGTKAYEWEKAGRSDRVQMRNDLGKINKVITEHTNYLAPYQFLTAFSQLISRICHSHDEVFVVLMEIIAKVFLAYPQQAMWMMTAVSKSSYPMRVNRCKEILNKAIHMKKSLEKFVGDATRLTDKLLELCNKPVDGSSSTLSMSTHFKMLKKLVEEATFSEILIPLQSVMIPTLPSILGTHANHASHEPFPGHWAYIAGFDDMVEILASLQKPKKISLKGSDGKFYIMMCKPKDDLRKDCRLMEFNSLINKCLRKDAESRRRELHIRTYAVIPLNDECGIIEWVNNTAGLRPILTKLYKEKGVYMTGKELRQCMLPKSAALSEKLKVFREFLLPRHPPIFHEWFLRTFPDPTSWYSSRSAYCRSTAVMSMVGYILGLGDRHGENILFDSLTGECVHVDFNCLFNKGETFEVPEIVPFRLTHNMVNGMGPMGTEGLFRRACEVTMRLMRDQREPLMSVLKTFLHDPLVEWSKPVKGHSKAPLNETGEVVNEKAKTHVLDIEQRLQGVIKTRNRVTGLPLSIEGHVHYLIQEATDENLLCQMYLGWTPYM

SEQ ID NO: 543 - protein, 229 aa, unidentified
MAPHDPGSLTTLVPWAAALLLALGVERALALPEICTQCPGSVQNLSKVAFYCKTTRELMLHARCCLNQKGTILGLDLQNCSLEDPGPNFHQAHTTVIIDLQANPLKGDLANTFRGFTQLQTLILPQHVNCPGGINAWNTITSYIDNQICQGQKNLCNNTGDPEMCPENGSCVPDGPGLLQCVCADGFHGYKCMRQGSFSLLMFFGILGATTLSVSILLWATQRRKAKTS

SEQ ID NO: 544 - protein, 1429 aa, unidentified
MVAAAAATEARLRRRTAATAALAGRSGGPHWDWDVTRAGRPGLGAGLRLPRLLSPPLRPRLLLLLLLLSPPLLLLLLPCEAEAAAAAAAVSGSAAAEAKECDRPCVNGGRCNPGTGQCVCPAGWVGEQCQHCGGRFRLTGSSGFVTDGPGNYKYKTKCTWLIEGQPNRIMRLRFNHFATECSWDHLYVYDGDSIYAPLVAAFSGLIVPERDGNETVPEVVATSGYALLHFFSDAAYNLTGFNITYSFDMCPNNCSGRGECKISNSSDTVECECSENWKGEACDIPHCTDNCGFPHRGICNSSDVRGCSCFSDWQGPGCSVPVPANQSFWTREEYSNLKLPRASHKAVVNGNIMWVVGGYMFNHSDYNMVLAYDLASREWLPLNRSVNNVVVRYGHSLALYKDKIYMYGGKIDSTGNVTNELRVFHIHNESWVLLTPKAKEQYAVVGHSAHIVTLKNGRVVMLVIFGHCPLYGYISNVQEYDLDKNTWSILHTQGALVQGGYGHSSVYDHRTRALYVHGGYKAFSANKYRLADDLYRYDVDTQMWTILKDSRFFRYLHTAVIVSGTMLVFGGNTHNDTSMSHGAKCFSSDFMAYDIACDRWSVLPRPDLHHDVNRFGHSAVLHNSTMYVFGGFNSLLLSDILVFTSEQCDAHRSEAACLAAGPGIRCVWNTGSSQCISWALATDEQEEKLKSECFSKRTLDHDRCDQHTDCYSCTANTNDCHWCNDHCVPRNHSCSEGQISIFRYENCPKDNPMYYCNKKTSCRSCALDQNCQWEPRNQECIALPENICGIGWHLVGNSCLKITTAKENYDNAKLFCRNHNALLASLTTQKKVEFVLKQLRIMQSSQSMSKLTLTPWVGLRKINVSYWCWEDMSPFTNSLLQWMPSEPSDAGFCGILSEPSTRGLKAATCINPLNGSVCERPANHSAKQCRTPCALRTACGDCTSGSSECMWCSNMKQCVDSNAYVASFPFGQCMEWYTMSTCPPENCSGYCTCSHCLEQPGCGWCTDPSNTGKGKCIEGSYKGPVKMPSQAPTGNFYPQPLLNSSMCLEDSRYNWSFIHCPACQCNGHSKCINQSICEKCENLTTGKHCETCISGFYGDPTNGGKCQPCKCNGHASLCNTNTGKCFCTTKGVKGDECQLCEVENRYQGNPLRGTCYYTLLIDYQFTFSLSQEDDRYYTAINFVATPDEQNRDLDMFINASKNFNLNITWAASFSAGTQAGEEMPVVSKTNIKEYKDSFSNEKFDFRNHPNITFFVYVSNFTWPIKIQIAFSQHSNFMDLVQFFVTFFSCFLSLLLVAAVVWKIKQSCWASRRREQLLREMQQMASRPFASVNVALETDEEPPDLIGGSIKTVPKPIALEPCFGNKAAVLSVFVRLPRGLGGIPPPGQSGLAVASALVDISQQMPIVYKEKSGAVRNRKQQPPAQPGTCI

SEQ ID NO: 545 - protein, 1379 aa, unidentified
METGGRARTGTPQPAAPGVWRARPAGGGGGGASSWLLDGNSWLLCYGFLYLALYAQVSQSKPCERTGSCFSGRCVNSTCLCDPGWVGDQCQHCQGRFKLTEPSGYLTDGPINYKYKTKCTWLIEGYPNAVLRLRFNHFATECSWDHMYVYDGDSIYAPLIAVLSGLIVPEIRGNETVPEVVTTSGYALLHFFSDAAYNLTGFNIFYSINSCPNNCSGHGKCTTSVSVPSQVYCECDKYWKGEACDIPYCKANCGSPDHGYCDLTGEKLCVCNDSWQGPDCSLNVPSTESYWILPNVKPFSPSVGRASHKAVLHGKFMWVIGGYTFNYSSFQMVLNYNLESSIWNVGTPSRGPLQRYGHSLALYQENIFMYGGRIETNDGNVTDELWVFNIHSQSWSTKTPTVLGHGQQYAVEGHSAHIMELDSRDVVMIIIFGYSAIYGYTSSIQEYHISSNTWLVPETKGAIVQGGYGHTSVYDEITKSIYVHGGYKALPGNKYGLVDDLYKYEVNTKTWTILKESGFARYLHSAVLINGAMLIFGGNTHNDTSLSNGAKCFSADFLAYDIACDEWKILPKPNLHRDVNRFGHSAVVINGSMYIFGGFSSVLLNDILVYKPPNCKAFRDEELCKNAGPGIKCVWNKNHCESWESGNTNNILRAKCPPKTAASDDRCYRYADCASCTANTNGCQWCDDKKCISANSNCSMSVKNYTKCHVRNEQICNKLTSCKSCSLNLNCQWDQRQQECQALPAHLCGEGWSHIGDACLRVNSSRENYDNAKLYCYNLSGNLASLTTSKEVEFVLDEIQKYTQQKVSPWVGLRKINISYWGWEDMSPFTNTTLQWLPGEPNDSGFCAYLERAAVAGLKANPCTSMANGLVCEKPVVSPNQNARPCKKPCSLRTSCSNCTSNGMECMWCSSTKRCVDSNAYIISFPYGQCLEWQTATCSPQNCSGLRTCGQCLEQPGCGWCNDPSNTGRGHCIEGSSRGPMKLIGMHHSEMVLDTNLCPKEKNYEWSFIQCPACQCNGHSTCINNNVCEQCKNLTTGKQCQDCMPGYYGDPTNGGQCTACTCSGHANICHLHTGKCFCTTKGIKGDQCQLCDSENRYVGNPLRGTCYYSLLIDYQFTFSLLQEDDRHHTAINFIANPEQSNKNLDISINASNNFNLNITWSVGSTAGTISGEETSIVSKNNIKEYRDSFSYEKFNFRSNPNITFYVYVSNFSWPIKIQIAFSQHNTIMDLVQFFVTFFSCFLSLLLVAAVVWKIKQTCWASRRREQLLRERQQMASRPFASVDVALEVGAEQTEFLRGPLEGAPKPIAIEPCAGNRAAVLTVFLCLPRGSSGAPPPGQSGLAIASALIDISQQKASDSKDKTSGVRNRKHLSTRQGTCV

SEQ ID NO: 546 - protein, 361 aa, unidentified
MESIFHEKQEGSLCAQHCLNNLLQGEYFSPVELSSIAHQLDEEERMRMAEGGVTSEDYRTFLQQPSGNMDDSGFFSIQVISNALKVWGLELILFNSPEYQRLRIDPINERSFICNYKEHWFTVRKLGKQWFNLNSLLTGPELISDTYLALFLAQLQQEGYSIFVVKGDLPDCEADQLLQMIRVQQMHRPKLIGEELAQLKEQRVHKTDLERVLEANDGSGMLDEDEEDLQRALALSRQEIDMEDEEADLRRAIQLSMQGSSRNISQDMTQTSGTNLTSEELRKRREAYFEKQQQKQQQQQQQQQQGDLSGQSSHPCERPATSSGALGSDLGDAMSEEDMLQAAVTMSLETVRNDLKTEGKK

SEQ ID NO: 547 - protein, 410 aa, unidentified
MELPSGPGPERLFDSHRLPGDCFLLLVLLLYAPVGFCLLVLRLFLGIHVFLVSCALPDSVLRRFVVRTMCAVLGLVARQEDSGLRDHSVRVLISNHVTPFDHNIVNLLTTCSTPLLNSPPSFVCWSRGFMEMNGRGELVESLKRFCASTRLPPTPLLLFPEEEATNGREGLLRFSSWPFSIQDVVQPLTLQVQRPLVSVTVSDASWVSELLWSLFVPFTVYQVRWLRPVHRQLGEANEEFALRVQQLVAKELGQTGTRLTPADKAEHMKRQRHPRLRPQSAQSSFPPSPGPSPDVQLATLAQRVKEVLPHVPLGVIQRDLAKTGCVDLTITNLLEGAVAFMPEDITKGTQSLPTASASKFPSSGPVTPQPTALTFAKSSWARQESLQERKQALYEYARRRFTERRAQEAD

SEQ ID NO: 548 - protein, 648 aa, unidentified
MEKARRGGDGVPRGPVLHIVVVGFHHKKGCQVEFSYPPLIPGDGHDSHTLPEEWKYLPFLALPDGAHNYQEDTVFFHLPPRNGNGATVFGISCYRQIEAKALKVRQADITRETVQKSVCVLSKLPLYGLLQAKLQLITHAYFEEKDFSQISILKELYEHMNSSLGGASLEGSQVYLGLSPRDLVLHFRHKVLILFKLILLEKKVLFYISPVNKLVGALMTVLSLFPGMIEHGLSDCSQYRPRKSMSEDGGLQESNPCADDFVSASTADVSHTNLGTIRKVMAGNHGEDAAMKTEEPLFQVEDSSKGQEPNDTNQYLKPPSRPSPDSSESDWETLDPSVLEDPNLKEREQLGSDQTNLFPKDSVPSESLPITVQPQANTGQVVLIPGLISGLEEDQYGMPLAIFTKGYLCLPYMALQQHHLLSDVTVRGFVAGATNILFRQQKHLSDAIVEVEEALIQIHDPELRKLLNPTTADLRFADYLVRHVTENRDDVFLDGTGWEGGDEWIRAQFAVYIHALLAATLQLDNEKILSDYGTTFVTAWKNTHNYRVWNSNKHPALAEINPNHPFQGQYSVSDMKLRFSHSVQNSERGKKIGNVMVTTSRNVVQTGKAVGQSVGGAFSSAKTAMSSWLSTFTTSTSQSLTEPPDEKP

SEQ ID NO: 549 - protein, 418 aa, unidentified
MRLSAGPDAGPSGNSSPWWPLATGAGNTSREAEALGEGNGPPRDVRNEELAKLEIAVLAVTFAVAVLGNSSVLLALHRTPRKTSRMHLFIRHLSLADLAVAFFQVLPQMCWDITYRFRGPDWLCRVVKHLQVFGMFASAYMLVVMTADRYIAVCHPLKTLQQPARRSRLMIAAAWVLSFVLSTPQYFVFSMIEVNNVTKARDCWATFIQPWGSRAYVTWMTGGIFVAPVVILGTCYGFICYNIWCNVRGKTASRQSKGAEQAGVAFQKGFLLAPCVSSVKSISRAKIRTVKMTFVIVTAYIVCWAPFFIIQMWSVWDPMSVWTESENPTITITALLGSLNSCCNPWIYMFFSGHLLQDCVQSFPCCQNMKEKFNKEDTDSMSRRQTFYSNNRSPTNSTGMWKDSPKSSKSIKFIPVST

SEQ ID NO: 550 - protein, 424 aa, unidentified
MDSGPLWDANPTPRGTLSAPNATTPWLGRDEELAKVEIGVLATVLVLATGGNLAVLLTLGQLGRKRSRMHLFVLHLALTDLAVALFQVLPQLLWDITYRFQGPDLLCRAVKYLQVLSMFASTYMLLAMTLDRYLAVCHPLRSLQQPGQSTYLLIAAPWLLAAIFSLPQVFIFSLREVIQGSGVLDCWADFGFPWGPRAYLTWTTLAIFVLPVTMLTACYSLICHEICKNLKVKTQAWRVGGGGWRTWDRPSPSTLAATTRGLPSRVSSINTISRAKIRTVKMTFVIVLAYIACWAPFFSVQMWSVWDKNAPDEDSTNVAFTISMLLGNLNSCCNPWIYMGFNSHLLPRPLRHLACCGGPQPRMRRRLSDGSLSSRHTTLLTRSSCPATLSLSLSLTLSGRPRPEESPRDLELADGEGTAETIIF

SEQ ID NO: 551 - protein, 371 aa, unidentified
MLMASTTSAVPGHPSLPSLPSNSSQERPLDTRDPLLARAELALLSIVFVAVALSNGLVLAALARRGRRGHWAPIHVFIGHLCLADLAVALFQVLPQLAWKATDRFRGPDALCRAVKYLQMVGMYASSYMILAMTLDRHRAICRPMLAYRHGSGAHWNRPVLVAWAFSLLLSLPQLFIFAQRNVEGGSGVTDCWACFAEPWGRRTYVTWIALMVFVAPTLGIAACQVLIFREIHASLVPGPSERPGGRRRGRRTGSPGEGAHVSAAVAKTVRMTLVIVVVYVLCWAPFFLVQLWAAWDPEAPLEGAPFVLLMLLASLNSCTNPWIYASFSSSVSSELRSLLCCARGRTPPSLGPQDESCTTASSSLAKDTSS

SEQ ID NO: 552 - protein, 328 aa, unidentified
MAHSKQPSHFQSLMLLQWPLSYLAIFWILQPLFVYLLFTSLWPLPVLYFAWLFLDWKTPERGGRRSAWVRNWCVWTHIRDYFPITILKTKDLSPEHNYLMGVHPHGLLTFGAFCNFCTEATGFSKTFPGITPHLATLSWFFKIPFVREYLMAKGVCSVSQPAINYLLSHGTGNLVGIVVGGVGEALQSVPNTTTLILQKRKGFVRTALQHGAHLVPTFTFGETEVYDQVLFHKDSRMYKFQSCFRRIFGFYCCVFYGQSFCQGSTGLLPYSRPIVTVVGEPLPLPQIEKPSQEMVDKYHALYMDALHKLFDQHKTHYGCSETQKLFFL

SEQ ID NO: 553 - protein, 333 aa, unidentified
MLLPSKKDLKTALDVFAVFQWSFSALLITTTVIAVNLYLVVFTPYWPVTVLILTWLAFDWKTPQRGGRRFTCVRHWRLWKHYSDYFPLKLLKTHDICPSRNYILVCHPHGLFAHGWFGHFATEASGFSKIFPGITPYILTLGAFFWMPFLREYVMSTGACSVSRSSIDFLLTHKGTGNMVIVVIGGLAECRYSLPGSSTLVLKNRSGFVRMALQHGVPLIPAYAFGETDLYDQHIFTPGGFVNRFQKWFQSMVHIYPCAFYGRGFTKNSWGLLPYSRPVTTIVGEPLPMPKIENPSQEIVAKYHTLYIDALRKLFDQHKTKFGISETQELEII

SEQ ID NO: 554 - protein, 894 aa, unidentified
MAWRCPRMGRVPLAWCLALCGWACMAPRGTQAEESPFVGNPGNITGARGLTGTLRCQLQVQGEPPEVHWLRDGQILELADSTQTQVPLGEDEQDDWIVVSQLRITSLQLSDTGQYQCLVFLGHQTFVSQPGYVGLEGLPYFLEEPEDRTVAANTPFNLSCQAQGPPEPVDLLWLQDAVPLATAPGHGPQRSLHVPGLNKTSSFSCEAHNAKGVTTSRTATITVLPQQPRNLHLVSRQPTELEVAWTPGLSGIYPLTHCTLQAVLSDDGMGIQAGEPDPPEEPLTSQASVPPHQLRLGSLHPHTPYHIRVACTSSQGPSSWTHWLPVETPEGVPLGPPENISATRNGSQAFVHWQEPRAPLQGTLLGYRLAYQGQDTPEVLMDIGLRQEVTLELQGDGSVSNLTVCVAAYTAAGDGPWSLPVPLEAWRPGQAQPVHQLVKEPSTPAFSWPWWYVLLGAVVAAACVLILALFLVHRRKKETRYGEVFEPTVERGELVVRYRVRKSYSRRTTEATLNSLGISEELKEKLRDVMVDRHKVALGKTLGEGEFGAVMEGQLNQDDSILKVAVKTMKIAICTRSELEDFLSEAVCMKEFDHPNVMRLIGVCFQGSERESFPAPVVILPFMKHGDLHSFLLYSRLGDQPVYLPTQMLVKFMADIASGMEYLSTKRFIHRDLAARNCMLNENMSVCVADFGLSKKIYNGDYYRQGRIAKMPVKWIAIESLADRVYTSKSDVWSFGVTMWEIATRGQTPYPGVENSEIYDYLRQGNRLKQPADCLDGLYALMSRCWELNPQDRPSFTELREDLENTLKALPPAQEPDEILYVNMDEGGGYPEPPGAAGGADPPTQPDPKDSCSCLTAAEVHPAGRYVLCPSTTPSPAQPADRGSPAAPGQEDGA

SEQ ID NO: 555 - protein, 422 aa, unidentified
MLQWRRRHCCFAKMTWNAKRSLFRTHLIGVLSLVFLFAMFLFFNHHDWLPGRAGFKENPVTYTFRGFRSTKSETNHSSLRNIWKETVPQTLRPQTATNSNNTDLSPQGVTGLENTLSANGSIYNEKGTGHPNSYHFKYIINEPEKCQEKSPFLILLIAAEPGQIEARRAIRQTWGNESLAPGIQITRIFLLGLSIKLNGYLQRAILEESRQYHDIIQQEYLDTYYNLTIKTLMGMNWVATYCPHIPYVMKTDSDMFVNTEYLINKLLKPDLPPRHNYFTGYLMRGYAPNRNKDSKWYMPPDLYPSERYPVFCSGTGYVFSGDLAEKIFKVSLGIRRLHLEDVYVGICLAKLRIDPVPPPNEFVFNHWRVSYSSCKYSHLITSHQFQPSELIKYWNHLQQNKHNACANAAKEKAGRYRHRKLH

SEQ ID NO: 556 - protein, 323 aa, unidentified
MKSALFTRFFILLPWILIVIIMLDVDTRRPVPPLTPRPYFSPYAVGRGGARLPLRRGGPAHGTQKRNQSRPQPQPEPQLPTIYAITPTYSRPVQKAELTRLANTFRQVAQLHWILVEDAAARSELVSRFLARAGLPSTHLHVPTPRRYKRPGLPRATEQRNAGLAWLRQRHQHQRAQPGVLFFADDDNTYSLELFQEMRTTRKVSVWPVGLVGGRRYERPLVENGKVVGWYTGWRADRPFAIDMAGFAVSLQVILSNPKAVFKRRGSQPGMQESDFLKQITTVEELEPKANNCTKVLVWHTRTEKVNLANEPKYHLDTVKIEV

SEQ ID NO: 557 - protein, 397 aa, unidentified
MSVGRRRIKLLGILMMANVFIYFIMEVSKSSSQEKNGKGEVIIPKEKFWKISTPPEAYWNREQEKLNRQYNPILSMLTNQTGEAGRLSNISHLNYCEPDLRVTSVVTGFNNLPDRFKDFLLYLRCRNYSLLIDQPDKCAKKPFLLLAIKSLTPHFARRQAIRESWGQESNAGNQTVVRVFLLGQTPPEDNHPDLSDMLKFESEKHQDILMWNYRDTFFNLSLKEVLFLRWVSTSCPDTEFVFKGDDDVFVNTHHILNYLNSLSKTKAKDLFIGDVIHNAGPHRDKKLKYYIPEVVYSGLYPPYAGGGGFLYSGHLALRLYHITDQVHLYPIDDVYTGMCLQKLGLVPEKHKGFRTFDIEEKNKNNICSYVDLMLVHSRKPQEMIDIWSQLQSAHLKC

SEQ ID NO: 558 - protein, 566 aa, unidentified
MGSAGFSVGKFHVEVASRGRECVSGTPECGNRLGSAGFGALCLELRGADPAWGPFAAHGRSRRQGSRFLWLLKILVIILVLGIVGFMFGSMFLQAVFSSPKPELPSPAPGVQKLKLLPEERLRNLFSYDGIWLFPKNQCKCEANKEQGGYNFQDAYGQSDLPAVKARRQAEFEHFQRREGLPRPLPLLVQPNLPFGYPVHGVEVMPLHTVPIPGLQFEGPDAPVYEVTLTASLGTLNTLADVPDSVVQGRGQKQLIISTSDRKLLKFILQHVTYTSTGYQHQKVDIVSLESRSSVAKFPVTIRHPVIPKLYDPGPERKLRNLVTIATKTFLRPHKLMIMLRSIREYYPDLTVIVADDSQKPLEIKDNHVEYYTMPFGKGWFAGRNLAISQVTTKYVLWVDDDFLFNEETKIEVLVDVLEKTELDVVGGSVLGNVFQFKLLLEQSENGACLHKRMGFFQPLDGFPSCVVTSGVVNFFLAHTERLQRVGFDPRLQRVAHSEFFIDGLGTLLVGSCPEVIIGHQSRSPVVDSELAALEKTYNTYRSNTLTRVQFKLALHYFKNHLQCAA

SEQ ID NO: 559 - protein, 398 aa, unidentified
MRLREPLLSGSAAMPGASLQRACRLLVAVCALHLGVTLVYYLAGRDLSRLPQLVGVSTPLQGGSNSAAAIGQSSGELRTGGARPPPPLGASSQPRPGGDSSPVVDSGPGPASNLTSVPVPHTTALSLPACPEESPLLVGPMLIEFNMPVDLELVAKQNPNVKMGGRYAPRDCVSPHKVAIIIPFRNRQEHLKYWLYYLHPVLQRQQLDYGIYVINQAGDTIFNRAKLLNVGFQEALKDYDYTCFVFSDVDLIPMNDHNAYRCFSQPRHISVAMDKFGFSLPYVQYFGGVSALSKQQFLTINGFPNNYWGWGGEDDDIFNRLVFRGMSISRPNAVVGRCRMIRHSRDKKNEPNPQRFDRIAHTKETMLSDGLNSLTYQVLDVQRYPLYTQITVDIGTPS

SEQ ID NO: 560 - protein, 372 aa, unidentified
MSRLLGGTLERVCKAVLLLCLLHFLVAVILYFDVYAQHLAFFSRFSARGPAHALHPAASSSSSSSNCSRPNATASSSGLPEVPSALPGPTAPTLPPCPDSPPGLVGRLLIEFTSPMPLERVQRENPGVLMGGRYTPPDCTPAQTVAVIIPFRHREHHLRYWLHYLHPILRRQRLRYGVYVINQHGEDTFNRAKLLNVGFLEALKEDAAYDCFIFSDVDLVPMDDRNLYRCGDQPRHFAIAMDKFGFRLPYAGYFGGVSGLSKAQFLRINGFPNEYWGWGGEDDDIFNRISLTGMKISRPDIRIGRYRMIKHDRDKHNEPNPQRFTKIQNTKLTMKRDGIGSVRYQVLEVSRQPLFTNITVDIGRPPSWPPRG

SEQ ID NO: 561 - protein, 501 aa, unidentified
MAQALPWLLLWMGAGVLPAHGTQHGIRLPLRSGLGGAPLGLRLPRETDEEPEEPGRRGSFVEMVDNLRGKSGQGYYVEMTVGSPPQTLNILVDTGSSNFAVGAAPHPFLHRYYQRQLSSTYRDLRKGVYVPYTQGKWEGELGTDLVSIPHGPNVTVRANIAAITESDKFFINGSNWEGILGLAYAEIARPDDSLEPFFDSLVKQTHVPNLFSLQLCGAGFPLNQSEVLASVGGSMIIGGIDHSLYTGSLWYTPIRREWYYEVIIVRVEINGQDLKMDCKEYNYDKSIVDSGTTNLRLPKKVFEAAVKSIKAASSTEKFPDGFWLGEQLVCWQAGTTPWNIFPVISLYLMGEVTNQSFRITILPQQYLRPVEDVATSQDDCYKFAISQSSTGTVMGAVIMEGFYVVFDRARKRIGFAVSACHVHDEFRTAAVEGPFVTLDMEDCGYNIPQTDESTLMTIAYVMAAICALFMLPLCLMVCQWRCLRCLRQQHDDFADDISLLK

SEQ ID NO: 562 - protein, 518 aa, unidentified
MGALARALLLPLLAQWLLRAAPELAPAPFTLPLRVAAATNRVVAPTPGPGTPAERHADGLALALEPALASPAGAANFLAMVDNLQGDSGRGYYLEMLIGTPPQKLQILVDTGSSNFAVAGTPHSYIDTYFDTERSSTYRSKGFDVTVKYTQGSWTGFVGEDLVTIPKGFNTSFLVNIATIFESENFFLPGIKWNGILGLAYATLAKPSSSLETFFDSLVTQANIPNVFSMQMCGAGLPVAGSGTNGGSLVLGGIEPSLYKGDIWYTPIKEEWYYQIEILKLEIGGQSLNLDCREYNADKAIVDSGTTLLRLPQKVFDAVVEAVARASLIPEFSDGFWTGSQLACWTNSETPWSYFPKISIYLRDENSSRSFRITILPQLYIQPMMGAGLNYECYRFGISPSTNALVIGATVMEGFYVIFDRAQKRVGFAASPCAEIAGAAVSEISGPFSTEDVASNCVPAQSLSEPILWIVSYALMSVCGAILLVLIVLLLLPFRCQRRPRDPEVVNDESSLVRHRWK

SEQ ID NO: 563 - protein, 211 aa, unidentified
MASGQGPGPPRQECGEPALPSASEEQVAQDTEEVFRSYVFYRHQQEQEAEGVAAPADPEMVTLPLQPSSTMGQVGRQLAIIGDDINRRYDSEFQTMLQHLQPTAENAYEYFTKIATSLFESGINWGRVVALLGFGYRLALHVYQHGLTGFLGQVTRFVVDFMLHHCIARWIAQRGGWVAALNLGNGPILNVLVVLGVVLLGQFVVRRFFKS

SEQ ID NO: 564 - protein, 260 aa, unidentified
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHGKLEFV

SEQ ID NO: 565 - protein, 628 aa, unidentified
MEPPDAPAQARGAPRLLLLAVLLAAHPDAQAEVRLSVPPLVEVMRGKSVILDCTPTGTHDHYMLEWFLTDRSGARPRLASAEMQGSELQVTMHDTRGRSPPYQLDSQGRLVLAEAQVGDERDYVCVVRAGAAGTAEATARLNVFAKPEATEVSPNKGTLSVMEDSAQEIATCNSRNGNPAPKITWYRNGQRLEVPVEMNPEGYMTSRTVREASGLLSLTSTLYLRLRKDDRDASFHCAAHYSLPEGRHGRLDSPTFHLTLHYPTEHVQFWVGSPSTPAGWVREGDTVQLLCRGDGSPSPEYTLFRLQDEQEEVLNVNLEGNLTLEGVTRGQSGTYGCRVEDYDAADDVQLSKTLELRVAYLDPLELSEGKVLSLPLNSSAVVNCSVHGLPTPALRWTKDSTPLGDGPMLSLSSITFDSNGTYVCEASLPTVPVLSRTQNFTLLVQGSPELKTAEIEPKADGSWREGDEVTLICSARGHPDPKLSWSQLGGSPAEPIPGRQGWVSSSLTLKVTSALSRDGISCEASNPHGNKRHVFHFGTVSPQTSQAGVAVMAVAVSVGLLLLVVAVFYCVRRKGGPCCRQRREKGAPPPGEPGLSHSGSEQPEQTGLLMGGASGGARGGSGGFGDEC

SEQ ID NO: 566 - protein, 241 aa, unidentified
MTLQWAAVATFLYAEIGLILIFCLPFIPPQRWQKIFSFNVWGKIATFWNKAFLTIIILLIVLFLDAVREVRKYSSVHTIEKSSTSRPDAYEHTQMKLFRSQRNLYISGFSLFFWLVLRRLVTLITQLAKELSNKGVLKTQAENTNKAAKKFMEENEKLKRILKSHGKDEECVLEAENKKLVEDQEKLKTELRKTSDALSKAQNDVMEMKMQSERLSKEYDQLLKEHSELQDRLERGNKKRL

SEQ ID NO: 567 - protein, 246 aa, unidentified
MSLQWTAVATFLYAEVFVVLLLCIPFISPKRWQKIFKSRLVELLVSYGNTFFVVLIVILVLLVIDAVREIRKYDDVTEKVNLQNNPGAMEHFHMKLFRAQRNLYIAGFSLLLSFLLRRLVTLISQQATLLASNEAFKKQAESASEAAKKYMEENDQLKKGAAVDGGKLDVGNAEVKLEEENRSLKADLQKLKDELASTKQKLEKAENQVLAMRKQSEGLTKEYDRLLEEHAKLQAAVDGPMDKKEE

SEQ ID NO: 568 - protein, 233 aa, unidentified
MSQSNRELVVDFLSYKLSQKGYSWSQFSDVEENRTEAPEGTESEMETPSAINGNPSWHLADSPAVNGATGHSSSLDAREVIPMAAVKQALREAGDEFELRYRRAFSDLTSQLHITPGTAYQSFEQVVNELFRDGVNWGRIVAFFSFGGALCVESVDKEMQVLVSRIAAWMATYLNDHLEPWIQENGGWDTFVELYGNNAAAESRKGQERFNRWFLTGMTVAGVVLLGSLFSRK

SEQ ID NO: 569 - protein, 204 aa, unidentified
MVDQLRERTTMADPLRERTELLLADYLGYCAREPGTPEPAPSTPEAAVLRSAAARLRQIHRSFFSAYLGYPGNRFELVALMADSVLSDSPGPTWGRVVTLVTFAGTLLERGPLVTARWKKWGFQPRLKEQEGDVARDCQRLVALLSSRLMGQHRAWLQAQGGWDGFCHFFRTPFPLAFWRKQLVQAFLSCLLTTAFIYLWTRLL

SEQ ID NO: 570 - protein, 485 aa, unidentified
MASSSTVPLGFHYETKYVVLSYLGLLSQEKLQEQHLSSPQGVQLDIASQSLDQEILLKVKTEIEEELKSLDKEISEAFTSTGFDRHTSPVFSPANPESSMEDCLAHLGEKVSQELKEPLHKALQMLLSQPVTYQAFRECTLETTVHASGWNKILVPLVLLRQMLLELTRRGQEPLSALLQFGVTYLEDYSAEYIIQQGGWGTVFSLESEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEVEEVVPALEPTETLLSEKEINAREESLVEELSPASEKKPVPPSEGKSRLSPAGEMKPMPLSEGKSILLFGGAAAVAILAVAIGVALALRKK

SEQ ID NO: 571 - protein, 193 aa, unidentified
MATPASAPDTRALVADFVGYKLRQKGYVCGAGPGEGPAADPLHQAMRAAGDEFETRFRRTFSDLAAQLHVTPGSAQQRFTQVSDELFQGGPNWGRLVAFFVFGAALCAESVNKEMEPLVGQVQEWMVAYLETQLADWIHSSGGWAEFTALYGDGALEEARRLREGNWASVRTVLTGAVALGALVTVGAFFASK

SEQ ID NO: 572 - protein, 419 aa, unidentified
MPLSDFILALKDNPYFGAGFGLVGVGTALALARKGVQLGLVAFRRHYMITLEVPARDRSYAWLLSWLTRHSTRTQHLSVETSYLQHESGRISTKFEFVPSPGNHFIWYRGKWIRVERSREMQMIDLQTGTPWESVTFTALGTDRKVFFNILEEARELALQQEEGKTVMYTAVGSEWRPFGYPRRRRPLNSVVLQQGLADRIVRDVQEFIDNPKWYTDRGIPYRRGYLLYGPPGCGKSSFITALAGELEHSICLLSLTDSSLSDDRLNHLLSVAPQQSLVLLEDVDAAFLSRDLAVENPVKYQGLGRLTFSGLLNALDGVASTEARIVFMTTNHVDRLDPALIRPGRVDLKEYVGYCSHWQLTQMFQRFYPGQAPSLAENFAEHVLRATNQISPAQVQGYFMLYKNDPVGAIHNAESLRR

SEQ ID NO: 573 - protein, 353 aa, unidentified
MASSWPPLELQSSNQSQLFPQNATACDNAPEAWDLLHRVLPTFIISICFFGLLGNLFVLLVFLLPRRQLNVAEIYLANLAASDLVFVLGLPFWAENIWNQFNWPFGALLCRVINGVIKANLFISIFLVVAISQDRYRVLVHPMASRRQQRRRQARVTCVLIWVVGGLLSIPTFLLRSIQAVPDLNITACILLLPHEAWHFARIVELNILGFLLPLAAIVFFNYHILASLRTREEVSRTRCGGRKDSKTTALILTLVVAFLVCWAPYHFFAFLEFLFQVQAVRGCFWEDFIDLGLQLANFFAFTNSSLNPVIYVFVGRLFRTKVWELYKQCTPKSLAPISSSHRKEIFQLFWRN

SEQ ID NO: 574 - protein, 391 aa, unidentified
MFSPWKISMFLSVREDSVPTTASFSADMLNVTLQGPTLNGTFAQSKCPQVEWLGWLNTIQPPFLWVLFVLATLENIFVLSVFCLHKSSCTVAEIYLGNLAAADLILACGLPFWAITISNNFDWLFGETLCRVVNAIISMNLYSSICFLMLVSIDRYLALVKTMSMGRMRGVRWAKLYSLVIWGCTLLLSSPMLVFRTMKEYSDEGHNVTACVISYPSLIWEVFTNMLLNVVGFLLPLSVITFCTMQIMQVLRNNEMQKFKEIQTERRATVLVLVVLLLFIICWLPFQISTFLDTLHRLGILSSCQDERIIDVITQIASFMAYSNSCLNPLVYVIVGKRFRKKSWEVYQGVCQKGGCRSEPIQMENSMGTLRTSISVERQIHKLQDWAGSRQ

SEQ ID NO: 575 - protein, 247 aa, unidentified
MTILFLTMVISYFGCMKAAPMKEANIRGQGGLAYPGVRTHGTLESVNGPKAGSRGLTSLADTFEHVIEELLDEDQKVRPNEENNKDADLYTSRVMLSSQVPLEPPLLFLLEEYKNYLDAANMSMRVRRHSDPARRGELSVCDSISEWVTAADKKTAVDMSGGTVTVLEKVPVSKGQLKQYFYETKCNPMGYTKEGCRGIDKRHWNSQCRTTQSYVRALTMDSKKRIGWRFIRIDTSCVCTLTIKRGR

SEQ ID NO: 576 - protein, 259 aa, unidentified
MSFKRPCPLARYNRTSYFYPTFSESSEHSHLLVSPVLVASAVIGVVIILSCITIIVGSIRRDRQARLQRHRHRHHRHHHHHHHHRRRRHREYEHGYVSDEHTYSRSSRRMRYACSSSEDWPPPLDISSDGDVDATVLRELYPDSPPGYEECVGPGATQLYVPTDAPPPYSLTDSCPTLDGTSDSGSGHSPGRHQQEQRTPAQGGLHTVSMDTLPPYEAVCGAGPPSGLLPLPGPDPGPRGSQGSPTPTRAPASGPERIV

SEQ ID NO: 577 - protein, 585 aa, unidentified
MTITYTSQVANARLGSFSRLLLCWRGSIYKLLYGEFLIFLLCYYIIRFIYRLALTEEQQLMFEKLTLYCDSYIQLIPISFVLGFYVTLVVTRWWNQYENLPWPDRLMSLVSGFVEGKDEQGRLLRRTLIRYANLGNVLILRSVSTAVYKRFPSAQHLVQAGFMTPAEHKQLEKLSLPHNMFWVPWVWFANLSMKAWLGGRIRDPILLQSLLNEMNTLRTQCGHLYAYDWISIPLVYTQVVTVAVYSFFLTCLVGRQFLNPAKAYPGHELDLVVPVFTFLQFFFYVGWLKVAEQLINPFGEDDDDFETNWIVDRNLQVSLLAVDEMHQDLPRMEPDMYWNKPEPQPPYTAASAQFRRASFMGSTFNISLNKEEMEFQPNQEDEEDAHAGIIGRFLGLQSHDHHPPRANSRTKLLWPKRESLLHEGLPKNHKAAKQNVRGQEDNKAWKLKAVDAFKSAPLYQRPGYYSAPQTPLSPTPMFFPLEPSAPSKLHSVTGIDTKDKSLKTVSSGAKKSFELLSESDGALMEHPEVSQVRRKTVEFNLTDMPEIPENHLKEPLEQSPTNIHTTLKDHMDPYWALENRDEAHS

SEQ ID NO: 578 - protein, 509 aa, unidentified
MTVTYTARVANARFGGFSQLLLLWRGSIYKLLWRELLCFLGFYMALSAAYRFVLTEGQKRYFEKLVIYCDQYASLIPVSFVLGFYVTLVVNRWWSQYLCMPLPDALMCVVAGTVHGRDDRGRLYRRTLMRYAGLSAVLILRSVSTAVFKRFPTIDHVVEAGFMTREERKKFENLNSSYNKYWVPCVWFSNLAAQARREGRIRDNSALKLLLEELNVFRGKCGMLFHYDWISVPLVYTQVVTIALYSYFLACLIGRQFLDPAQGYKDHDLDLCVPIFTLLQFFFYAGWLKVAEQLINPFGEDDDDFETNFLIDRNFQVSMLAVDEMYDDLAVLEKDLYWDAAEARAPYTAATVFQLRQPSFQGSTFDITLAKEDMQFQRLDGLDGPMGEAPGDFLQRLLPAGAGMVAGGPLGRRLSFLLRKNSCVSEASTGASCSCAVVPEGAAPECSCGDPLLDPGLPEPEAPPPAGPEPLTLIPGPVEPFSIVTMPGPRGPAPPWLPSPIGEEEENLA

SEQ ID NO: 579 - protein, 668 aa, unidentified
MTVTYSSKVANATFFGFHRLLLKWRGSIYKLLYREFIVFAVLYTAISLVYRLLLTGVQKRYFEKLSIYCDRYAEQIPVTFVLGFYVTLVVNRWWNQFVNLPWPDRLMFLISSSVHGSDEHGRLLRRTLMRYVNLTSLLIFRSVSTAVYKRFPTMDHVVEAGFMTTDERKLFNHLKSPHLKYWVPFIWFGNLATKARNEGRIRDSVDLQSLMTEMNRYRSWCSLLFGYDWVGIPLVYTQVVTLAVYTFFFACLIGRQFLDPTKGYAGHDLDLYIPIFTLLQFFFYAGWLKVAEQLINPFGEDDDDFETNWCIDRNLQVSLLAVDEMHMSLPKMKKDIYWDDSAARPPYTLAAADYCIPSFLGSTVQMGLSGSDFPDEEWLWDYEKHGHRHSMIRRVKRFLSAHEHPSSPRRRSYRRQTSDSSMFLPRDDLSPARDLLDVPSRNPPRASPTWKKSCFPEGSPTLHFSMGELSTIRETSQTSTLQSLTPQSSVRTSPIKMPLVPEVLITAAEAPVPTSGGYHHDSATSILSSEFTGVQPSKTEQQQGPMGSILSPSEKETPPGGPSPQTVSASAEENIFNCEEDPGDTFLKRWSLPGFLGSSHTSLGNLSPDPMSSQPALLIDTETSSEISGINIVAGSRVSSDMLYLMENLDTKETDIIELNKETEESPK

SEQ ID NO: 580 - protein, 473 aa, unidentified
MTVSYTLKVAEARFGGFSGLLLRWRGSIYKLLYKEFLLFGALYAVLSITYRLLLTQEQRYVYAQVARYCNRSADLIPLSFVLGFYVTLVVNRWWSQYTSIPLPDQLMCVISASVHGVDQRGRLLRRTLIRYANLASVLVLRSVSTRVLKRFPTMEHVVDAGFMSQEERKKFESLKSDFNKYWVPCVWFTNLAAQARRDGRIRDDIALCLLLEELNKYRAKCSMLFHYDWISIPLVYTQVVTIAVYSFFALSLVGRQFVEPEAGAAKPQKLLKPGQEPAPALGDPDMYVPLTTLLQFFFYAGWLKVAEQIINPFGEDDDDFETNQLIDRNLQVSLLSVDEMYQNLPPAEKDQYWDEDQPQPPYTVATAAESLRPSFLGSTFNLRMSDDPEQSLQVEASPGSGRPAPAAQTPLLGRFLGVGAPSPAISLRNFGRVRGTPRPPHLLRFRAEEGGDPEAAARIEEESAESGDEALEP

SEQ ID NO: 581 - protein, 127 aa, unidentified
MRRAGLGEGVPPGNYGNYGYANSGYSACEEENERLTESLRSKVTAIKSLSIEIGHEVKTQNKLLAEMDSQFDSTTGFLVDPSGSRDFTSSSESLLLLILTVPQHLSRSLKRRRLTFSAIYHSCRIIS

SEQ ID NO: 582 - protein, 111 aa, unidentified
MADWARAQSPGAVEEILDRENKRMADSLASKVTRLKSLALDIDRDAEDQNRYLDGMDSDFTSMTSLLTGSVKRFSTMARSGQDNRKLLCGMAVGLIVAFFILSYFLSRART

SEQ ID NO: 583 - protein, 450 aa, unidentified
MEEPQKSYVNTMDLERDEPLKSTGPQISVSEFSCHCCYDILVNPTTLNCGHSFCRHCLALWWASSKKTECPECREKWEGFPKVSILLRDAIEKLFPDAIRLRFEDIQQNNDIVQSLAAFQKYGNDQIPLAPNTGRANQQMGGGFFSGVLTALTGVAVVLLVYHWSSRESEHDLLVHKAVAKWTAEEVVLWLEQLGPWASLYRERFLSERVNGRLLLTLTEEEFSKTPYTIENSSHRRAILMELERVKALGVKPPQNLWEYKAVNPGRSLFLLYALKSSPRLSLLYLYLFDYTDTFLPFIHTICPLQEDSSGEDIVTKLLDLKEPTWKQWREFLVKYSFLPYQLIAEFAWDWLEVHYWTSRFLIINAMLLSVLELFSFWRIWSRSELKTVPQRMWSHFWKVSTQGLFVAMFWPLIPQFVCNCLFYWALYFNPIINIDLVVKELRRLETQVL

SEQ ID NO: 584 - protein, 160 aa, unidentified
MSEVRPLSRDILMETLLYEQLLEPPTMEVLGMTDSEEDLDPMEDFDSLECMEGSDALALRLACIGDEMDVSLRAPRLAQLSEVAMHSLGLAFIYDQTEDIRDVLRSFMDGFTTLKENIMRFWRSPNPGSWVSCEQVLLALLLLLALLLPLLSGGLHLLLK

SEQ ID NO: 585 - protein, 532 aa, unidentified
MPQLYIYIRLLGAYLFIISRVQGQNLDSMLHGTGMKSDSDQKKSENGVTLAPEDTLPFLKCYCSGHCPDDAINNTCITNGHCFAIIEEDDQGETTLASGCMKYEGSDFQCKDSPKAQLRRTIECCRTNLCNQYLQPTLPPVVIGPFFDGSIRWLVLLISMAVCIIAMIIFSSCFCYKHYCKSISSRRRYNRDLEQDEAFIPVGESLKDLIDQSQSSGSGSGLPLLVQRTIAKQIQMVRQVGKGRYGEVWMGKWRGEKVAVKVFFTTEEASWFRETEIYQTVLMRHENILGFIAADIKGTGSWTQLYLITDYHENGSLYDFLKCATLDTRALLKLAYSAACGLCHLHTEIYGTQGKPAIAHRDLKSKNILIKKNGSCCIADLGLAVKFNSDTNEVDVPLNTRVGTKRYMAPEVLDESLNKNHFQPYIMADIYSFGLIIWEMARRCITGGIVEEYQLPYYNMVPSDPSYEDMREVVCVKRLRPIVSNRWNSDECLRAVLKLMSECWAHNPASRLTALRIKKTLAKMVESQDVKI

SEQ ID NO: 586 - protein, 502 aa, unidentified
MLLRSAGKLNVGTKKEDGESTAPTPRPKVLRCKCHHHCPEDSVNNICSTDGYCFTMIEEDDSGLPVVTSGCLGLEGSDFQCRDTPIPHQRRSIECCTERNECNKDLHPTLPPLKNRDFVDGPIHHRALLISVTVCSLLLVLIILFCYFRYKRQETRPRYSIGLEQDETYIPPGESLRDLIEQSQSSGSGSGLPLLVQRTIAKQIQMVKQIGKGRYGEVWMGKWRGEKVAVKVFFTTEEASWFRETEIYQTVLMRHENILGFIAADIKGTGSWTQLYLITDYHENGSLYDYLKSTTLDAKSMLKLAYSSVSGLCHLHTEIFSTQGKPAIAHRDLKSKNILVKKNGTCCIADLGLAVKFISDTNEVDIPPNTRVGTKRYMPPEVLDESLNRNHFQSYIMADMYSFGLILWEVARRCVSGGIVEEYQLPYHDLVPSDPSYEDMREIVCIKKLRPSFPNRWSSDECLRQMGKLMTECWAHNPASRLTALRVKKTLAKMSESQDIKL

SEQ ID NO: 587 - protein, 1038 aa, unidentified
MTSSLQRPWRVPWLPWTILLVSTAAASQNQERLCAFKDPYQQDLGIGESRISHENGTILCSKGSTCYGLWEKSKGDINLVKQGCWSHIGDPQECHYEECVVTTTPPSIQNGTYRFCCCSTDLCNVNFTENFPPPDTTPLSPPHSFNRDETIIIALASVSVLAVLIVALCFGYRMLTGDRKQGLHSMNMMEAAASEPSLDLDNLKLLELIGRGRYGAVYKGSLDERPVAVKVFSFANRQNFINEKNIYRVPLMEHDNIARFIVGDERVTADGRMEYLLVMEYYPNGSLCKYLSLHTSDWVSSCRLAHSVTRGLAYLHTELPRGDHYKPAISHRDLNSRNVLVKNDGTCVISDFGLSMRLTGNRLVRPGEEDNAAISEVGTIRYMAPEVLEGAVNLRDCESALKQVDMYALGLIYWEIFMRCTDLFPGESVPEYQMAFQTEVGNHPTFEDMQVLVSREKQRPKFPEAWKENSLAVRSLKETIEDCWDQDAEARLTAQCAEERMAELMMIWERNKSVSPTVNPMSTAMQNERNLSHNRRVPKIGPYPDYSSSSYIEDSIHHTDSIVKNISSEHSMSSTPLTIGEKNRNSINYERQQAQARIPSPETSVTSLSTNTTTTNTTGLTPSTGMTTISEMPYPDETNLHTTNVAQSIGPTPVCLQLTEEDLETNKLDPKEVDKNLKESSDENLMEHSLKQFSGPDPLSSTSSSLLYPLIKLAVEATGQQDFTQTANGQACLIPDVLPTQIYPLPKQQNLPKRPTSLPLNTKNSTKEPRLKFGSKHKSNLKQVETGVAKMNTINAAEPHVVTVTMNGVAGRNHSVNSHAATTQYANGTVLSGQTTNIVTHRAQEMLQNQFIGEDTRLNINSSPDEHEPLLRREQQAGHDEGVLDRLVDRRERPLEGGRTNSNNNNSNPCSEQDVLAQGVPSTAADPGPSKPRRAQRPNSLDLSATNVLDGSSIQIGESTQDGKSGSGEKIKKRVKTPYSLKRWRPSTWVISTESLDCEVNNNGSNRAVHSKSSTAVYLAEGGTATTMVSKDIGMNCL

SEQ ID NO: 588 - protein, 405 aa, unidentified
MEPGAGGRNTARAQRAGSPNTPPPREQERKLEQEKLSGVVKSVHRRLRKKYREVGDFDKIWREHCEDEETLCEYAVAMKNLADNHWAKTCEGEGRIEWCCSVCREYFQNGGKRKALEKDEKRAVLATKTTPALNMHESSQLEGHLTNLSFTNPEFITELLQASGKIRLLDVGSCFNPFLKFEEFLTVGIDIVPAVESVYKCDFLNLQLQQPLQLAQDAIDAFLKQLKNPIDSLPGELFHVVVFSLLLSYFPSPYQRWICCKKAHELLVLNGLLLIITPDSSHQNRHAMMMKSWKIAIESLGFKRFKYSKFSHMHLMAFRKISLKTTSDLVSRNYPGMLYIPQDFNSIEDEEYSNPSCYVRSDIEDEQLAYGFTELPDAPYDSDSGESQASSIPFYELEDPILLLS

SEQ ID NO: 589 - protein, 228 aa, unidentified
MAAPQDVHVRICNQEIVKFDLEVKALIQDIRDCSGPLSALTELNTKVKEKFQQLRHRIQDLEQLAKEQDKESEKQLLLQEVENHKKQMLSNQASWRKANLTCKIAIDNLEKAELLQGGDLLRQRKTTKESLAQTSSTITESLMGISRMMAQQVQQSEEAMQSLVTSSRTILDANEEFKSMSGTIQLGRKLITKYNRRELTDKLLIFLALALFLATVLYIVKKRLFPFL

SEQ ID NO: 590 - protein, 314 aa, unidentified
MEGVELKEEWQDEDFPIPLPEDDSIEADILAITGPEDQPGSLEVNGNKVRKKLMAPDISLTLDPSDGSVLSDDLDESGEIDLDGLDTPSENSNEFEWEDDLPKPKTTEVIRKGSITEYTAAEEKEDGRRWRMFRIGEQDHRVDMKAIEPYKKVISHGGYYGDGLNAIVVFAVCFMPESSQPNYRYLMDNLFKYVIGTLELLVAENYMIVYLNGATTRRKMPSLGWLRKCYQQIDRRLRKNLKSLIIVHPSWFIRTLLAVTRPFISSKFSQKIRYVFNLAELAELVPMEYVGIPECIKQVDQELNGKQDEPKNEQ

SEQ ID NO: 591 - protein, 259 aa, unidentified
MGDAAADPPGPALPCEFLRPGCGAPLSPGAQLGRGAPTSAFPPPAAEAHPAARRGLRSPQLPSGAMSQNGAPGMQEESLQGSWVELHFSNNGNGGSVPASVSIYNGDMEKILLDAQHESGRSSSKSSHCDSPPRSQTPQDTNRASETDTHSIGEKNSSQSEEDDIERRKEVESILKKNSDWIWDWSSRPENIPPKEFLFKHPKRTATLSMRNTSVMKKGGIFSAEFLKVFLPSLLLSHLLAIGLGIYIGRRLTTSTSTF

SEQ ID NO: 592 - protein, 219 aa, unidentified
MSSHLVEPPPPLHNNNNNCEENEQSLPPPAGLNSSWVELPMNSSNGNDNGNGKNGGLEHVPSSSSIHNGDMEKILLDAQHESGQSSSRGSSHCDSPSPQEDGQIMFDVEMHTSRDHSSQSEEEVVEGEKEVEALKKSADWVSDWSSRPENIPPKEFHFRHPKRSVSLSMRKSGAMKKGGIFSAEFLKVFIPSLFLSHVLALGLGIYIGKRLSTPSASTY

SEQ ID NO: 593 - protein, 357 aa, unidentified
MGTIQEAGKKTDVGVREIAEAPELGAALRHGELELKEEWQDEEFPRLLPEEAGTSEDPEDPKGDSQAAAGTPSTLALCGQRPMRKRLSAPELRLSLTKGPGNDGASPTQSAPSSPDGSSDLEIDELETPSDSEQLDSGHEFEWEDELPRAEGLGTSETAERLGRGCMWDVTGEDGHHWRVFRMGPREQRVDMTVIEPYKKVLSHGGYHGDGLNAVILFASCYLPRSSIPNYTYVMEHLFRYMVGTLELLVAENYLLVHLSGGTSRAQVPPLSWIRQCYRTLDRRLRKNLRALVVVHATWYVKAFLALLRPFISSKFTRKIRFLDSLGELAQLISLDQVHIPEAVRQLDRDLHGSGGT

SEQ ID NO: 594 - protein, 1114 aa, unidentified
MLRGTMTAWRGMRPEVTLACLLLATAGCFADLNEVPQVTVQPASTVQKPGGTVILGCVVEPPRMNVTWRLNGKELNGSDDALGVLITHGTLVITALNNHTVGRYQCVARMPAGAVASVPATVTLANLQDFKLDVQHVIEVDEGNTAVIACHLPESHPKAQVRYSVKQEWLEASRGNYLIMPSGNLQIVNASQEDEGMYKCAAYNPVTQEVKTSGSSDRLRVRRSTAEAARIIYPPEAQTIIVTKGQSLILECVASGIPPPRVTWAKDGSSVTGYNKTRFLLSNLLIDTTSEEDSGTYRCMADNGVGQPGAAVILYNVQVFEPPEVTMELSQLVIPWGQSAKLTCEVRGNPPPSVLWLRNAVPLISSQRLRLSRRALRVLSMGPEDEGVYQCMAENEVGSAHAVVQLRTSRPSITPRLWQDAELATGTPPVSPSKLGNPEQMLRGQPALPRPPTSVGPASPQCPGEKGQGAPAEAPIILSSPRTSKTDSYELVWRPRHEGSGRAPILYYVVKHRKVTNSSDDWTISGIPANQHRLTLTRLDPGSLYEVEMAAYNCAGEGQTAMVTFRTGRRPKPEIMASKEQQIQRDDPGASPQSSSQPDHGRLSPPEAPDRPTISTASETSVYVTWIPRGNGGFPIQSFRVEYKKLKKVGDWILATSAIPPSRLSVEITGLEKGTSYKFRVRALNMLGESEPSAPSRPYVVSGYSGRVYERPVAGPYITFTDAVNETTIMLKWMYIPASNNNTPIHGFYIYYRPTDSDNDSDYKKDMVEGDKYWHSISHLQPETSYDIKMQCFNEGGESEFSNVMICETKARKSSGQPGRLPPPTLAPPQPPLPETIERPVGTGAMVARSSDLPYLIVGVVLGSIVLIIVTFIPFCLWRAWSKQKHTTDLGFPRSALPPSCPYTMVPLGGLPGHQASGQPYLSGISGRACANGIHMNRGCPSAAVGYPGMKPQQHCPGELQQQSDTSSLLRQTHLGNGYDPQSHQITRGPKSSPDEGSFLYTLPDDSTHQLLQPHHDCCQRQEQPAAVGQSGVRRAPDSPVLEAVWDPPFHSGPPCCLGLVPVEEVDSPDSCQVSGGDWCPQHPVGAYVGQEPGMQLSPGPLVRVSFETPPLTI

SEQ ID NO: 595 - protein, 212 aa, unidentified
MEVLRRSSVFAAEIMDAFDRSPTDKELVAQAKALGREYVHARLLRAGLSWSAPERAAPVPGRLAEVCAVLLRLGDELEMIRPSVYRNVARQLHISLQSEPVVTDAFLAVAGHIFSAGITWGKVVSLYAVAAGLAVDCVRQAQPAMVHALVDCLGEFVRKTLATWLRRRGGWTDVLKCVVSTDPGLRSHWLVAALCSFGRFLKAAFFVLLPER

SEQ ID NO: 596 - protein, 487 aa, unidentified
MRENMARGPCNAPRWASLMVLVAIGTAVTAAVNPGVVVRISQKGLDYASQQGTAALQKELKRIKIPDYSDSFKIKHLGKGHYSFYSMDIREFQLPSSQISMVPNVGLKFSISNANIKISGKWKAQKRFLKMSGNFDLSIEGMSISADLKLGSNPTSGKPTITCSSCSSHINSVHVHISKSKVGWLIQLFHKKIESALRNKMNSQVCEKVTNSVSSELQPYFQTLPVMTKIDSVAGINYGLVAPPATTAETLDVQMKGEFYSENHHNPPPFAPPVMEFPAAHDRMVYLGLSDYFFNTAGLVYQEAGVLKMTLRDDMIPKESKFRLTTKFFGTFLPEVAKKFPNMKIQIHVSASTPPHLSVQPTGLTFYPAVDVQAFAVLPNSSLASLFLIGMHTTGSMEVSAESNRLVGELKLDRLLLELKHSNIGPFPVELLQDIMNYIVPILVLPRVNEKLQKGFPLPTPARVQLYNVVLQPHQNFLLFGADVVYK

SEQ ID NO: 597 - protein, 125 aa, unidentified
MDHKPLLQERPPAYNLEAGQGDYACGPHGYGAIPAAPPPPPYPYLVTGIPTHHPRVYNIHSRTVTRYPANSIVVVGGCPVCRVGVLEDCFTFLGIFLAIILFPFGFICCFALRKRRCPNCGATFA

SEQ ID NO: 598 - protein, 251 aa, unidentified
MGARASGGPLARAGLLLLLLLLLLLGLLAPGAQGARGRGGAEKNSYRRTVNTFSQSVSSLFGEDNVRAAQKFLARLTERFVLGVDMFVETLWKVWTELLDVLGLDVSNLSQYFSPASVSSSPARALLLVGVVLLAYWFLSLTLGFTFSVLHVVFGRFFWIVRVVLFSMSCVYILHKYEGEPENAVLPLCFVVAVYFMTGPMGFYWRSSPSGPSNPSNPSVEEKLEHLEKQVRLLNIRLNRVLESLDRSKDK

SEQ ID NO: 599 - protein, 260 aa, unidentified
MEPASCCAERPKPGPTGVKTKPSCGGWRAVSLLLLLLLLVLAAVGVVAGGLLGSAQGPPKPRLQTLRMTLPSPHMPRPNQTILVDVARNAATITVTPPQSNHSWAVLFDGQSGCICYRPEEHQVCFLRLMEDSDRETLRLLVDTSKVQEAWVPSQDTHHTQELLAVQGSLEVDPAQAGALVQRLCMRTPIYWARRAEGESGPLWGKARPSGWFEELGAEPLEIHGTLATGPRRQRLIYLCIDICFPSNICVSVCFYYLPD

SEQ ID NO: 600 - protein, 399 aa, unidentified
MAQRQPHSPNQTLISITNDTESSSSVVSNDNTNKGWSGDNSPGIEALCAIYITYAVIISVGILGNAILIKVFFKTKSMQTVPNIFITSLAFGDLLLLLTCVPVDATHYLAEGWLFGRIGCKVLSFIRLTSVGVSVFTLTILSADRYKAVVKPLERQPSNAILKTCVKAGCVWIVSMIFALPEAIFSNVYTFRDPNKNMTFESCTSYPVSKKLLQEIHSLLCFLVFYIIPLSIISVYYSLIARTLYKSTLNIPTEEQSHARKQIESRKRIARTVLVLVALFALCWLPNHLLYLYHSFTSQTYVDPSAMHFIFTIFSRVLAFSNSCVNPFALYWLSKSFQKHFKAQLFCCKAERPEPPVADTSLTTLAVMGTVPGTGSIQMSEISVTSFTGCSVKQAEDRF

SEQ ID NO: 601 - protein, 778 aa, unidentified
MSSGAKEGGGGSPAYHLPHPHPHPPQHAQYVGPYRLEKTLGKGQTGLVKLGVHCITGQKVAIKIVNREKLSESVLMKVEREIAILKLIEHPHVLKLHDVYENKKYLYLVLEHVSGGELFDYLVKKGRLTPKEARKFFRQIVSALDFCHSYSICHRDLKPENLLLDEKNNIRIADFGMASLQVGDSLLETSCGSPHYACPEVIKGEKYDGRRADMWSCGVILFALLVGALPFDDDNLRQLLEKVKRGVFHMPHFIPPDCQSLLRGMIEVEPEKRLSLEQIQKHPWYLGGKHEPDPCLEPAPGRRVAMRSLPSNGELDPDVLESMASLGCFRDRERLHRELRSEEENQEKMIYYLLLDRKERYPSCEDQDLPPRNDVDPPRKRVDSPMLSRHGKRRPERKSMEVLSITDAGGGGSPVPTRRALEMAQHSQRSRSVSGASTGLSSSPLSSPRSPVFSFSPEPGAGDEARGGGSPTSKTQTLPSRGPRGGGAGEQPPPPSARSTPLPGPPGSPRSSGGTPLHSPLHTPRASPTGTPGTTPPPSPGGGVGGAAWRSRLNSIRNSFLGSPRFHRRKMQVPTAEEMSSLTPESSPELAKRSWFGNFISLDKEEQIFLVLKDKPLSSIKADIVHAFLSIPSLSHSVLSQTSFRAEYKASGGPSVFQKPVRFQVDISSSEGPEPSPRRDGSGGGGIYSVTFTLISGPSRRFKRVVETIQAQLLSTHDQPSVQALADEKNGAQTRPAGAPPRSLQPPPGRPDPELSSSPRRGPPKDKKLLATNGTPLP

SEQ ID NO: 602 - protein, 736 aa, unidentified
MTSTGKDGGAQHAQYVGPYRLEKTLGKGQTGLVKLGVHCVTCQKVAIKIVNREKLSESVLMKVEREIAILKLIEHPHVLKLHDVYENKKYLYLVLEHVSGGELFDYLVKKGRLTPKEARKFFRQIISALDFCHSHSICHRDLKPENLLLDEKNNIRIADFGMASLQVGDSLLETSCGSPHYACPEVIRGEKYDGRKADVWSCGVILFALLVGALPFDDDNLRQLLEKVKRGVFHMPHFIPPDCQSLLRGMIEVDAARRLTLEHIQKHIWYIGGKNEPEPEQPIPRKVQIRSLPSLEDIDPDVLDSMHSLGCFRDRNKLLQDLLSEEENQEKMIYFLLLDRKERYPSQEDEDLPPRNEIDPPRKRVDSPMLNRHGKRRPERKSMEVLSVTDGGSPVPARRAIEMAQHGQRSRSISGASSGLSTSPLSSPRVTPHPSPRGSPLPTPKGTPVHTPKESPAGTPNPTPPSSPSVGGVPWRARLNSIKNSFLGSPRFHRRKLQVPTPEEMSNLTPESSPELAKKSWFGNFISLEKEEQIFVVIKDKPLSSIKADIVHAFLSIPSLSHSVISQTSFRAEYKATGGPAVFQKPVKFQVDITYTEGGEAQKENGIYSVTFTLLSGPSRRFKRVVETIQAQLLSTHDPPAAQHLSDTTNCMEMMTGRLSKCGSPLSNFFDVIKQLFSDEKNGQAAQAPSTPAKRSAHGPLGDSAAAGPGPGGDAEYPTGKDTAKMGPPTARREQP

SEQ ID NO: 603 - protein, 398 aa, unidentified
MVNDPPVPALLWAQEVGQVLAGRARRLLLQFGVLFCTILLLLWVSVFLYGSFYYSYMPTVSHLSPVHFYYRTDCDSSTTSLCSFPVANVSLTKGGRDRVLMYGQPYRVTLELELPESPVNQDLGMFLVTISCYTRGGRIISTSSRSVMLHYRSDLLQMLDTLVFSSLLLFGFAEQKQLLEVELYADYRENSYVPTTGAIIEIHSKRIQLYGAYLRIHAHFTGLRYLLYNFPMTCAFIGVASNFTFLSVIVLFSYMQWVWGGIWPRHRFSLQVNIRKRDNSRKEVQRRISAHQPGPEGQEESTPQSDVTEDGESPEDPSGTEGQLSEEEKPDQQPLSGEEELEPEASDGSGSWEDAALLTEANLPAPAPASASAPVLETLGSSEPAGGALRQRPTCSSS

SEQ ID NO: 604 - protein, 385 aa, unidentified
MAAALFVLLGFALLGTHGASGAAGFVQAPLSQQRWVGGSVELHCEAVGSPVPEIQWWFEGQGPNDTCSQLWDGARLDRVHIHATYHQHAASTISIDTLVEEDTGTYECRASNDPDRNHLTRAPRVKWVRAQAVVLVLEPGTVFTTVEDLGSKILLTCSLNDSATEVTGHRWLKGGVVLKEDALPGQKTEFKVDSDDQWGEYSCVFLPEPMGTANIQLHGPPRVKAVKSSEHINEGETAMLVCKSESVPPVTDWAWYKITDSEDKALMNGSESRFFVSSSQGRSELHIENLNMEADPGQYRCNGTSSKGSDQAIITLRVRSHLAALWPFLGIVAEVLVLVTIIFIYEKRRKPEDVLDDDDAGSAPLKSSGQHQNDKGKNVRQRNSS

SEQ ID NO: 605 - protein, 320 aa, unidentified
MADEKTFRIGFIVLGLFLLALGTFLMSHDRPQVYGTFYAMGSVMVIGGIIWSMCQCYPKITFVPADSDFQGILSPKAMGLLENGLAAEMKSPSPQPPYVRLWEEAAYDQSLPDFSHIQMKVMSYSEDHRSLLAPEMGQPKLGTSDGGEGGPGDVQAWMEAAVVIHKGSDESEGERRLTQSWPGPLACPQGPAPLASFQDDLDMDSSEGSSPNASPHDREEACSPQQEPQGCRCPLDRFQDFALIDAPTLEDEPQEGQQWEIALPNNWQRYPRTKVEEKEASDTGGEEPEKEEEDLYYGLPDGAGDLLPDKELGFEPDTQG

SEQ ID NO: 606 - protein, 180 aa, unidentified
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 607 - protein, 178 aa, unidentified
MDRAARCSGASSLPLLLALALGLVILHCVVADGNSTRSPETNGLLCGDPEENCAATTTQSKRKGHFSRCPKQYKHYCIKGRCRFVVAEQTPSCVCDEGYIGARCERVDLFYLRGDRGQILVICLIAVMVVFIILVIGVCTCCHPLRKRRKRKKKEEEMETLGKDITPINEDIEETNIA

SEQ ID NO: 608 - protein, 289 aa, unidentified
MKTLPAMLGTGKLFWVFFLIPYLDIWNIHGKESCDVQLYIKRQSEHSILAGDPFELECPVKYCANRPHVTWCKLNGTTCVKLEDRQTSWKEEKNISFFILHFEPVLPNDNGSYRCSANFQSNLIESHSTTLYVTDVKSASERPSKDEMASRPWLLYRLLPLGGLPLLITTCFCLFCCLRRHQGKQNELSDTAGREINLVDAHLKSEQTEASTRQNSQVLLSETGIYDNDPDLCFRMQEGSEVYSNPCLEENKPGIVYASLNHSVIGPNSRLARNVKEAPTEYASICVRS

SEQ ID NO: 609 - protein, 526 aa, unidentified
MAVFPSSGLPRCLLTLILLQLPKLDSAPFDVIGPPEPILAVVGEDAELPCRLSPNASAEHLELRWFRKKVSPAVLVHRDGREQEAEQMPEYRGRATLVQDGIAKGRVALRIRGVRVSDDGEYTCFFREDGSYEEALVHLKVAALGSDPHISMQVQENGEICLECTSVGWYPEPQVQWRTSKGEKFPSTSESRNPDEEGLFTVAASVIIRDTSAKNVSCYIQNLLLGQEKKVEISIPASSLPRLTPWIVAVAVILMVLGLLTIGSIFFTWRLYNERPRERRNEFSSKERLLEELKWKKATLHAVDVTLDPDTAHPHLFLYEDSKSVRLEDSRQKLPEKTERFDSWPCVLGRETFTSGRHYWEVEVGDRTDWAIGVCRENVMKKGFDPMTPENGFWAVELYGNGYWALTPLRTPLPLAGPPRRVGIFLDYESGDISFYNMNDGSDIYTFSNVTFSGPLRPFFCLWSSGKKPLTICPIADGPERVTVIANAQDLSKEIPLSPMGEDSAPRDADTLHSKLIPTQPSQGAP

SEQ ID NO: 610 - protein, 527 aa, unidentified
MESAAALHFSRPASLLLLLLSLCALVSAQFIVVGPTDPILATVGENTTLRCHLSPEKNAEDMEVRWFRSQFSPAVFVYKGGRERTEEQMEEYRGRTTFVSKDISRGSVALVIHNITAQENGTYRCYFQEGRSYDEAILHLVVAGLGSKPLISMRGHEDGGIRLECISRGWYPKPLTVWRDPYGGVAPALKEVSMPDADGLFMVTTAVIIRDKSVRNMSCSINNTLLGQKKESVIFIPESFMPSVSPCAVALPIIVVILMIPIAVCIYWINKLQKEKKILSGEKEFERETREIALKELEKERVQKEEELQVKEKLQEELRWRRTFLHAVDVVLDPDTAHPDLFLSEDRRSVRRCPFRHLGESVPDNPERFDSQPCVLGRESFASGKHYWEVEVENVIEWTVGVCRDSVERKGEVLLIPQNGFWTLEMHKGQYRAVSSPDRILPLKESLCRVGVFLDYEAGDVSFYNMRDRSHIYTCPRSAFSVPVRPFFRLGCEDSPIFICPALTGANGVTVPEEGLTLHRVGTHQSL

SEQ ID NO: 611 - protein, 523 aa, unidentified
MEPAAALHFSLPASLLLLLLLLLLSLCALVSAQFTVVGPANPILAMVGENTTLRCHLSPEKNAEDMEVRWFRSQFSPAVFVYKGGRERTEEQMEEYRGRITFVSKDINRGSVALVIHNVTAQENGIYRCYFQEGRSYDEAILRLVVAGLGSKPLIEIKAQEDGSIWLECISGGWYPEPLTVWRDPYGEVVPALKEVSIADADGLFMVTTAVIIRDKYVRNVSCSVNNTLLGQEKETVIFIPESFMPSASPWMVALAVILTASPWMVSMTVILAVFIIFMAVSICCIKKLQREKKILSGEKKVEQEEKEIAQQLQEELRWRRTFLHAADVVLDPDTAHPELFLSEDRRSVRRGPYRQRVPDNPERFDSQPCVLGWESFASGKHYWEVEVENVMVWTVGVCRHSVERKGEVLLIPQNGFWTLEMFGNQYRALSSPERILPLKESLCRVGVFLDYEAGDVSFYNMRDRSHIYTCPRSAFTVPVRPFFRLGSDDSPIFICPALTGASGVMVPEEGLKLHRVGTHQSL

SEQ ID NO: 612 - protein, 513 aa, unidentified
MKMASFLAFLLLNFRVCLLLLQLLMPHSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSDLHVDVKGYKDGGIHLECRSTGWYPQPQIQWSNNKGENIPTVEAPVVADGVGLYAVAASVIMRGSSGEGVSCTIRSSLLGLEKTASISIADPFFRSAQRWIAALAGTLPVLLLLLGGAGYFLWQQQEEKKTQFRKKKREQELREMAWSTMKQEQSTRVKLLEELRWRSIQYASRGERHSAYNEWKKALFKPADVILDPKTANPILLVSEDQRSVQRAKEPQDLPDNPERFNWHYCVLGCESFISGRHYWEVEVGDRKEWHIGVCSKNVQRKGWVKMTPENGFWTMGLTDGNKYRTLTEPRTNLKLPKPPKKVGVFLDYETGDISFYNAVDGSHIHTFLDVSFSEALYPVFRILTLEPTALTICPA

SEQ ID NO: 613 - protein, 334 aa, unidentified
MKMASSLAFLLLNFHVSLLLVQLLTPCSAQFSVLGPSGPILAMVGEDADLPCHLFPTMSAETMELKWVSSSLRQVVNVYADGKEVEDRQSAPYRGRTSILRDGITAGKAALRIHNVTASDSGKYLCYFQDGDFYEKALVELKVAALGSNLHVEVKGYEDGGIHLECRSTGWYPQPQIQWSNAKGENIPAVEAPVVADGVGLYEVAASVIMRGGSGEGVSCIIRNSLLGLEKTASISIADPFFRSAQPWIAALAGTLPILLLLLAGASYFLWRQQKEITALSSEIESEQEMKEMGYAATEREISLRESLQEELKRKKIQYLTRGEESSSDTNKSA

SEQ ID NO: 614 - protein, 584 aa, unidentified
MKMASSLAFLLLNFHVSLFLVQLLTPCSAQFSVLGPSGPILAMVGEDADLPCHLFPTMSAETMELRWVSSSLRQVVNVYADGKEVEDRQSAPYRGRTSILRDGITAGKAALRIHNVTASDSGKYLCYFQDGDFYEKALVELKVAALGSDLHIEVKGYEDGGIHLECRSTGWYPQPQIKWSDTKGENIPAVEAPVVADGVGLYAVAASVIMRGSSGGGVSCIIRNSLLGLEKTASISIADPFFRSAQPWIAALAGTLPISLLLLAGASYFLWRQQKEKIALSRETEREREMKEMGYAATEQEISLREKLQEELKWRKIQYMARGEKSLAYHEWKMALFKPADVILDPDTANAILLVSEDQRSVQRAEEPRDLPDNPERFEWRYCVLGCENFTSGRHYWEVEVGDRKEWHIGVCSKNVERKKGWVKMTPENGYWTMGLTDGNKYRALTEPRTNLKLPEPPRKVGIFLDYETGEISFYNATDGSHIYTFPHASFSEPLYPVFRILTLEPTALTICPIPKEVESSPDPDLVPDHSLETPLTPGLANESGEPQAEVTSLLLPAHPGAEVSPSATTNQNHKLQARTEALY

SEQ ID NO: 615 - protein, 455 aa, unidentified
MVDFPGYNLSGAVASFLFILLTMKQSEDFRVIGPAHPILAGVGEDALLTCQLLPKRTTMHVEVRWYRSEPSTPVFVHRDGVEVTEMQMEEYRGWVEWIENGIAKGNVALKIHNIQPSDNGQYWCHFQDGNYCGETSLLLKVAGLGSAPSIHMEGPGESGVQLVCTARGWFPEPQVYWEDIRGEKLLAVSEHRIQDKDGLFYAEATLVVRNASAESVSCLVHNPVLTEEKGSVISLPEKLQTELASLKVNGPSQPILVRVGEDIQLTCYLSPKANAQSMEVRWDRSHRYPAVHVYMDGDHVAGEQMAEYRGRTVLVSDAIDEGRLTLQILSARPSDDGQYRCLFEKDDVYQEASLDLKVVSLGSSPLITVEGQEDGEMQPMCSSDGWFPQPHVPWRDMEGKTIPSSSQALTQGSHGLFHVQTLLRVTNISAVDVTCSISIPFLGEEKIATFSLSGW

SEQ ID NO: 616 - protein, 466 aa, unidentified
MAFVLILVLSFYELVSGQWQVTGPGKFVQALVGEDAVFSCSLFPETSAEAMEVRFFRNQFHAVVHLYRDGEDWESKQMPQYRGRTEFVKDSIAGGRVSLRLKNITPSDIGLYGCWFSSQIYDEEATWELRVAALGSLPLISIVGYVDGGIQLLCLSSGWFPQPTAKWKGPQGQDLSSDSRANADGYSLYDVEISIIVQENAGSILCSIHLAEQSHEVESKVLIGETFFQPSPWRLASILLGLLCGALCGVVMGMIIVFFKSKGKIQAELDWRRKHGQAELRDARKHAVEVTLDPETAHPKLCVSDLKTVTHRKAPQEVPHSEKRFTRKSVVASQGFQAGKHYWEVDVGQNVGWYVGVCRDDVDRGKNNVTLSPNNGYWVLRLTTEHLYFTFNPHFISLPPSTPPTRVGVFLDYEGGTISFFNTNDQSLIYTLLTCQFEGLLRPYIQHAMYDEEKGTPIFICPVSWG

SEQ ID NO: 617 - protein, 500 aa, unidentified
MALMLSLVLSLLKLGSGQWQVFGPDKPVQALVGEDAAFSCFLSPKTNAEAMEVRFFRGQFSSVVHLYRDGKDQPFMQMPQYQGRTKLVKDSIAEGRISLRLENITVLDAGLYGCRISSQSYYQKAIWELQVSALGSVPLISITGYVDRDIQLLCQSSGWFPRPTAKWKGPQGQDLSTDSRTNRDMHGLFDVEISLTVQENAGSISCSMRHAHLSREVESRVQIGDTFFEPISWHLATKVLGILCCGLFFGIVGLKIFFSKFQWKIQAELDWRRKHGQAELRDARKHAVEVTLDPETAHPKLCVSDLKTVTHRKAPQEVPHSEKRFTRKSVVASQSFQAGKHYWEVDGGHNKRWRVGVCRDDVDRRKEYVTLSPDHGYWVLRLNGEHLYFTLNPRFISVFPRTPPTKIGVFLDYECGTISFFNINDQSLIYTLTCRFEGLLRPYIEYPSYNEQNGTPIVICPVTQESEKEASWQRASAIPETSNSESSSQATTPFLPRGEM

SEQ ID NO: 618 - protein, 535 aa, unidentified
MVDLSVSPDSLKPVSLTSSLVFLMHLLLLQPGEPSSEVKVLGPEYPILALVGEEVEFPCHLWPQLDAQQMEIRWFRSQTFNVVHLYQEQQELPGRQMPAFRNRTKLVKDDIAYGSVVLQLHSIIPSDKGTYGCRFHSDNFSGEALWELEVAGLGSDPHLSLEGFKEGGIQLRLRSSGWYPKPKVQWRDHQGQCLPPEFEAIVWDAQDLFSLETSVVVRAGALSNVSVSIQNLLLSQKKELVVQIADVFVPGASAWKSAFVATLPLLLVLAALALGVLRKQRRSREKLRKQAEKRQEKLTAELEKLQTELDWRRAEGQAEWRAAQKYAVDVTLDPASAHPSLEVSEDGKSVSSRGAPPGPAPGHPQRFSEQTCALSLERFSAGRHYWEVHVGRRSRWFLGACLAAVPRAGPARLSPAAGYWVLGLWNGCEYFVLAPHRVALTLRVPPRRLGVFLDYEAGELSFFNVSDGSHIFTFHDTFSGALCAYFRPRAHDGGEHPDPLTICPLPVRGTGVPEENDSDTWLQPYEPADPALDWW

SEQ ID NO: 619 - protein, 360 aa, unidentified
MNYTESSPLRESTAIGFTPELESIIPVPSNKTTCENWREIHHLVFHVANICFAVGLVIPTTLHLHMIFLRGMLTLGCTLYIVWATLYRCALDIMIWNSVFLGVNILHLSYLLYKKRPVKIEKELSGMYRRLFEPLRVPPDLFRRLTGQFCMIQTLKKGQTYAAEDKTSVDDRLSILLKGKMKVSYRGHFLHNIYPCAFIDSPEFRSTQMHKGEKFQVTIIADDNCRFLCWSRERLTYFLESEPFLYEIFRYLIGKDITNKLYSLNDPTLNDKKAKKLEHQLSLCTQISMLEMRNSIASSSDSDDGLHQFLRGTSSMSSLHVSSPHQRASAKMKPIEEGAEDDDDVFEPASPNTLKVHQLP

SEQ ID NO: 620 - protein, 105 aa, unidentified
MNLGVSMLRILFLLDVGGAQVLATGKTPGAEIDFKYALIGTAVGVAISAGFLALKICMIRRHLFDDDSSDLKSTPGGLSDTIPLKKRAPRRNHNFSKRDAQVIEL

SEQ ID NO: 621 - protein, 121 aa, unidentified
MVRILANGEIVQDDDPRVRTTTQPPRGSIPRQSFFNRGHGAPPGGPGPRQQQAGARLGAAQSPFNDLNRQLVNMGFPQWHLGNHAVEPVTSILLLFLLMMLGVRGLLLVGLVYLVSHLSQR

SEQ ID NO: 622 - protein, 449 aa, unidentified
MWTALVLIWIFSLSLSESHAASNDPRNFVPNKMWKGLVKRNASVETVDNKTSEDVTMAAASPVTLTKGTSAAHLNSMEVTTEDTSRTDVSEPATSGGAADGVTSIAPTAVASSTTAASITTAASSMTVASSAPTTAASSTTVASIAPTTAASSMTAASSTPMTLALPAPTSTSTGRTPSTTATGHPSLSTALAQVPKSSALPRTATLATLATRAQTVATTANTSSPMSTRPSPSKHMPSDTAASPVPPMRPQAQGPISQVSVDQPVVNTTNKSTPMPSNTTPEPAPTPTVVTTTKAQAREPTASPVPVPHTSPIPEMEAMSPTTQPSPMPYTQRAAGPGTSQAPEQVETEATPGTDSTGPTPRSSGGTKMPATDSCQPSTQGQYMVVTTEPLTQAVVDKTLLLVVLLLGVTLFITVLVLFALQAYESYKKKDYTQVDYLINGMYADSEM

SEQ ID NO: 623 - protein, 577 aa, unidentified
MEGTAVAVFEILRFLIIHWKCDIDVSKGALLEGQLVISIEGLNSKHQANALHCVTTVASAGSLFGGMVLKKFLKEIQSILPGISAKLTWTSEEGSYSQDMTGVTPFQMIFEVDEKPRTLMTDCLVIKHFLRKIIMVHPKVRFHFSVKVNGILSTEIFGVENEPTLNLGNGIALLVDSQHYVRPNFGTIESHCSRIHPVLGHPVMLFIPEDVAGMDLLGELILTPAAALCPSPKVSSNQLNRISSVSIFLYGPLGLPLILSTWEQPMTTFFKDTSSLVDWKKYHLCMIPNLDLNLDRDLVLPDVSYQVESSEEDQSQTMDPQGQTLLLFLFVDFHSAFPVQQMEIWGVYTLLTTHLNAILVESHSVVQGSIQFTVDKVLEQHHQAAKAQQKLQASLSVAVNSIMSILTGSTRSSFRKMCLQTLQAADTQEFRTKLHKVFREITQHQFLHHCSCEVKQQLTLEKKDSAQGTEDAPDNSSLELLADTSGQAENKRLKRGSPRIEEMRALRSARAPSPSEAAPRRPEATAAPLTPRGREHREAHGRALAPGRASLGSRLEDVLWLQEVSNLSEWLSPSPGP

SEQ ID NO: 624 - protein, 197 aa, unidentified
MSARAPKELRLALPPCLLNRTFASPNASGSGNTGARGPGAVGSGTCITQVGQQLFQSFSSTLVLIVLVTLIFCLIVLSLSTFHIHKRRMKKRKMQRAQEEYERDHCSGSRGGGGLPRPGRQAPTHAKETRLERQPRDSPFCAPSNASSLSSSSPGLPCQGPCAPPPPPPASSPQGAHAASSCLDTAGEGLLQTVVLS

SEQ ID NO: 625 - protein, 135 aa, unidentified
MFQNLQGTFEKEIGKIIPFTIAFKRAEAVEPDGCVQSWRCCLPCDLGQASRFIHTTVCSAIRWRSCKGERNFAERHILPAELEEQSNHAGMGPILPAMPSVDGNHFQHPAGDCHPYGILCLQAHSASVTARQVLQ

SEQ ID NO: 626 - protein, 140 aa, unidentified
MSRFLNVLRSWLVMVSIIAMGNTLQSFRDHTFLYEKLYTGKPNLVNGLQARTFGIWTLLSSVIRCLCAIDIHNKTLYHITLWTFLLALGHFLSELFVYGTAAPTIGVLAPLMVASFSILGMLVGLRYLEVEPVSRQKKRN

SEQ ID NO: 627 - protein, 83 aa, unidentified
MDLSFMAAQLPMMGGAFMDSPNEDFSTEYSLFNSSANVHAAANGQGQPEDPPRSSNDAVLLWIAIIATLGNIVVVGVVYAFTF

SEQ ID NO: 628 - protein, 160 aa, unidentified
MRTAAGAVSPDSRPETRRQTRKNEEAAWGPRVCRAEREDNRKCPPSILKRSRPEHHRPEAKPQRTSRRVWFREPPAVTVHYIADKNATATVRVPGRPRPHGGSLLLQLCVCVLLVLALGLYCGRAKPVATALEDLRARLLGLVLHLRHVALTCWRGLLRL

SEQ ID NO: 629 - protein, 58 aa, unidentified
MLQSIIKNIWIPMKPYYTKVYQEIWIGMGLMGFIVYKIRAADKRSKALKASAPAPGHH

SEQ ID NO: 630 - protein, 774 aa, unidentified
MRGPIVLHICLAFCSLLLFSVATQCLAFPKIERRREIAHVHAEKGQSDKMNTDDLENSSVTSKQTPQLVVSEDPMMMSAVPSATSLNKAFSINKETQPGQAGLMQTERPGVSTPTESGVPSAEEVFGSSQPERISPESGLAKAMLTIAITATPSLTVDEKEELLTSTNFQPIVEEITETTKGFLKYMDNQSFATESQEGVGLGHSPSSYVNTKEMLTTNPKTEKFEADTDHRTTSFPGAESTAGSEPGSLTPDKEKPSQMTADNTQAAATKQPLETSEYTLSVEPETDSLLGAPEVTVSVSTAVPAASALSDEWDDTKLESVSRIRTPKLGDNEETQVRTEMSQTAQVSHEGMEGGQPWTEAAQVALGLPEGETHTGTALLIAHGNERSPAFTDQSSFTPTSLMEDMKVSIVNLLQSTGDFTESTKENDALFFLETTVSVSVYESEADQLLGNTMKDIITQEMTTAVQEPDATLSMVTQEQVATLELIRDSGKTEEEKEDPSPVSDVPGVTQLSRRWEPLATTISTTVVPLSFEVTPTVEEQMDTVTGPNEEFTPVLGSPVTPPGIMVGEPSISPALPALEASSERRTVVPSITRVNTAASYGLDQLESEEGQEDEDEEDEEDEDEEEEDEEEDEEDKDADSLDEGLDGDTELPGFTLPGITSQEPGLEEGNMDLLEGATYQVPDALEWEQQNQGLVRSWMEKLKDKAGYMSGMLVPVGVGIAGALFILGALYSIKVMNRRRRNGFKRHKRKQREFNSMQDRVMLLADSSEDEF

SEQ ID NO: 631 - protein, 224 aa, unidentified
MPLTPEPPSGRVEGPPAWEAAPWPSLPCGPCIPIMLVLATLAALFILTTAVLAERLFRRALRPDPSHRAPTLVWRPGGELWIEPMGTARERSEDWYGSAVPLLTDRAPEPPTQVGTLEARATAPPAPSAPNSAPSNLGPQTVLEVPARSTFWGPQPWEGRPPATGLVSWAEPEQRPEASVQFGSPQARRQRPGSPDPEWGLQPRVTLEQISAFWKREGRTSVGF

SEQ ID NO: 632 - protein, 468 aa, unidentified
MADDAGLETPLCSEQFGSGEARGCRAAADGSLQWEVGGWRWWGLSRAFTVKPEGRDAGEVGASGAPSPPLSGLQAVFLPQGFPDSVSPDYLPYQLWDSVQAFASSLSGSLATQAVLLGIGVGNAKATVSAATATWLVKDSTGMLGRIVFAWWKGSKLDCNAKQWRLFADILNDVAMFLEIMAPVYPICFTMTVSTSNLAKCIVSVAGGATRAALTVHQARRNNMADVSAKDSSQETLVNLAGLLVSLLMLPLVSGCPGFSLGCFFFLTALHIYANYRAVRALVMETLNEGRLRLVLKHYLQRGEVLDPTAANRMEPLWTGFWPAPSLSLGVPLHRLVSSVFELQQLVEGHQESYLLCWDQSQNQVQVVLNQKAGPKTILRAATHGLMLGALQGDGPLPAELEELRNRVRAGPKKESWVVVKETHEVLDMLFPKFLKGLQDAGWKTEKHQLEVDEWRATWLLSPEKKVL

SEQ ID NO: 633 - protein, 963 aa, unidentified
MAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELDDFEEGSQKELLNLTQQDYVNRIEELNQSLKDAWASDQKVKALKIVIQCSKLLSDTSVIQFYPSKFVLITDILDTFGKLVYERIFSMCVDSRSVLPDHFSPENANDTAKETCLNWFFKIASIRELIPRFYVEASILKCNKFLSKTGISECLPRLTCMIRGIGDPLVSVYARAYLCRVGMEVAPHLKETLNKNFFDFLLTFKQIHGDTVQNQLVVQGVELPSYLPLYPPAMDWIFQCISYHAPEALLTEMMERCKKLGNNALLLNSVMSAFRAEFIATRSMDFIGMIKECDESGFPKHLLFRSLGLNLALADPPESDRLQILNEAWKVITKLKNPQDYINCAEVWVEYTCKHFTKREVNTVLADVIKHMTPDRAFEDSYPQLQLIIKKVIAHFHDFSVLFSVEKFLPFLDMFQKESVRVEVCKCIMDAFIKHQQEPTKDPVILNALLHVCKTMHDSVNALTLEDEKRMLSYLINGFIKMVSFGRDFEQQLSFYVESRSMFCNLEPVLVQLIHSVNRLAMETRKVMKGNHSRKTAAFVRACVAYCFITIPSLAGIFTRLNLYLHSGQVALANQCLSQADAFFKAAISLVPEVPKMINIDGKMRPSESFLLEFLCNFFSTLLIVPDHPEHGVLFLVRELLNVIQDYTWEDNSDEKIRIYTCVLHLLSAMSQETYLYHIDKVDSNDSLYGGDSKFLAENNKLCETVMAQILEHLKTLAKDEALKRQSSLGLSFFNSILAHGDLRNNKLNQLSVNLWHLAQRHGCADTRTMVKTLEYIKKQSKQPDMTHLTELALRLPLQTRT

SEQ ID NO: 634 - protein, 132 aa, unidentified
MNRVLCAPAAGAVRALRLIGWASRSLHPLPGSRDRAHPAAEEEDDPDRPIEFSSSKANPHRWSVGHTMGKGHQRPWWKVLPLSCFLVALIIWCYLREESEADQWLRQVWGEVPEPSDRSEEPETPAAYRART

SEQ ID NO: 635 - protein, 132 aa, unidentified
MGAGVGVAGCTRGHRNWVPSQLPPREIKAGVSLAVVTEFAWVLAPRPKRATASALGTESPRFLDRPDFFDYPDSDQARLLAVAQFIGEKPIVFINSGSSPGLFHHILVGLLVVAFFFLLFQFCTHINFQKGA

SEQ ID NO: 636 - protein, 187 aa, unidentified
MYLQVETRTSSRLHLKRAPGIRSWSLLVGILSIGLAAAYYSGDSLGWKLFYVTGCLFVAVQNLEDWEEAIFDKSTGKVVLKTFSLYKKLLTLFRAGHDQVVVLLHDVRDVSVEEEKVRYFGKGYMVVLRLATGFSHPLTQSAVMGHRSDVEAIAKLITSFLELHCLESPTELSQSSDSEAGDPASQS

SEQ ID NO: 637 - protein, 501 aa, unidentified
MENQLWHNTVRCCNQYQESPHDAEDILLLLLGLIVLVNIGINVATMMWHGLQNALDKMIDWATQKNEIQASESPPSGPPDKAQDVHIHCILDPVQVKMSRPTQYSSFSCHHFSNHHSSSLLRCVRRRRRRHRRCRRRCCNHQQRPQNYRQIPHSHSVFRNPHRSQKMSQLHRVPFFDQEDPDSYLEEEDNLPFPYPKYPRRGWGGFYQRAGLPSNVGLWGHQGGILASLPPPSLYLSPELRCMPKRVEARSELRLQSYGRHGSQSRLWGNVEAEQWASSPPPPHRLPPNPSWVPVGHSPYPSVGWMLYDSWDQRRRGTEGFERPPASVSRNARPEAQGCREHHSPQSHQQSLLGHAYGQSHRSPHPSTEPLGYSSQDPREVRRRAADWAEALPAWRPLTTSASLTVLDEASHQRTPAPSSVLVPHSSQPWPKVQAADPAPPPTMFVPLSRNPGGNANYQVYDSLELKRQVQKSRARSSSLPPASTSTLRPSLHRSQTEKLN

SEQ ID NO: 638 - protein, 609 aa, unidentified
MSDNPPRMEVCPYCKKPFKRLKSHLPYCKMIGPTIPTDQKVYQSKPATLPRAKKMKGPIKDLIKAKGKELETENEERNSKLVVDKPEQTVKTFPLPAVGLERAATTKADKDIKNPIQPSFKMLKNTKPMTTFQEETKAQFYASEKTSPKRELAKDLPKSGESRCNPSEAGASLLVGSIEPSLSNQDRKYSSTLPNDVQTTSGDLKLDKIDPQRQELLVKLLDVPTGDCHISPKNVSDGVKRVRTLLSNERDSKGRDHLSGVPTDVTVTETPEKNTESLILSLKMSSLGKIQVMEKQEKGLTLGVETCGSKGNAEKSMSATEKQERTVMSHGCENFNTRDSVTGKESQGERPHLSLFIPRETTYQFHSVSQSSSQSLASLATTFLQEKKAEAQNHHCVPDVKALMESPEGQLSLEPKSDSQFQASHTGCQSPLCSAQRHTPQSPFTNHAAAAGRKTLRSCMGLEWFPELYPGYLGLGVLPGKPQCWNAMTQKPQLISPQGERLSQVSLLERSSTHIRSLEPPAGLTTSNFSLMRLLGAVQKGWIRCNTTIRKSGFGGITMLFTGYFVLCCSWSFRRLKKLCRPLPWKSTVPPCIGVAKTTGDCRSKTCLD

SEQ ID NO: 639 - protein, 76 aa, unidentified
MVCIPCIVIPVLLWIYKKFLEPYIYPLVSPFVSRIWPKKAIQESNDTNKGKVNFKGADMNGLPTKGPTEICDKKKD

SEQ ID NO: 640 - protein, 215 aa, unidentified
MDKVQSGFLILFLFLMECQLHLCLPYADGLHPTGNITGLPGSKRSQPPRNITKEPKVFFHKTQLPGIQGAASRSTAASPTNPMKFLRNKAIIRHRPALVKVILISSVAFSIALICGMAISYMIYRLAQAEERQQLESLYKNLRIPLLGDEEEGSEDEGESTHLLPENENELEKFIHSVIISKRSKNIKKKLKEEQNSVTENKTKNASHNGKMEDL

SEQ ID NO: 641 - protein, 132 aa, unidentified
MGPRVLQPPLLLLLLALLLAALPCGAEEASPLRPAQVTLSPPPAVTNGSQPGAPHNSTHTRPPGASGSALTRSFYVILGFCGLTALYFLIRAFRLKKPQRRRYGLLANTEDPTEMASLDSDEETVFESRNLR

SEQ ID NO: 642 - protein, 230 aa, unidentified
MPWTILLFAAGSLAIPAPSIRLVPPYPSSQEDPIHIACMAPGNFPGANFTLYRGGQVVQLLQAPTDQRGVTFNLSGGSSKAPGGPFHCQYGVLGELNQSQLSDLSEPVNVSFPVPTWILVLSLSLAGALFLLAGLVAVALVVRKVKLRNLQKKRDRESCWAQINFDSTDMSFDNSLFTVSAKTMPEEDPATLDDHSGTTATPSNSRTRKRPTSTSSSPETPEFSTFRACQ

SEQ ID NO: 643 - protein, 318 aa, unidentified
MLSESSSFLKGVMLGSIFCALITMLGHIRIGHGNRMHHHEHHHLQAPNKEDILKISEDERMELSKSFRVYCIILVKPKDVSLWAAVKETWTKHCDKAEFFSSENVKVFESINMDTNDMWLMMRKAYKYAFDKYRDQYNWFFLARPTTFAIIENLKYFLLKKDPSQPFYLGHTIKSGDLEYVGMEGGIVLSVESMKRLNSLLNIPEKCPEQGGMIWKISEDKQLAVCLKYAGVFAENAEDADGKDVFNTKSVGLSIKEAMTYHPNQVVEGCCSDMAVTFNGLTPNQMHVMMYGVYRLRAFGHIFNDALVFLPPNGSDND

SEQ ID NO: 644 - protein, 951 aa, unidentified
MSAREVAVLLLWLSCYGSALWRYSTNSPNYRIFSTRSTIKLEYEGTLFTEWSVPETCFVLNKSSPTTELRCSSPGVHAIKPIVTGPDEEERYLFVESSHTCFLWYYRVRHFFNNFTQLITVWAYDPESADPDELLGNAEEPSINSIVLSTQMATLGQKPVIHTVLKRKVYSSNEKMRRGTWRIVVPMTKDDALKEIRGNQVTFQDCFIADFLILLTFPLLTIPEIPGYLPISSPRGSQLMASWDACVVASAVLVTDMETFHTTDSFKSWTRIRVPPDILSDDERRSVAHVILSRDGIVFLINGVLYIKSFRGFIRLGGIVNLPDGGITGISSRKWCWVNYLLKAKGRRSTFAVWTENEIYLGSILLKFARLVTTTELKNILSLSVTATLTIDRVEYTGHPLEIAVFLNYCTVCNVTKKIFLVIYNEDTKQWVSQDFTLDAPIDSVTMPHFTFSALPGLLLWNKHSIYYCYHNFTFTGILQTPAGHGNLSMLSNDSIIHEVFIDYYGDILVKMENNVIFYSKINTRDAVKLHLWTNYTTRAFIFLSTSGQTYFLYALDDGTIQIQDYPLHLEAQSIAFTTKDKCPYMAFHNNVAHVFYFLDKGEALTVWTQIVYPENTGLYVIVESYGPKILQESHEISFEAAFGYCTKTLTLTFYQNVDYERISDYFETQDKHTGLVLVQFRPSEYSKACPIAQKVFQIAVGCDDKKFIAIKGFSKKGCHHHDFSYVIEKSYLRHQPSKNLRVRYIWGEYGCPLRLDFTEKFQPVVQLFDDNGYVKDVEANFIVWEIHGRDDYSFNNTMAQSGCLHEAQTWKSMIELNKHLPLEEVWGPENYKHCFSYAIGKPGDLNQPYEIINSSNGNHIFWPMGHSGMYVFRVKILDPNYSFCNLTAMFAIETFGLIPSPSVYLVASFLFVLMLLFFTILVLSYFRYMRIYRRYIYEPLHKPQRKRKKN

SEQ ID NO: 645 - protein, 380 aa, unidentified
MALRHLALLAGLLVGVASKSMENTVTRNSTAVINTQAEGTLSPPGLSSLPVVREWALTHTAQLPECCVDVVGVNASCPGASLCGPGCYRRWNADGSASCVRCGNGTLPAYNGSECRSFAGPGAPFPMNRSSGTPGRPHPGAPRVAASLFLGTFFISSGLILSVAGFFYLKRSSKLPRACYRRNKAPALQPGEAAAMIPPPQSSGNSSCRIPLWGFPSLGQSQGALWVCPQTGLPGSGSRPPLPGSPGDPPTRQGQGRIWLVPPALDLSWIWPAPPARPPLIPVTSMLFPVPETWGLQERRTHHDRADPQYLLLLEVQLHPRTDAAGLRQALLSSHRFSGAGSGGPKSQPVRKPRYVRRERPLDRATDPAAFPGEARISNV

SEQ ID NO: 646 - protein, 155 aa, unidentified
MGGNGSTCKPDTERQGTLSTAAPTTSPAPCLSNHHNKKHLILAFCAGVLLTLLLIAFIFLIIKSYRKYRRERLPISPGPLLRWVPLLSGTMADHSKPQAPDPHSDPPAKLSSIPGESLTYASTTFKLSEEKSNHLAENHSADFDPIVYAQIKVTN

SEQ ID NO: 647 - protein, 199 aa, unidentified
MASPKGFFNYLTYFLAAGAVTLGIGFFALASALWFLICKRREIFQNSKFKAIDERCRQRPSMAKIKSHSQCVFISRNFHTGRFQLQEEQRKKEAAHIKAIKDHSKDEPQLATKNIICDPSETSSTTNRSSVTLSLSTLPSDSYYSQSIEAADDWFSDDSLVKRNSPMPSLGEPLMEKVFSYLSTISLEEGTESVLNDTL

SEQ ID NO: 648 - protein, 172 aa, unidentified
MLTEVMEVWHGLVIAVVSLFLQACFLTAINYLLSRHMAHKSEQILKAASLQVPRPSPGHHHPPAVKEMKETQTERDIPMSDSLYRHDSDTPSDSLDSSCSSPPACQATEDVDYTQVVFSDPGELKNDSPLDYENIKEITDYVNVNPERHKPSFWYFVNPALSEPAEYDQVAM

SEQ ID NO: 649 - protein, 113 aa, unidentified
MNETNKTLVGPSELPTASAVAPGPGTGARAWPVLVGFVLGAVVLSLLIALAAKCHLCRRYHASYRHRPLPETGRGGRPQVAEDEDDDGFIEDNYIQPGTGELGTEGSRDHFSL

SEQ ID NO: 650 - protein, 454 aa, unidentified
MGRTYIVEETVGQYLSNINLQGKAFVSGLLIGQCSSQKDYVILATRTPPKEEQSENLKHPKAKLDNLDEEWATEHACQVSRMLPGGLLVLGVFIITTLELANDFQNALRRLMFAVEKSINRKRLWNFTEEEVSERVTLHICASTKKIFCRTYDIHDPKSSARPADWKYQSGLSSSWLSLECTVHINIHIPLSATSVSYTLEKNTKNGLTRWAKEIENGVYLINGQVKDEDCDLLEGQKKSSRGNTQATSHSFDVRVLTQLLLNSDHRSTATVQICSGSVNLKGAVKCRAYIHSSKPKVKDAVQAVKRDILNTVADRCEMLFEDLLLNEIPEKKDSEKEFHVLPYRVFVPLPGSTVMLCDYKFDDESAEEIRDHFMEMLDHTIQIEDLEIAEETNTACMSSSMNSQASLDNTDDEQPKQPIKTTMLLKIQQNIGVIAAFTVAVLAAGISFHYFSD

SEQ ID NO: 651 - protein, 253 aa, unidentified
MASGSNWLSGVNVVLVMAYGSLVFVLLFIFVKRQIMRFAMKSRRGPHVPVGHNAPKDLKEEIDIRLSRVQDIKYEPQLLADDDARLLQLETQGNQSCYNYLYRMKALDAIRTSEIPFHSEGRHPRSLMGKNFRSYLLDLRNTSTPFKGVRKALIDTLLDGYETARYGTGVFGQNEYLRYQEALSELATAVKARIGSSQRHHQSAAKDLTQSPEVSPTTIQVTYLPSSQKSKRAKHFLELKSFKDNYNTLESTL

SEQ ID NO: 652 - protein, 165 aa, unidentified
MTRLCLPRPEAREDPIPVPPRGLGAGEGSGSPVRPPVSTWGPSWAQLLDSVLWLGALGLTIQAVFSTTGPALLLLLVSFLTFDLLHRPAGHTLPQRKLLTRGQSQGAGEGPGQQEALLLQMGTVSGQLSLQDALLLLLMGLGPLLRACGMPLTLLGLAFCLHPWA

SEQ ID NO: 653 - protein, 137 aa, unidentified
MSGGRRKEEPPQPQLANGALKVSVWSKVLRSDAAWEDKDEFLDVIYWFRQIIAVVLGVIWGVLPLRGFLGIAGFCLINAGVLYLYFSNYLQIDEEEYGGTWELTKEGFMTSFALFMVCVADSFTTGHLDHLLHCHPL

SEQ ID NO: 654 - protein, 706 aa, unidentified
MDPGWGQRDVGWAALLILFAASLLTVFAWLLQYARGLWLARARGDRGPGPALAGEPAGSLRELGVWRSLLRLRATRAGAAEEPGVRGLLASLFAFKSFRENWQRAWVRALNEQACRNGSSIQIAFEEVPQLPPRASISHVTCVDQSEHTMVLRCQLSAEEVRFPVSVTQQSPAAVSMETYHVTLTLPPTQLEVNLEEIPGEGLLISWAFTDRPDLSLTVLPKLQARERGEEQVELSTIEELIKDAIVSTQPAMMVNLRACSAPGGLVPSEKPPMMPQAQPAIPRPNRLFLRQLRASHLGNELEGTEELCCVAELDNPMQQKWTKPARAGSEVEWTEDLALDLGPQSRELTLKVLRSSSCGDTELLGQATLPVGSPSRPLSRRQLCPLTPGPGKALGPAATMAVELHYEEGSPRNLGTPTSSTPRPSITPTKKIELDRTIMPDGTIVTTVTTVQSRPRIDGKLDSPSRSPSKVEVTEKTTTVLSESSGPSNTSHSSSRDSHLSNGLDPVAETAIRQLTEPSGRVAKKTPTKRSTLIISGVSKVPIAQDELALSLGYAASLEASVQDDAGTSGGPSSPPSDPPAMSPGPLDALSSPTSVQEADETTRSDISERPSVDDIESETGSTGALETRSLKDHKVSFLRSGTKLIFRRRPRQKEAGLSQSHDDLSNATATPSVRKKAGSFSRRLIKRFSFKSKPKANGNPSPQL

SEQ ID NO: 655 - protein, 1984 aa, unidentified
MELTPGAQQQGINYQELTSGWQDVKSMMLVPEPTRKFPSGPLLTSVRFSNLSPESQQQDVKSLEFTVEPKLQSVKHVKLSSVSLQQTIKSVELAPGSLPQRVKYGEQTPRTNYQIMESSELIPRPGHQFAKYAEMIPQPKYQIPKSANLISIPIYHATESSEMAQGLAYKGIDTVEKSVGLTPKLTGRAKESLGMLLQPDLQVPKFVDLTPMVRDQGSKFLGLTPEKSYQILETMELLSQSRPRVKDVGELYMKPLQQTVEYEGITPELKHYFTEAMGLTAEARIQANEFFGMTPKPTSQATGFAERSPRLCPQNLECVEVISEKRLQGEESVVLIPKSLHHVPDSASGMTPGLGHRVPESVELTSKSGVQVEKTLQLTPKPQHHVGSPGIISGLGHQVPESVNLTCKQWLQMEESLEVPLKQTSQVIGHEESVELTSEARQHREVSMGLTKSKNQSMKSPGTTPGPLGRIVEFMRISPEPLDQVTESARTQLQVAQSEEVILIDVPKVVQSVKVTPGPPFQIVKSVTIPRPTPQMVEYIELTPKLQYVRPSEHHTGPCLQDVKSTKLITKPKHQILETVELTGFQIVKTMLIPGPSLQIVKSEELAPGPIPQVVEPIGVALESGIEAINCVDLLPRPHLQELIVPAELTPSPCTQVKSAELTSPQTSPFEEHTILTHKQGLQAVKSTVIKTEPPKVMETEDLNLGHVCQNRDCQKLTSEELQVGTDFSRFLQSSSTTLISSSVRTASELGGLWDSGIQEVSRALDIKNPGTDILQPEETYIDPTMIQSLTFPLALHNQSSDKTANIVENPCPEILGVDVISKETTKRKQMEELENSLQRHLPQSWRSRSRTFQAESGVQKGLIKSFPGRQHNVWESHAWRQRLPRKYLSTMLMLGNILGTTMERKLCSQTSLAERATADTCQSIQNLFGIPAELMEPSQSLPEKGPVTISQPSVVKNYIQRHTFYHGHKKRMALRIWTRGSTSSIIQQYSGTRVRIKKTNSTFNGISQEVIQHMPVSCAGGQLPVLVKSESSLSIFYDREDLVPMEESEDSQSDSQTRISESQHSLKPNYLSQAKTDFSEQFQLLEDLQLKIAAKLLRSQIPPDVPPPLASGLVLKYPICLQCGRCSGLNCHHKLQTTSGPYLLIYPQLHLVRTPEGHGEVRLHLGFRLRIGKRSQISKYRERDRPVIRRSPISPSQRKAKIYTQASKSPTSTIDLQSGPSQSPAPVQVYIRRGQRSRPDLVEKTKTRAPGHYEFTQVHNLPESDSESTQNEKRAKVRTKKTSDSKYPMKRITKRLRKHRKFYTNSRTTIESPSRELAAHLRRKRIGATQTSTASLKRQPKKPSQPKFMQLLFQSLKRAFQTAHRVIASVGRKPVDGTRPDNLWASKNYYPKQNARDYCLPSSIKRDKRSADKLTPAGSTIKQEDILWGGTVQCRSAQQPRRAYSFQPRPLRLPKPTDSQSGIAFQTASVGQPLRTVQKDSSSRSKKNFYRNETSSQESKNLSTPGTRVQARGRILPGSPVKRTWHRHLKDKLTHKEHNHPSFYRERTPRGPSERTRHNPSWRNHRSPSERSQRSSLERRHHSPSQRSHCSPSRKNHSSPSERSWRSPSQRNHCSPPERSCHSLSERGLHSPSQRSHRGPSQRRHHSPSERSHRSPSERSHRSSSERRHRSPSQRSHRGPSERSHCSPSERRHRSPSQRSHRGPSERRHHSPSKRSHRSPARRSHRSPSERSHHSPSERSHHSPSERRHHSPSERSHCSPSERSHCSPSERRHRSPSERRHHSPSEKSHHSPSERSHHSPSERRRHSPLERSRHSLLERSHRSPSERRSHRSFERSHRRISERSHSPSEKSHLSPLERSRCSPSERRGHSSSGKTCHSPSERSHRSPSGMRQGRTSERSHRSSCERTRHSPSEMRPGRPSGRNHCSPSERSRRSPLKEGLKYSFPGERPSHSLSRDFKNQTTLLGTTHKNPKAGQVWRPEATR

SEQ ID NO: 656 - protein, 194 aa, unidentified
MSLLAKPMSFETTAITFFIILLICLICILLLLVVFLYKCFQGRKGKETKKVPCTDANGGVDCAAAKVVTSNPEDHERILMQVMNLNVPMRPGILVQRQSKEVLATPLENRRDMEAEEENQINEKQEPENAGETGQEEDDGLQKIHTSVTRTPSVVESQKRPLKGVTFSREVIVVDLGNEYPTPRSYTREHKERK

SEQ ID NO: 657 - protein, 121 aa, unidentified
MASCLALRMALLLVSGVLAPAVLTDDVPQEPVPTLWNEPAELPSGEGPVESTSPGREPVDTGPPAPTVAPGPEDSTAQERLDQGGGSLGPGAIAAIVIAALLATCVVLALVVVALRKFSAS

SEQ ID NO: 658 - protein, 150 aa, unidentified
MEDYALTFGINPFIALMIQPIVTMTVVDNQGLGLPVDIQHKAKPSPKASQMLPPDLGPPSFQNLLSPSEKLEPWDPGMRKLTVQTCGLTFIHPAGHGLCHPTAEASAETLSSTALNRPSVREGACNEKSTENKKPQDSVLWSHSRWFQGN

SEQ ID NO: 659 - protein, 482 aa, unidentified
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLYSNVFKPADVVSPKIPSGFPIEDHETSPLDNSDAFLSTHLKLFPSASSNSFYESELPQGFQDYYNLGQFTDDDQVPTPLVAITITRLVVGFLLPSVIMIACYSFIVFRMQRGRFAKSQSKTFRVAVVVVAVFLVCWTPYHIFGVLSLLTDPETPLGKTLMSWDHVCIALASANSCFNPFLYALLGKDFRKKARQSIQGILEAAFSEELTRSTHCPSNNVISERNSTTV

SEQ ID NO: 660 - protein, 162 aa, unidentified
MNSRTASARGWFSSRPPTSESDLEPATDGPASETTTLSPEATTFNDTRIPDAAGGTAGVGTMLLSFGIITVIGLAVALVLYIRKKKRLEKLRHQLMPMYNFDPTEEQDELEQELLEHGRDAASVQAATSVQAMQGKTTLPSQGPLQRPSRLVFTDVANAIHA

SEQ ID NO: 661 - protein, 170 aa, unidentified
MKTMATRKRCKLSRTGPEFENVIKRLLCARTFHTRIGGDLTHGIINRGRRANAEQMGLQGSAQHFNIFPLDLWTQGKKTEVQKREGTDSIPAAGRSGTANQPSIAPHRCLFSRGITALDGLKRGRGCNGAAHLVRGDAWKTKLGEPWVSIALALAGPGAILILELSWFLG

SEQ ID NO: 662 - protein, 217 aa, unidentified
MDLAQPSQPVDELELSVLERQPEENTPLNGADKVFPSLDEEVPPAEANKESPWSSCNKNVVGRCKLWMIITSIFLGVITVIIIGLCLAAVTYVDEDENEILELSSNKTFFIMLKIPEECVAEEELPHLLTERLTDVYSTSPSLGRYFTSVEIVDFSGENATVTYDLQFGVPSDDENFMKYMMSEELVLGILLQDFRDQNIPGCESLGLDPTSLLLYE

SEQ ID NO: 663 - protein, 247 aa, unidentified
MWGPGVTAEGLSVAPAPPPLLPLLLLLALALVAPSRGGGGCAELACGERERCCDATNATAVRCCKLPLHAFLDNVGWFVRKLSGLLILLVLFAIGYFLQRIICPSPRRYPRGQARPGQRPGPPGGAGPLGGAGPPDDDDDSPALLRDEAAAGSQDSLLDSGGGGRGRGGGGRSDPSCASEHEMRVVSPVFLQLPSYEEVKYLPTYEESMRLQQLSPGEVVLPVSVLGRPRGGVAAEPDGGEGRYPLI

SEQ ID NO: 664 - protein, 66 aa, unidentified
MEVDAPGVDGRDGLRERRGFSEGGRQNFDVRPQSGANGLPKHSYWLDLWLFILFDVVVFLFVYFLP

SEQ ID NO: 665 - protein, 132 aa, unidentified
MCSAGELLRGGDGGERDEDGDALAEREAAGTGWDPGASPRRRGQRPKESEQDVEDSQNHTGEPVGDDYKKMGTLFGELNKNLINMGFTRMYFGERIVEPVIVIFFWVMLWFLGLQALGLVAVLCLVIIYVQQ

SEQ ID NO: 666 - protein, 350 aa, unidentified
MDSFNYTTPDYGHYDDKDTLDLNTPVDKTSNTLRVPDILALVIFAVVFLVGVLGNALVVWVTAFEAKRTINAIWFLNLAVADFLSCLALPILFTSIVQHHHWPFGGAACSILPSLILLNMYASILLLATISADRFLLVFKPIWCQNFRGAGLAWIACAVAWGLALLLTIPSFLYRVVREEYFPPKVLCGVDYSHDKRRERAVAIVRLVLGFLWPLLTLTICYTFILLRTWSRRATRSTKTLKVVVAVVASFFIFWLPYQVTGIMMSFLEPSSPTFLLLKKLDSLCVSFAYINCCINPIIYVVAGQGFQGRLRKSLPSLLRNVLTEESVVRESKSFTRSTVDTMAQKTQAV

SEQ ID NO: 667 - protein, 337 aa, unidentified [sequence omitted]

SEQ ID NO: 668 - protein, 265 aa, unidentified
MAAAVPKRMRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEEDSHFFFHLIIFAFCIAVVYITYHNKRKIFLLVQSRKWRDGLCSKTVEYHRLDQNVNEAMPSLKITNDYIF

SEQ ID NO: 669 - protein, 3197 aa, unidentified
MEIRLEILTSTGIKQKKPWPRVSWLGKEKEAVFLLDDKFINEINLLSGKIKKKIPSLQPFLKDVIVLTTSSNDAWLAGVLTTGELFLWNKDQDCLKTIPITEKPKEMIKATVASSLRLYLYVSGNGKRIVLITPSGCIFLWEYLELKNILSSKSLSLAGRWSQVIPEEAVLLPSTEDKEAVVNAVFIKNELFGDCCLCSFTFYSGECLKLTFLAIRWHENVFTSVRSLPYHVHWAQQDCHLCSLIPKCESVKSRGALISAFSRDGLTLAVTLNQKDPKATQVLFINTLNFVTLCGSLKGCSNKSPVVPATLIRSYWVGDISWTHDSLFLACMLKRGSLVLLTCQGELLTLITFGCSIEFGPAEFIPLHPLITYRPQQFTFQDSNNSVDSSASDSDPMRQRFSIKAHSRLPYLVISDGYMVTTLRFLDSLSPSVHMRSLLLDSTQRLEKIYQSVILSKPKGKGLNLRSLNSLRSSLLEHQGNESSADFTVPKFLQAEETINENAADFQDFEAEETNEGRHFPDNLCPFWNKRDDVLCSSMKEGRLEFASMFDTIHAKDDSEETDRTITELHSIQKSLLAAWTIGISKTVTEKNLMLNYIVVCITHFFYILQFIKCPFPKLDLVLSKSSRHNAWILCIFQLFHQCLSIHYWDIRYKQDVGHLIKLTSNTVKLLLTQQQKGQLFSEKLLACFYLLKMVADNLNGVYILQPEVISASADGSKITAQDSLVVPIFQMFQDSGFQKNWSWNSFFKIHPQVVNPVQQPGHRLLILWRILYKKTLWYQAQLNRRVPEADSQLTEKMTHEASTVKSLLCHLQANLQSTGDCLNQTLELKSINGEECFLLGSYEKSVQLWKKALQEIEEKGGRRTYFLQIRYYLSLLYCHLYSYNLNDAQGLCDQLAREILRWSQLPVKENKDFSGAAKSHFECGMVGGVHPEAAVRVVQSMARFMAAYFTNQQLCILPPHHVNVLPPLHIKTEQSFRLIPLQHSKVASVVRDQNLSNVWTVEYALELLFIGGLVPEAVWLAYKLGDWKTSVSIGVAFQLFCKRDSNFMRSKKKSLNLPLRMTPAQIFQEKLQCVLGQPASLEAKNEMGSKYKQFTDPIEEEDANLLFGSVQEVLKASVMADADILSETFQLLIDSAKDFSKRLWGLVPFGLYLPAPPLYCPQPAILSEEDGDDLLLKAEKNNRQKVSGILQRVLLLFRAAQCSFPVAQWYILQLRWARKVMQKIRMKGSLPSLSPFPQSLLNYCKGGIAFFRPGAAGDHKLDEVSIRAIGCFRELCALCWMLHVRDKLSYSCRQYQKARENVKGEKDLEVEFDSCMIEHCLSAVEWAYRMLPFSRFFNMEELIQDIILSLIGELPPIRKVAEIFVKAFPYPEDVRVPLRDKYHSLHQRLRHCVVKGPQTEEMMSVVMHSIQKVRVKALKRVQRNIGSFEVNIWEPIEEEKPDEAPGVDRYSLGTSLSRSTLTELGDSVVHSDADTFSEALSVEEKSRINIYQRNAPNHMELTSIHKPTDKRKMCNQKENPTKKEDHEKLSQNTLPVIGVWEFERDDDEYIKFLDLFLSYILERDLPYSRDADIPFLTSFSGKLREHELNSLLFDVHTTLKRHQSKTKSQNVFRAGSCFVVAPESYESEKSSSLNDEYGMHLENQKLSSSVLVNQGIKPFLQYPSNEVNKNEGMSGLFGLKQRSIYKIQDDTREKCLIQRSSNHIFWTPKSIKTRRCIFKAIQCNDINPQEDLPLALNTFGSIGRLLEWMIRWSNRRLLCDSGITESSSEYSPVIRVKTSTAAILTSLWLLEQPYFATYKAKNAIIKMVENRDTGCQIGPNIERESKSDAGGSVAVATPGGTEERNGQNKSCQNILNRMPTEAKNPDIKEINDDIISITHNTKKEFIDIDENLLEVEAFTEEEMDMHISDYEEDIEESVGGFRSPSLAICMMTLPQQLEEEFTEEVQCQREEPLETIMEEKSTEQKGMIEAFSHPGHTTPQSMQVDTSSEISSAQISTYKEKSSSVPLLISNGVNVASQPPAPTPQKTQRNEFTAQLPDCSESVRQMLQDEMFKLVQLQQINFMSLMQIVGSSFANLPDTQQLVQQSQSVHLGESQESNLRGCGDVEDSNKNLKERFFIKPQSMGENAREPRKNSPHCHEGTIPSGQNSTGNVQNVPHGSIPLCQLNGQPRKKGPIPSSQNLPSTSFYPAPAGNTHLYLLSTPSVVQKAPRLIPHAKTFSPGDGFPLLQFKSKQEFQPLFLHTGSIPQVPFRPLPQPREAWGLSDSFQPALPQRAAQTTPASHLNVSQYNTEARKKEVEQKTWAETVITEIPNHVNLDQYVGQENLTPQQDSSVFIKPEKLFDVKPGTLEISPHHSFGLPLLYLPLKPPNMFPSTSRASITVPSTPIQPIAEERKYPRLSLLHSHLSPENRCKKTQLIPLENLIAFKQSQQKLTHNLFEQGDAGHLQLLKVKIEPPEVRQGKDSKKRQRRRAEKELQEKRCEKLRRKPNVTFRPENSIINNDDSEIIKKPKEQQEHCGSHPLDDFDVPFEMLQDDNTSAGLHFMASVKKKAIGSQDASTNTDPEHEPLTAPQLLVPDVYLNLKLSSEMSEKPWSPSIPHTVTNLELPVREEPSNDNVIKQQSDHLAVPSSAELHYMAASVTNAVPPHNFKSQGLPKPEFRFKGQSTKSDSAEDYLLWKRLQGVSAACPAPSSAAHQLEHLSAKLQKIDEQLLAIQNIAENIEQDFPKPEMLDLHCDKIGPVDHIEFSSGPEFKKTLASKTISISEEVRFLTHMDEEDQSDKKETSEPEFSITENYSGQKTCVFPTADSAVSLSSSSDQNTTSPGMNSSDELCESVSVHPLQMTGLTDIADIIDDLIIKDGVSSEELGLTEQAMGTSRIQHYSGRHSQRTDKERREIQAWMKRKRKERMAKYLNELAEKRGQEHDPFCPRSNPLYMTSREIRLRQKMKHEKDRLLLSEHYSRRISQAYGLMNELLSESVQLPTLPQKPLPNKPSPTQSSSCQHCPSPRGENQHGHSFLINRPGKVKYMSKPSYIHKRKSFGQPQGSPWPHGTATFTIQKKAGGAKAAVRKATQSPVTFQKGSNAPCHSLQHTKKHGSAGLAPQTKQVCVEYEREETVVSPWTIPSEIHKILHESHNSLLQDLSPTEEEEPEHPFGVGGVDSVSESTGSILSKLDWNAIEDMVASVEDQGLSVHWALDL

SEQ ID NO: 670 - protein, 102 aa, unidentified
MSNTTVPNAPQANSDSMVGYVLGPFFLITLVGVVVAVVMYVQKKKRVDRLRHHLLPMYSYDPAEELHEAEQELLSDMGDPKVVHGWQSGYQHKRMPLLDVKT

SEQ ID NO: 671 - protein, 563 aa, unidentified
MTVLEITLAVILTLLGLAILAILLTRWARCKQSEMYISRYSSEQSARLLDYEDGRGSRHAYSTQSDTSYDNRERSKRDYTPSTNSLVSMASKFSLGQTELILLLMCFILALSRSSIGSIKCLQTTEEPPSRTAGAMMQFTAPIPGATGPIKLSQKTIVQTPGPIVQYPGSNAGPPSAPRGPPMAPIIISQRTARIPQVHTMDSSGKITLTPVVILTGYMDEELAKKSCSKIQILKCGGTARSQNSREENKEALKNDIIFTNSVESLKSAHIKEPEREGKGTDLEKDKIGMEVKVDSDAGIPKRQETQLKISEMSIPQGQGAQIKKSVSDVPRGQESQVKKSESGVPKGQEAQVTKSGLVVLKGQEAQVEKSEMGVPRRQESQVKKSQSGVSKGQEAQVKKRESVVLKGQEAQVEKSELKVPKGQEGQVEKTEADVPKEQEVQEKKSEAGVLKGPESQVKNTEVSVPETLESQVKKSESGVLKGQEAQEKKESFEDKGNNDKEKERDAEKDPNKKEKGDKNTKGDKGKDKVKGKRESEINGEKSKGSKRAKANTGRKYNKKVEE

SEQ ID NO: 672 - protein, 315 aa, unidentified
MYQPSRGAARRLGPCLRAYQARPQDQLYPGTLPFPPLWPHSTTTTSPSSPLFWSPLPPRLPTQRLPQVPPLPLPQIQALSSAWVVLPPGKGEEGPGPELHSGCLDGLRSLFEGPPCPYPGAWIPFQVPGTAHPSPATPSGDPSMEEHLSVMYERLRQELPKLFLQSHDYSLYSLDVEFINEILNIRTKGRTWYILSLTLCRFLAWNYFAHLRLEVLQLTRHPENWTLQARWRLVGLPVHLLFLRFYKRDKDEHYRTYDAYSTFYLNSSGLICRHRLDKLMPSHSPPTPVKKLLVGALVALGLSEPEPDLNLCSKP

SEQ ID NO: 673 - protein, 294 aa, unidentified
MFLRRLGGWLPRPWGRRKPMRPDPPYPEPRRVDSSSENSGSDWDSAPETMEDVGHPKTKDSGALRVSGAASEPSKEEPQVEQLGSKRMDSLKWDQPISSTQESGRLEAGGASPKLRWDHVDSGGTRRPGVSPEGGLSVPGPGAPLEKPGRREKLLGWLRGEPGAPSRYLGGPEECLQISTNLTLHLLELLASALLALCSRPLRAALDTLGLRGPLGLWLHGLLSFLAALHGLHAVLSLLTAHPLHFACLFGLLQALVLAVSLREPNGDEAATDWESEGLEREGEEQRGDPGKGL

SEQ ID NO: 674 - protein, 347 aa, unidentified
MDLAANEISIYDKLSETVDLVRQTGHQCGMSEKAIEKFIRQLLEKNEPQRPPPQYPLLIVVYKVLATLGLILLTAYFVIQPFSPLAPEPVLSGAHTWRSLIHHIRLMSLPIAKKYMSENKGVPLHGGDEDRPFPDFDPWWTNDCEQNESEPIPANCTGCAQKHLKVMLLEDAPRKFERLHPLVIKTGKPLLEEEIQHFLCQYPEATEGFSEGFFAKWWRCFPERWFPFPYPWRRPLNRSQMLRELFPVFTHLPFPKDASLNKCSFLHPEPVVGSKMHKMPDLFIIGSGEAMLQLIPPFQCRRHCQSVAMPIEPGDIGYVDTTHWKVYVIARGVQPLVICDGTAFSEL

SEQ ID NO: 675 - protein, 122 aa, unidentified
MPPLAPQLCRAVFLVPILLLLQVKPLNGSPGPKDGSQTEKTPSADQNQEQFEEHFVASSVGEMWQVVDMAQQEEDQSSKTAAVHKHSFHLSFCFSLASVMVFSGGPLRRTFPNIQLCFMLTH

SEQ ID NO: 676 - protein, 161 aa, unidentified
MKKIEISGTCLSFHLLFGLEIRMRRIVFAGVILFRLLGVILFRLLGVILFGRLGDLGTCQTKPGQYWKEEVHIQDVGGLICRACNLSLPFHGCLLDLGTCQAEPGQYCKEEVHIQGGIQWYSVKGCTKNTSECFKSTLVKRILQLHELVTTHCCNHSLCNF

SEQ ID NO: 677 - protein, 139 aa, unidentified
MPVMPIPRRVRSFHGPHTTCLHAACGPVRASHLARTKYNNFDVYIKTRWLYGFIRFLLYFSCSLFTAALWGALAALFCLQYLGVRVLLRFQRKLSVLLLLLGRRRVDFRLVNELLVYGIHVTMLLVGGLGWCFMVFVDM

SEQ ID NO: 678 - protein, 77 aa, unidentified
MARFQRTKEREEDRCSLNIYYVRNTTQGTAPACVGKRMQPSPTGKGGKCCTVHGLTRKIHNVQPNLQSPILSAACVD

SEQ ID NO: 679 - protein, 283 aa, unidentified
MPRRSLHAAAVLLLVILKEQPSSPAPVNGSKWTYFVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALETALYCTHMDDPSPREMINNFRQVQKFDERLVYTSFSQGIILSLALAGILGICIVVVVSIWLFRRKSIKKGDNKGVIYKPATKMETEAHA

SEQ ID NO: 680 - protein, 337 aa, unidentified
MLFSALLLEVIWILAADGGQHWTYEGPHGQDHWPASYPECGNNAQSPIDIQTDSVTFDPDLPALQPHGYDQPGTEPLDLHNNGHTVQLSLPSTLYLGGLPRKYVAAQLHLHWGQKGSPGGSEHQINSEATFAELHIVHYDSDSYDSLSEAAERPQGLAVLGILIEVGETKNIAYEHILSHLHEVRHKDQKTSVPPFNLRELLPKQLGQYFRYNGSLTTPPCYQSVLWTVFYRRSQISMEQLEKLQGTLFSTEEEPSKLLVQNYRALQPLNQRMVFASFIQAGSSYTTGEMLSLGVGILVGCLCLLLAVYFIARKIRKKRLENRKSVVFTSAQATTEA

SEQ ID NO: 681 - protein, 312 aa, unidentified
MRMLLALLALSAARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQKLYYDKEQTVSMKDNVRPLQQLGQRTVIKSGAPGRPLPWALPALLGPMLACLLAGFLR

SEQ ID NO: 682 - protein, 459 aa, unidentified
MAPLCPSPWLPLLIPAPAPGLTVQLLLSLLLLVPVHPQRLPRMQEDSPLGGGSSGEDDPLGEEDLPSEEDSPREEDPPGEEDLPGEEDLPGEEDLPEVKPKSEEEGSLKLEDLPTVEAPGDPQEPQNNAHRDKEGDDQSHWRYGGDPPWPRVSPACAGRFQSPVDIRPQLAAFCPALRPLELLGFQLPPLPELRLRNNGHSVQLTLPPGLEMALGPGREYRALQLHLHWGAAGRPGSEHTVEGHRFPAEIHVVHLSTAFARVDEALGRPGGLAVLAAFLEEGPEENSAYEQLLSRLEEIAEEGSETQVPGLDISALLPSDFSRYFQYEGSLTTPPCAQGVIWTVFNQTVMLSAKQLHTLSDTLWGPGDSRLQLNFRATQPLNGRVIEASFPAGVDSSPRAAEPVQLNSCLAAGDILALVFGLLFAVTSVAFLVQMRRQHRRGTKGGVSYRPAEVAETGA

SEQ ID NO: 683 - protein, 478 aa, unidentified
MAAAAAGGAPGPAPGPAGPPPPAAPTSAARAPPQALRRRGDSRRRQAALFFLNNISLDGRPPSLGPGGEKPPPPPAEAREPPAPPPPEPPTGLPARTPAPQGLLSPTQVPTGLGLDGQRQRKRVTSQRCSLEFLEDAVGCAPAQRTKHTSGSPRHKGLKKTHFIKNMRQYDTRNSRIVLICAKRSLCAAFSVLPYGEGLRISDLRVDSQKQRHPSGGVSVSSEMVFELEGVELGADGKVVSYAKFLYPTNALVTHKSDSHGLLPTPRPSVPRTLPGSRHKPAPTKSAPASTELGSDVGDTLEYNPNLLDDPQWPCGKHKRVLIFASYMTTVIEYVKPSDLKKDMNETFREKFPHVKLTLSKIRSLKREMRSLSEECSLEPVTVAMAYVYFEKLVLQGKLSKQNRKLCAGACVLLAAKISSDLRKSGVTQLIDKLEERFRFNRRDLIGFEFTVLVALELALYLPENQVLPHYRRLTQQF

SEQ ID NO: 684 - protein, 215 aa, unidentified
MPFHPVTAALMYRGIYTVPNLLSEQRPVDIPEDELEEIREAFKVFDRDGNGFISKQELGTAMRSLGYMPNEVELEVIIQRLDMDGDGQVDFEEFVTLLGPKLSTSGIPEKFHGTDFDTVFWKCDMQKLTVDELKRLLYDTFCEHLSMKDIENIIMTEEESHLGTAEECPVDVETCSNQQIRQTCVRKSLICAFAIAFIISVMLIAANQVLRSGMK

SEQ ID NO: 685 - protein, 172 aa, unidentified
MSSSGGAPGASASSAPPAQEEGMTWWYRWLCRLSGVLGAVSCAISGLFNCITIHPLNIAAGVWMIMNAFILLLCEAPFCCQFIEFANTVAEKVDRLRSWQKAVFYCGMAVVPIVISLTLTTLLGNAIAFATGVLYGLSALGKKGDAISYARIQQQRQQADEEKLAETLEGEL

SEQ ID NO: 686 - protein, 1274 aa, unidentified
MARQPEEEETAVARARRPPLWLLCLVACWLLGAGAEADFSILDEAQVLASQMRRLAAEELGVVTMQRIFNSFVYTEKISNGESEVQQLAKKIREKFNRYLDVVNRNKQVVEASYTAHLTSPLTAIQDCCTIPPSMMEFDGNFNTNVSRTISCDRLSTTVNSRAFNPGRDLNSVLADNLKSNPGIKWQYFSSEEGIFTVFPAHKFRCKGSYEHRSRPIYVSTVRPQSKHIVVILDHGASVTDTQLQIAKDAAQVILSAIDEHDKISVLTVADTVRTCSLDQCYKTFLSPATSETKRKMSTFVSSVKSSDSPTQHAVGFQKAFQLIRSTNNNTKFQANTDMVIIYLSAGITSKDSSEEDKKATLQVINEENSFLNNSVMILTYALMNDGVTGLKELAFLRDLAEQNSGKYGVPDRMALPVIKGSMMVLNQLSNLETTVGRFYTNLPNRMIDEAVFSLPFSDEMGDGLIMTVSKPCYFGNLLLGIVGVDVNLAYILEDVTYYQDSLASYTFLIDDKGYTLMHPSLTRPYLLSEPPLHTDIIHYENIPKFELVRQNILSLPLGSQIIAVPVNSSLSWHINKLRETGKEAYNVSYAWKMVQDTSFILCIVVIQPEIPVKQLKNLNTVPSSKLLYHRLDLLGQPSACLHFKQLATLESPTIMLSAGSFSSPYEHLSQPETKRMVEHYTAYLSDNTRLIANPGLKFSVRNEVMATSHVTDEWMTQMEMSSLNTYIVRRYIATPNGVLRIYPGSLMDKAFDPTRRQWYLHAVANPGLISLTGPYLDVGGAGYVVTISHTIHSSSTQLSSGHTVAVMGIDFTLRYFYKVLMDLLPVCNQDGGNKIRCFIMEDRGYLVAHPTLIDPKGHAPVEQQHITHKEPLVANDILNHPNFVKKNLCNSFSDRTVQRFYKFNTSLAGDLTNLVHGSHCSKYRLARIPGTNAFVGIVNETCDSLAFCACSMVDRLCLNCHRMEQNECECPCECPLEVNECTGNLTNAENRNPSCEVHQEPVTYTAIDPGLQDALHQCVNSRCSQRLESGDCFGVLDCEWCMVDSDGKTHLDKPYCAPQKECFGGIVGAKSPYVDDMGAIGDEVITLNMIKSAPVGPVAGGIMGCIMVLVLAVYAYRHQIHRRSHQHMSPLAAQEMSVRMSNLENDRDERDDDSHEDRGIISNTRFIAAVIERHAHSPERRRRYWGRSGTESDHGYSTMSPQEDSENPPCNNDPLSAGVDVGNHDEDLDLDTPPQTAALLSHKFHHYRSHHPTLHHSHHLQAAVTVHTVDAEC

SEQ ID NO: 687 - protein, 2506 aa, unidentified
MARFGDEMPARYGGGGSGAAAGVVVGSGGGRGAGGSRQGGQPGAQRMYKQSMAQRARTMALYNPIPVRQNCLTVNRSLFLFSEDNVVRKYAKKITEWPPFEYMILATIIANCIVLALEQHLPDDDKTPMSERLDDTEPYFIGIFCFEAGIKIIALGFAFHKGSYLRNGWNVMDFVVVLTGILATVGTEFDLRTLRAVRVLRPLKLVSGIPSLQVVLKSIMKAMIPLLQIGLLLFFAILIFAIIGLEFYMGKFHTTCFEEGTDDIQGESPAPCGTEEPARTCPNGTKCQPYWEGPNNGITQFDNILFAVLTVFQCITMEGWTDLLYNSNDASGNTWNWLYFIPLIIIGSFFMLNLVLGVLSGEFAKERERVENRRAFLKLRRQQQIERELNGYMEWISKAEEVILAEDETDGEQRHPFDALRRTTIKKSKTDLLNPEEAEDQLADIASVGSPFARASIKSAKLENSTFFHKKERRMRFYIRRMVKTQAFYWTVLSLVALNTLCVAIVHYNQPEWLSDFLYYAEFIFLGLFMSEMFIKMYGLGTRPYFHSSFNCFDCGVIIGSIFEVIWAVIKPGTSFGISVLRALRLLRIFKVTKYWASLRNLVVSLLNSMKSIISLLFLLFLFIVVFALLGMQLFGGQFNFDEGTPPTNFDTFPAAIMTVFQILTGEDWNEVMYDGIKSQGGVQGGMVFSIYFIVLTLFGNYTLLNVFLAIAVDNLANAQELTKDEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTGNSKGKDINTIKSLRVLRVLRPLKTIKRLPKLKAVFDCVVNSLKNVFNILIVYMLFMFIFAVVAVQLFKGKFFHCTDESKEFEKDCRGKYLLYEKNEVKARDREWKKYEFHYDNVLWALLTLFTVSTGEGWPQVLKHSVDATFENQGPSPGYRMEMSIFYVVYFVVFPFFFVNIFVALIIITFQEQGDKMMEEYSLEKNERACIDFAISAKPLTRHMPQNKQSFQYRMWQFVVSPPFEYTIMAMIALNTIVLMMKFYGASVAYENALRVFNIVFTSLFSLECVLKVMAFGILNYFRDAWNIFDFVTVLGSITDILVTEFGNNFINLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSATGEAWHNIMLSCLSGKPCDKNSGILTRECGNEFAYFYFVSFIFLCSFLMLNLFVAVIMDNFEYLTRDSSILGPHHLDEYVRVWAEYDPAAWGRMPYLDMYQMLRHMSPPLGLGKKCPARVAYKRLLRMDLPVADDNTVHFNSTLMALIRTALDIKIAKGGADKQQMDAELRKEMMAIWPNLSQKTLDLLVTPHKSTDLTVGKIYAAMMIMEYYRQSKAKKLQAMREEQDRTPLMFQRMEPPSPTQEGGPGQNALPSTQLDPGGALMAHESGLKESPSWVTQRAQEMFQKTGTWSPEQGPPTDMPNSQPNSQSVEMREMGRDGYSDSEHYLPMEGQGRAASMPRLPAENQRRRGRPRGNNLSTISDTSPMKRSASVLGPKARRLDDYSLERVPPEENQRHHQRRRDRSHRASERSLGRYTDVDTGLGTDLSMTTQSGDLPSKERDQERGRPKDRKHRQHHHHHHHHHHPPPPDKDRYAQERPDHGRARARDQRWSRSPSEGREHMAHRQGSSSVSGSPAPSTSGTSTPRRGRRQLPQTPSTPRPHVSYSPVIRKAGGSGPPQQQQQQQQQQQQQAVARPGRAATSGPRRYPGPTAEPLAGDRPPTGGHSSGRSPRMERRVPGPARSESPRACRHGGARWPASGPHVSEGPPGPRHHGYYRGSDYDEADGPGSGGGEEAMAGAYDAPPPVRHASSGATGRSPRTPRASGPACASPSRHGRRLPNGYYPAHGLARPRGPGSRKGLHEPYSESDDDWC

SEQ ID NO: 688 - protein, 2339 aa, unidentified [sequence omitted]

SEQ ID NO: 689 - protein, 2221 aa, unidentified
MVNENTRMYIPEENHQGSNYGSPRPAHANMNANAAAGLAPEHIPTPGAALSWQAAIDAARQAKLMGSAGNATISTVSSTQRKRQQYGKPKKQGSTTATRPPRALLCLTLKNPIRRACISIVEWKPFEIIILLTIFANCVALAIYIPFPEDDSNATNSNLERVEYLFLIIFTVEAFLKVIAYGLLFHPNAYLRNGWNLLDFIIVVVGLFSAILEQATKADGANALGGKGAGFDVKALRAFRVLRPLRLVSGVPSLQVVLNSIIKAMVPLLHIALLVLFVIIIYAIIGLELFMGKMHKTCYNQEGIADVPAEDDPSPCALETGHGRQCQNGTVCKPGWDGPKHGITNFDNFAFAMLTVFQCITMEGWTDVLYWVNDAVGRDWPWIYFVTLIIIGSFFVLNLVLGVLSGEFSKEREKAKARGDFQKLREKQQLEEDLKGYLDWITQAEDIDPENEDEGMDEEKPRNMSMPTSETESVNTENVAGGDIEGENCGARLAHRISKSKFSRYWRRWNRFCRRKCRAAVKSNVFYWLVIFLVFLNTLTIASEHYNQPNWLTEVQDTANKALLALFTAEMLLKMYSLGLQAYFVSLFNRFDCFVVCGGILETILVETKIMSPLGISVLRCVRLLRIFKITRYWNSLSNLVASLLNSVRSIASLLLLLFLFIIIFSLLGMQLFGGKFNFDEMQTRRSTFDNFPQSLLTVFQILTGEDWNSVMYDGIMAYGGPSFPGMLVCIYFIILFICGNYILLNVFLAIAVDNLADAESLTSAQKEEEEEKERKKLARTASPEKKQELVEKPAVGESKEEKIELKSITADGESPPATKINMDDLQPNENEDKSPYPNPETTGEEDEEEPEMPVGPRPRPLSELHLKEKAVPMPEASAFFIFSSNNRFRLQCHRIVNDTIFTNLILFFILLSSISLAAEDPVQHTSFRNHILFYFDIVFTTIFTIEIALKILGNADYVFTSIFTLEIILKMTAYGAFLHKGSFCRNYFNILDLLVVSVSLISFGIQSSAINVVKILRVLRVLRPLRAINRAKGLKHVVQCVFVAIRTIGNIVIVTTLLQFMFACIGVQLFKGKLYTCSDSSKQTEAECKGNYITYKDGEVDHPIIQPRSWENSKFDFDNVLAAMMALFTVSTFEGWPELLYRSIDSHTEDKGPIYNYRVEISIFFIIYIIIIAFFMMNIFVGFVIVTFQEQGEQEYKNCELDKNQRQCVEYALKARPLRRYIPKNQHQYKVWYVVNSTYFEYLMFVLILLNTICLAMQHYGQSCLFKIAMNILNMLFTGLFTVEMILKLIAFKPKGYFSDPWNVFDFLIVIGSIIDVILSETNHYFCDAWNTFDALIVVGSIVDIAITEVNPAEHTQCSPSMNAEENSRISITFFRLFRVMRLVKLLSRGEGIRTLLWTFIKSFQALPYVALLIVMLFFIYAVIGMQVFGKIALNDTTEINRNNNFQTFPQAVLLLFRCATGEAWQDIMLACMPGKKCAPESEPSNSTEGETPCGSSFAVFYFISFYMLCAFLIINLFVAVIMDNFDYLTRDWSILGPHHLDEFKRIWAEYDPEAKGRIKHLDVVTLLRRIQPPLGFGKLCPHRVACKRLVSMNMPLNSDGTVMFNATLFALVRTALRIKTEGNLEQANEELRAIIKKIWKRTSMKLLDQVVPPAGDDEVTVGKFYATFLIQEYFRKFKKRKEQGLVGKPSQRNALSLQAGLRTLHDIGPEIRRAISGDLTAEEELDKAMKEAVSAASEDDIFRRAGGLFGNHVSYYQSDGRSAFPQTFTTQRPLHINKAGSSQGDTESPSHEKLVDSTFTPSSYSSTGSNANINNANNTALGRLPRPAGYPSTVSTVEGHGPPLSPAIRVQEVAWKLSSNRERHVPMCEDLELRRDSGSAGTQAHCLLLRKANPSRCHSRESQAAMAGQEETSQDETYEVKMNHDTEACSEPSLLSTEMLSYQDDENRQLTLPEEDKRDIRQSPKRGFLRSASLGRRASFHLECLKRQKDRGGDISQKTVLPLHLVHHQALAVAGLSPLLQRSHSPASFPRPFATPPATPGSRGWPPQPVPTLRLEGVESSEKLNSSFPSIHCGSWAETTPGGGGSSAARRVRPVSLMVPSQAGAPGRQFHGSASSLVEAVLISEGLGQFAQDPKFIEVTTQELADACDMTIEEMESAADNILSGGAPQSPNGALLPFVNCRDAGQDRAGGEEDAGCVRARGRPSEEELQDSRVYVSSL

SEQ ID NO: 690 - protein, 2161 aa, unidentified
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVPSLQVVLNSIIKAMVPLLHIALLVLFVIIIYAIIGLELFIGKMHKTCFFADSDIVAEEDPAPCAFSGNGRQCTANGTECRSGWVGPNGGITNFDNFAFAMLTVFQCITMEGWTDVLYWMNDAMGFELPWVYFVSLVIFGSFFVLNLVLGVLSGEFSKEREKAKARGDFQKLREKQQLEEDLKGYLDWITQAEDIDPENEEEGGEEGKRNTSMPTSETESVNTENVSGEGENRGCCGSLCQAISKSKLSRRWRRWNRFNRRRCRAAVKSVTFYWLVIVLVFLNTLTISSEHYNQPDWLTQIQDIANKVLLALFTCEMLVKMYSLGLQAYFVSLFNRFDCFVVCGGITETILVELEIMSPLGISVFRCVRLLRIFKVTRHWTSLSNLVASLLNSMKSIASLLLLLFLFIIIFSLLGMQLFGGKFNFDETQTKRSTFDNFPQALLTVFQILTGEDWNAVMYDGIMAYGGPSSSGMIVCIYFIILFICGNYILLNVFLAIAVDNLADAESLNTAQKEEAEEKERKKIARKESLENKKNNKPEVNQIANSDNKVTIDDYREEDEDKDPYPPCDVPVGEEEEEEEEDEPEVPAGPRPRRISELNMKEKIAPIPEGSAFFILSKTNPIRVGCHKLINHHIFTNLILVFIMLSSAALAAEDPIRSHSFRNTILGYFDYAFTAIFTVEILLKMTTFGAFLHKGAFCRNYFNLLDMLVVGVSLVSFGIQSSAISVVKILRVLRVLRPLRAINRAKGLKHVVQCVFVAIRTIGNIMIVTTLLQFMFACIGVQLFKGKFYRCTDEAKSNPEECRGLFILYKDGDVDSPVVRERIWQNSDFNFDNVLSAMMALFTVSTFEGWPALLYKAIDSNGENIGPIYNHRVEISIFFIIYIIIVAFFMMNIFVGFVIVTFQEQGEKEYKNCELDKNQRQCVEYALKARPLRRYIPKNPYQYKFWYVVNSSPFEYMMFVLIMLNTLCLAMQHYEQSKMFNDAMDILNMVFTGVFTVEMVLKVIAFKPKGYFSDAWNTFDSLIVIGSIIDVALSEADPTESENVPVPTATPGNSEESNRISITFFRLFRVMRLVKLLSRGEGIRTLLWTFIKSFQALPYVALLIAMLFFIYAVIGMQMFGKVAMRDNNQINRNNNFQTFPQAVLLLFRCATGEAWQEIMLACLPGKLCDPESDYNPGEEYTCGSNFAIVYFISFYMLCAFLIINLFVAVIMDNFDYLTRDWSILGPHHLDEFKRIWSEYDPEAKGRIKHLDVVTLLRRIQPPLGFGKLCPHRVACKRLVAMNMPLNSDGTVMFNATLFALVRTALKIKTEGNLEQANEELRAVIKKIWKKTSMKLLDQVVPPAGDDEVTVGKFYATFLIQDYFRKFKKRKEQGLVGKYPAKNTTIALQAGLRTLHDIGPEIRRAISCDLQDDEPEETKREEEDDVFKRNGALLGNHVNHVNSDRRDSLQQTNTTHRPLHVQRPSIPPASDTEKPLFPPAGNSVCHNHHNHNSIGKQVPTSTNANLNNANMSKAAHGKRPSIGNLEHVSENGHHSSHKHDREPQRRSSVKRTRYYETYIRSDSGDEQLPTICREDPEIHGYFRDPHCLGEQEYFSSEECYEDDSSPTWSRQNYGYYSRYPGRNIDSERPRGYHHPQGFLEDDDSPVCYDSRRSPRRRLLPPTPASHRRSSFNFECLRRQSSQEEVPSSPIFPHRTALPLHLMQQQIMAVAGLDSSKAQKYSPSHSTRSWATPPATPPYRDWTPCYTPLIQVEQSEALDQVNGSLPSLHRSSWYTDEPDISYRTFTPASLTVPSSFRNKNSDKQRSADSLVEAVLISEGLGRYARDPKFVSATKHEIADACDLTIDEMESAASTLLNGNVRPRANGDVGPLSHRQDYELQDFGPGYSDEEPDPGRDEEDLADEMICITTL

SEQ ID NO: 691 - protein, 2313 aa, unidentified
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNNSGILEGFDPPHPCGVQGCPAGYECKDWIGPNDGITQFDNILFAVLTVFQCITMEGWTTVLYNTNDALGATWNWLYFIPLIIIGSFFVLNLVLGVLSGEFAKERERVENRRAFMKLRRQQQIERELNGYRAWIDKAEEVMLAEENKNAGTSALEVLRRATIKRSRTEAMTRDSSDEHCVDISSVGTPLARASIKSAKVDGVSYFRHKERLLRISIRHMVKSQVFYWIVLSLVALNTACVAIVHHNQPQWLTHLLYYAEFLFLGLFLLEMSLKMYGMGPRLYFHSSFNCFDFGVTVGSIFEVVWAIFRPGTSFGISVLRALRLLRIFKITKYWASLRNLVVSLMSSMKSIISLLFLLFLFIVVFALLGMQLFGGRFNFNDGTPSANFDTFPAAIMTVFQILTGEDWNEVMYNGIRSQGGVSSGMWSAIYFIVLTLFGNYTLLNVFLAIAVDNLANAQELTKDEQEEEEAFNQKHALQKAKEVSPMSAPNMPSIERDRRRRHHMSMWEPRSSHLRERRRRHHMSVWEQRTSQLRKHMQMSSQEALNREEAPTMNPLNPLNPLSSLNPLNAHPSLYRRPRAIEGLALGLALEKFEEERISRGGSLKGDGGDRSSALDNQRTPLSLGQREPPWLARPCHGNCDPTQQEAGGGEAVVTFEDRARHRQSQRRSRHRRVRTEGKESSSASRSRSASQERSLDEAMPTEGEKDHELRGNHGAKEPTIQEERAQDLRRTNSLMVSRGSGLAGGLDEADTPLVLPHPELEVGKHVVLTEQEPEGSSEQALLGNVQLDMGRVISQSEPDLSCITANTDKATTESTSVTVAIPDVDPLVDSTVVHISNKTDGEASPLKEAEIREDEEEVEKKKQKKEKRETGKAMVPHSSMFIFSTTNPIRRACHYIVNLRYFEMCILLVIAASSIALAAEDPVLTNSERNKVLRYFDYVFTGVFTFEMVIKMIDQGLILQDGSYFRDLWNILDFVVVVGALVAFALANALGTNKGRDIKTIKSLRVLRVLRPLKTIKRLPKLKAVFDCVVTSLKNVFNILIVYKLFMFIFAVIAVQLFKGKFFYCTDSSKDTEKECIGNYVDHEKNKMEVKGREWKRHEFHYDNIIWALLTLFTVSTGEGWPQVLQHSVDVTEEDRGPSRSNRMEMSIFYVVYFVVFPFFFVNIFVALIIITFQEQGDKMMEECSLEKNERACIDFAISAKPLTRYMPQNRHTFQYRVWHFVVSPSFEYTIMAMIALNTVVLMMKYYSAPCTYELALKYLNIAFTMVFSLECVLKVIAFGFLNYFRDTWNIFDFITVIGSITEIILTDSKLVNTSGFNMSFLKLFRAARLIKLLRQGYTIRILLWTFVQSFKALPYVCLLIAMLFFIYAIIGMQVFGNIKLDEESHINRHNNFRSFFGSLMLLFRSATGEAWQEIMLSCLGEKGCEPDTTAPSGQNENERCGTDLAYVYFVSFIFFCSFLMLNLFVAVIMDNFEYLTRDSSILGPHHLDEFVRVWAEYDRAACGRIHYTEMYEMLTLMSPPLGLGKRCPSKVAYKRLVLMNMPVAEDMTVHFTSTLMALIRTALDIKIAKGGADRQQLDSELQKETLAIWPHLSQKMLDLLVPMPKASDLTVGKIYAAMMIMDYYKQSKVKKQRQQLEEQKNAPMFQRMEPSSLPQEIIANAKALPYLQQDPVSGLSGRSGYPSMSPLSPQDIFQLACMDPADDGQFQERQSLEPEVSELKSVQPSNHGIYLPSDTQEHAGSGRASSMPRLTVDPQVVTDPSSMRRSFSTIRDKRSNSSWLEEFSMERSSENTYKSRRRSYHSSLRLSAHRLNSDSGHKSDTHRSGGRERGRSKERKHLLSPDVSRCNSEERGTQADWESPERRQSRSPSEGRSQTPNRQGTGSLSESSIPSVSDTSTPRRSRRQLPPVPPKPRPLLSYSSLIRHAGSISPPADGSEEGSPLTSQALESNNACLTESSNSPHPQQSQHASPQRYISEPYLALHEDSHASDCGEEETLTFEAAVATSLGRSNTIGSAPPLRHSWQMPNGHYRRRRRGGPGPGMMCGAVNNLLSDTEEDDKC

SEQ ID NO: 692 - protein, 1977 aa, unidentified
MSESEGGKDTTPEPSPANGAGPGPEWGLCPGPPAVEGESSGASGLGTPKRRNQHSKHKTVAVASAQRSPRALFCLTLANPLRRSCISIVEWKPFDILILLTIFANCVALGVYIPFPEDDSNTANHNLEQVEYVFLVIFTVETVLKIVAYGLVLHPSAYIRNGWNLLDFIIVVVGLFSVLLEQGPGRPGDAPHTGGKPGGFDVKALRAFRVLRPLRLVSGVPSLHIVLNSIMKALVPLLHIALLVLFVIIIYAIIGLELFLGRMHKTCYFLGSDMEAEEDPSPCASSGSGRACTLNQTECRGRWPGPNGGITNFDNFFFAMLTVFQCVTMEGWTDVLYWMQDAMGYELPWVYFVSLVIFGSFFVLNLVLGVLSGEFSKEREKAKARGDFQKQREKQQMEEDLRGYLDWITQAEELDMEDPSADDNLGSMAEEGRAGHRPQLAELTNRRRGRLRWFSHSTRSTHSTSSHASLPASDTGSMTETQGDEDEEEGALASCTRCLNKIMKTRVCRRLRRANRVLRARCRRAVKSNACYWAVLLLVFLNTLTIASEHHGQPVWLTQIQEYANKVLLCLFTVEMLLKLYGLGPSAYVSSFFNRFDCFVVCGGILETTLVEVGAMQPLGISVLRCVRLLRIFKVTRHWASLSNLVASLLNSMKSIASLLLLLFLFIIIFSLLGMQLFGGKFNFDQTHTKRSTFDTFPQALLTVFQILTGEDWNVVMYDGIMAYGGPFFPGMLVCIYFIILFICGNYILLNVFLAIAVDNLASGDAGTAKDKGGEKSNEKDLPQENEGLVPGVEKEEEEGARREGADMEEEEEEEEEEEEEEEEEGAGGVELLQEVVPKEKVVPIPEGSAFFCLSQTNPLRKGCHTLIHHHVFTNLILVFIILSSVSLAAEDPIRAHSFRNHILGYFDYAFTSIFTVEILLKMTVFGAFLHRGSFCRSWFNMLDLLVVSVSLISFGIHSSAISVVKILRVLRVLRPLRAINRAKGLKHVVQCVFVAIRTIGNIMIVTTLLQFMFACIGVQLFKGKFYTCTDEAKHTPQECKGSFLVYPDGDVSRPLVRERLWVNSDFNFDNVLSAMMALFTVSTFEGWPALLYKAIDAYAEDHGPIYNYRVEISVFFIVYIIIIAFFMMNIFVGFVIITFRAQGEQEYQNCELDKNQRQCVEYALKAQPLRRYIPKNPHQYRVWATVNSAAFEYLMFLLILLNTVALAMQHYEQTAPFNYAMDILNMVFTGLFTIEMVLKIIAFKPKHYFTDAWNTFDALIVVGSIVDIAVTEVNNGGHLGESSEDSSRISITFFRLFRVMRLVKLLSKGEGIRTLLWTFIKSFQALPYVALLIAMIFFIYAVIGMQMFGKVALQDGTQINRNNNFQTFPQAVLLLFRCATGEAWQEIMLASLPGNRCDPESDFGPGEEFTCGSNFAIAYFISFFMLCAFLIINLFVAVIMDNFDYLTRDWSILGPHHLDEFKRIWSEYDPGAKGRIKHLDVVALLRRIQPPLGFGKLCPHRVACKRLVAMNMPLNSDGTVTFNATLFALVRTSLKIKTEGNLEQANQELRIVIKKIWKRMKQKLLDEVIPPPDEEEVTVGKFYATFLIQDYFRKFRRRKEKGLLGNDAAPSTSSALQAGLRSLQDLGPEMRQALTCDTEEEEEEGQEGVEEEDEKDLETNKATMVSQPSARRGSGISVSLPVGDRLPDSLSFGPSDDDRGTPTSSQPSVPQAGSNTHRRGSGALIFTIPEEGNSQPKGTKGQNKQDEDEEVPDRLSYLDEQAGTPPCSVLLPPHRAQRYMDGHLVPRRRLLPPTPAGRKPSFTIQCLQRQGSCEDLPIPGTYHRGRNSGPNRAQGSWATPPQRGRLLYAPLLLVEEGAAGEGYLGRSSGPLRTFTCLHVPGTHSDPSHGKRGSADSLVEAVLISEGLGLFARDPRFVALAKQEIADACRLTLDEMDNAASDLLAQGTSSLYSDEESILSRFDEEDLGDEMACVHAL

SEQ ID NO: 693 - protein, 2377 aa, unidentified
MDEEEDGAGAEESGQPRSFMRLNDLSGAGGRPGPGSAEKDPGSADSEAEGLPYPALAPVVFFYLSQDSRPRSWCLRTVCNPWFERISMLVILLNCVTLGMFRPCEDIACDSQRCRILQAFDDFIFAFFAVEMVVKMVALGIFGKKCYLGDTWNRLDFFIVIAGMLEYSLDLQNVSFSAVRTVRVLRPLRAINRVPSMRILVTLLLDTLPMLGNVLLLCFFVFFIFGIVGVQLWAGLLRNRCFLPENFSLPLSVDLERYYQTENEDESPFICSQPRENGMRSCRSVPTLRGDGGGGPPCGLDYEAYNSSSNTTCVNWNQYYTNCSAGEHNPFKGAINFDNIGYAWIAIFQVITLEGWVDIMYFVMDAHSFYNFIYFILLIIVGSFFMINLCLVVIATQFSETKQRESQLMREQRVRFLSNASTLASFSEPGSCYEELLKYLVYILRKAARRLAQVSRAAGVRVGLLSSPAPLGGQETQPSSSCSRSHRRLSVHHLVHHHHHHHHHYHLGNGTLRAPRASPEIQDRDANGSRRLMLPPPSTPALSGAPPGGAESVHSFYHADCHLEPVRCQAPPPRSPSEASGRTVGSGKVYPTVHTSPPPETLKEKALVEVAASSGPPTLTSLNIPPGPYSSMHKLLETQSTGACQSSCKISSPCLKADSGACGPDSCPYCARAGAGEVELADREMPDSDSEAVYEFTQDAQHSDLRDPHSRRQRSLGPDAEPSSVLAFWRLICDTFRKIVDSKYFGRGIMIAILVNTLSMGIEYHEQPEELTNALEISNIVFTSLFALEMLLKLLVYGPFGYIKNPYNIFDGVIVVISVWEIVGQQGGGLSVLRTFRLMRVLKLVRFLPALQRQLVVLMKTMDNVATFCMLLMLFIFIFSILGMHLFGCKFASERDGDTLPDRKNFDSLLWAIVTVFQILTQEDWNKVLYNGMASTSSWAALYFIALMTFGNYVLFNLLVAILVEGFQAEEISKREDASGQLSCIQLPVDSQGGDANKSESEPDFFSPSLDGDGDRKKCLALVSLGEHPELRKSLLPPLIIHTAATPMSLPKSTSTGLGEALGPASRRTSSSGSAEPGAAHEMKSPPSARSSPHSPWSAASSWTSRRSSRNSLGRAPSLKRRSPSGERRSLLSGEGQESQDEEESSEEERASPAGSDHRHRGSLEREAKSSFDLPDTLQVPGLHRTASGRGSASEHQDCNGKSASGRLARALRPDDPPLDGDDADDEGNLSKGERVRAWIRARLPACCLERDSWSAYIFPPQSRFRLLCHRIITHKMFDHVVLVIIFLNCITIAMERPKIDPHSAERIFLTLSNYIFTAVFLAEMTVKVVALGWCFGEQAYLRSSWNVLDGLLVLISVIDILVSMVSDSGTKILGMLRVLRLLRTLRPLRVISRAQGLKLVVETLMSSLKPIGNIVVICCAFFIIFGILGVQLFKGKFFVCQGEDTRNITNKSDCAEASYRWVRHKYNFDNLGQALMSLFVLASKDGWVDIMYDGLDAVGVDQQPIMNHNPWMLLYFISFLLIVAFFVLNMFVGVVVENFHKCRQHQEEEEARRREEKRLRRLEKKRRNLMLDDVIASGSSASAASEAQCKPYYSDYSRFRLLVHHLCTSHYLDLFITGVIGLNVVTMAMEHYQQPQILDEALKICNYIFTVIFVLESVFKLVAFGFRRFFQDRWNQLDLAIVLLSIMGITLEEIEVNASLPINPTIIRIMRVLRIARVLKLLKMAVGMRALLDTVMQALPQVGNLGLLFMLLFFIFAALGVELFGDLECDETHPCEGLGRHATFRNFGMAFLTLFRVSTGDNWNGIMKDTLRDCDQESTCYNTVISPIYFVSFVLTAQFVLVNVVIAVLMKHLEESNKEAKEEAELEAELELEMKTLSPQPHSPLGSPFLWPGVEGPDSPDSPKPGALHPAAHARSASHFSLEHPTDRQLFDTISLLIQGSLEWELKLMDELAGPGGQPSAFPSAPSLGGSDPQIPLAEMEALSLTSEIVSEPSCSLALTDDSLPDDMHTLLLSALESNMQPHPTELPGPDLLTVRKSGVSRTHSLPNDSYMCRHGSTAEGPLGHRGWGLPKAQSGSVLSVHSQPADTSYILQLPKDAPHLLQPHSAPTWGTIPKLPPPGRSPLAQRPLRRQAAIRTDSLDVQGLGSREDLLAEVSGPSPPLARAYSFWGQSSTQAQQHSRSHSKISKHMTPPAPCPGPEPNWGKGPPETRSSLELDTELSWISGDLLPPGGQEEPPSPRDLKKCYSVEAQSCQRRPTSWLDEQRRHSIAVSCLDSGSQPHLGTDPSNLGGQPLGGPGSRPKKKLSPPSITIDPPESQGPRTPPSPGICLRRRAPSSDSKDPLASGPPDSMAASPSPKKDVLSLSGLSSDPADLDP

SEQ ID NO: 694 - protein, 2353 aa, unidentified
MTEGARAADEVRVPLGAPPPGPAALVGASPESPGAPGREAERGSELGVSPSESPAAERGAELGADEEQRVPYPALAATVFFCLGQTTRPRSWCLRLVCNPWFEHVSMLVIMLNCVTLGMFRPCEDVECGSERCNILEAFDAFIFAFFAVEMVIKMVALGLFGQKCYLGDTWNRLDFFIVVAGMMEYSLDGHNVSLSAIRTVRVLRPLRAINRVPSMRILVTLLLDTLPMLGNVLLLCFFVFFIFGIVGVQLWAGLLRNRCFLDSAFVRNNNLTFLRPYYQTEEGEENPFICSSRRDNGMQKCSHIPGRRELRMPCTLGWEAYTQPQAEGVGAARNACINWNQYYNVCRSGDSNPHNGAINFDNIGYAWIAIFQVITLEGWVDIMYYVMDAHSFYNFIYFILLIIVGSFFMINLCLVVIATQFSETKQRESQLMREQRARHLSNDSTLASFSEPGSCYEELLKYVGHIFRKVKRRSLRLYARWQSRWRKKVDPSAVQGQGPGHRQRRAGRHTASVHHLVYHHHHHHHHHYHFSHGSPRRPGPEPGACDTRLVRAGAPPSPPSPGRGPPDAESVHSIYHADCHIEGPQERARVAHAAATAAASLRLATGLGTMNYPTILPSGVGSGKGSTSPGPKGKWAGGPPGTGGHGPLSLNSPDPYEKIPHVVGEHGLGQAPGHLSGLSVPCPLPSPPAGTLTCELKSCPYCTRALEDPEGELSGSESGDSDGRGVYEFTQDVRHGDRWDPTRPPRATDTPGPGPGSPQRRAQQRAAPGEPGWMGRLWVTFSGKLRRIVDSKYFSRGIMMAILVNTLSMGVEYHEQPEELTNALEISNIVFTSMFALEMLLKLLACGPLGYIRNPYNIFDGIIVVISVWEIVGQADGGLSVLRTFRLLRVLKLVRFLPALRRQLVVLVKTMDNVATFCTLLMLFIFIFSILGMHLFGCKFSLKTDTGDTVPDRKNFDSLLWAIVTVFQILTQEDWNVVLYNGMASTSSWAALYFVALMTFGNYVLFNLLVAILVEGFQAEGDANRSDTDEDKTSVHFEEDFHKLRELQTTELKMCSLAVTPNGHLEGRGSLSPPLIMCTAATPMPTPKSSPFLDAAPSLPDSRRGSSSSGDPPLGDQKPPASLRSSPCAPWGPSGAWSSRRSSWSSLGRAPSLKRRGQCGERESLLSGEGKGSTDDEAEDGRAAPGPRATPLRRAESLDPRPLRPAALPPTKCRDRDGQVVALPSDFFLRIDSHREDAAELDDDSEDSCCLRLHKVLEPYKPQWCRSREAWALYLFSPQNRFRVSCQKVITHKMFDHVVLVFIFLNCVTIALERPDIDPGSTERVFLSVSNYIFTAIFVAEMMVKVVALGLLSGEHAYLQSSWNLLDGLLVLVSLVDIVVAMASAGGAKILGVLRVLRLLRTLRPLRVISRAPGLKLVVETLISSLRPIGNIVLICCAFFIIFGILGVQLFKGKFYYCEGPDTRNISTKAQCRAAHYRWVRRKYNFDNLGQALMSLFVLSSKDGWVNIMYDGLDAVGVDQQPVQNHNPWMLLYFISFLLIVSFFVLNMFVGVVVENFHKCRQHQEAEEARRREEKRLRRLERRRRSTFPSPEAQRRPYYADYSPTRRSIHSLCTSHYLDLFITFIICVNVITMSMEHYNQPKSLDEALKYCNYVFTIVFVFEAALKLVAFGFRRFFKDRWNQLDLAIVLLSLMGITLEEIEMSAALPINPTIIRIMRVLRIARVLKLLKMATGMRALLDTVVQALPQVGNLGLLFMLLFFIYAALGVELFGRLECSEDNPCEGLSRHATFSNFGMAFLTLFRVSTGDNWNGIMKDTLRECSREDKHCLSYLPALSPVYFVTFVLVAQFVLVNVVVAVLMKHLEESNKEAREDAELDAEIELEMAQGPGSARRVDADRPPLPQESPGARDAPNLVARKVSVSRMLSLPNDSYMFRPVVPASAPHPRPLQEVEMETYGAGTPLGSVASVHSPPAESCASLQIPLAVSSPARSGEPLHALSPRGTARSPSLSRLLCRQEAVHTDSLEGKIDSPRDTLDPAEPGEKTPVRPVTQGGSLQSPPRSPRPASVRTRKHTFGQRCVSSRPAAPGGEEAEASDPADEEVSHITSSACPWQPTAEPHGPEASPVAGGERDLRRLYSVDAQGFLDKPGRADEQWRPSAELGSGEPGEAKAWGPEAEPALGARRKKKMSPPCISVEPPAEDEGSARPSAAEGGSTTLRRRTPSCEATPHRDSLEPTEGSGAGGDPAAKGERWGQASCRAEHLTVPSFAFEPLDLGVPSGDPFLDGSHSVTPESRASSSGAIVPLEPPESEPPMPVGDPPEKRRGLYLTVPQCPLEKPGSPSATPAPGGGADDPV

SEQ ID NO: 695 - protein, 2223 aa, unidentified
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPPYYQPEEDDEMPFICSLSGDNGIMGCHEIPPLKEQGRECCLSKDDVYDFGAGRQDLNASGLCVNWNRYYNVCRTGSANPHKGAINFDNIGYAWIVIFQVITLEGWVEIMYYVMDAHSFYNFIYFILLIIVGSFFMINLCLVVIATQFSETKQREHRLMLEQRQRYLSSSTVASYAEPGDCYEEIFQYVCHILRKAKRRALGLYQALQSRRQALGPEAPAPAKPGPHAKEPRHYHGKTKGQGDEGRHLGSRHCQTLHGPASPGNDHSGRELCPQHSPLDATPHTLVQPIPATLASDPASCPCCQHEDGRRPSGLGSTDSGQEGSGSGSSAGGEDEADGDGARSSEDGASSELGKEEEEEEQADGAVWLCGDVWRETRAKLRGIVDSKYFNRGIMMAILVNTVSMGIEHHEQPEELTNILEICNVVFTSMFALEMILKLAAFGLFDYLRNPYNIFDSIIVIISIWEIVGQADGGLSVLRTFRLLRVLKLVRFMPALRRQLVVLMKTMDNVATFCMLLMLFIFIFSILGMHIFGCKFSLRTDTGDTVPDRKNFDSLLWAIVTVFQILTQEDWNVVLYNGMASTSPWASLYFVALMTFGNYVLFNLLVAILVEGFQAEGDANRSYSDEDQSSSNIEEFDKLQEGLDSSGDPKLCPIPMTPNGHLDPSLPLGGHLGPAGAAGPAPRLSLQPDPMLVALGSRKSSVMSLGRMSYDQRSLSSSRSSYYGPWGRSAAWASRRSSWNSLKHKPPSAEHESLLSAERGGGARVCEVAADEGPPRAAPLHTPHAHHIHHGPHLAHRHRHHRRTLSLDNRDSVDLAELVPAVGAHPRAAWRAAGPAPGHEDCNGRMPSIAKDVFTKMGDRGDRGEDEEEIDYTLCFRVRKMIDVYKPDWCEVREDWSVYLFSPENRFRVLCQTIIAHKLFDYVVLAFIFLNCITIALERPQIEAGSTERIFLTVSNYIFTAIFVGEMTLKVVSLGLYFGEQAYLRSSWNVLDGFLVFVSIIDIVVSLASAGGAKILGVLRVLRLLRTLRPLRVISRAPGLKLVVETLISSLKPIGNIVLICCAFFIIFGILGVQLFKGKFYHCLGVDTRNITNRSDCMAANYRWVHHKYNFDNLGQALMSLFVLASKDGWVNIMYNGLDAVAVDQQPVTNHNPWMLLYFISFLLIVSFFVLNMFVGVVVENFHKCRQHQEAEEARRREEKRLRRLEKKRRKAQRLPYYATYCHTRLLIHSMCTSHYLDIFITFIICLNVVTMSLEHYNQPTSLETALKYCNYMFTTVFVLEAVLKLVAFGLRRFFKDRWNQLDLAIVLLSVMGITLEEIEINAALPINPTIIRIMRVLRIARVLKLLKMATGMRALLDTVVQALPQVGNLGLLFMLLFFIYAALGVELFGKLVCNDENPCEGMSRHATFENFGMAFLTLFQVSTGDNWNGIMKDTLRDCTHDERSCLSSLQFVSPLYFVSFVLTAQFVLINVVVAVLMKHLDDSNKEAQEDAEMDAELELEMAHGLGPGPRLPTGSPGAPGRGPGGAGGGGDTEGGLCRRCYSPAQENLWLDSVSLIIKDSLEGELTIIDNLSGSIFHHYSSPAGCKKCHHDKQEVQLAETEAFSLNSDRSSSILLGDDLSLEDPTACPPGRKDSKGELDPPEPMRVGDLGECFFPLSSTAVSPDPENFLCEMEEIPFNPVRSWLKHDSSQAPPSPFSPDASSPLLPMPAEFFHPAVSASQKGPEKGTGTGTLPKIALQGSWASLRSPRVNCTLLRQATGSDTSLDASPSSSAGSLQTTLEDSLTLSDSPRRALGPPAPAPGPRAGLSPAARRRLSLRGRGLFSLRGLRAHQRSHSSGGSTSPGCTHHDSMDPSDEEGRGGAGGGGAGSEHSETLSSLSLTSLFCPPPPPPAPGLTPARKFSSTSSLAAPGRPHAAALAHGLARSPSWAADRSKDPPGRAPLPMGLGPLAPPPQPLPGELEPGDAASKRKR

SEQ ID NO: 696 - protein, 1873 aa, unidentified
MEPSSPQDEGLRKKQPKKPVPEILPRPPRALFCLTLENPLRKACISIVEWKPFETIILLTIFANCVALAVYLPMPEDDNNSLNLGLEKLEYFFLIVFSIEAAMKIIAYGFLFHQDAYLRSGWNVLDFTIVFLGVFTVILEQVNVIQSHTAPMSSKGAGLDVKALRAFRVLRPLRLVSGVPSLQVVLNSIFKAMLPLFHIALLVLFMVIIYAIIGLELFKGKMHKTCYFIGTDIVATVENEEPSPCARTGSGRRCTINGSECRGGWPGPNHGITHFDNFGFSMLTVYQCITMEGWTDVLYWVNDAIGNEWPWIYFVTLILLGSFFILNLVLGVLSGEFTKEREKAKSRGTFQKLREKQQLDEDLRGYMSWITQGEVMDVEDFREGKLSLDEGGSDTESLYEIAGLNKIIQFIRHWRQWNRIFRWKCHDIVKSKVFYWLVILIVALNTLSIASEHHNQPLWLTRLQDIANRVLLSLFTTEMLMKMYGLGLRQYFMSIFNRFDCFVVCSGILEILLVESGAMTPLGISVLRCIRLLRIFKITKYWTSLSNLVASLLNSIRSIASLLLLLFLFIVIFALLGMQLFGGRYDFEDTEVRRSNFDNFPQALISVFQVLTGEDWTSMMYNGIMAYGGPSYPGMLVCIYFIILFVCGNYILLNVFLAIAVDNLAEAESLTSAQKAKAEEKKRRKMSKGLPDKSEEEKSTMAKKLEQKPKGEGIPTTAKLKIDEFESNVNEVKDPYPSADFPGDDEEDEPEIPLSPRPRPLAELQLKEKAVPIPEASSFFIFSPTNKIRVLCHRIVNATWFTNFILLFILLSSAALAAEDPIRADSMRNQILKHFDIGFTSVFTVEIVLKMTTYGAFLHKGSFCRNYFNMLDLLVVAVSLISMGLESSAISVVKILRVLRVLRPLRAINRAKGLKHVVQCMFVAISTIGNIVLVTTLLQFMFACIGVQLFKGKFFRCTDLSKMTEEECRGYYYVYKDGDPMQIELRHREWVHSDFHFDNVLSAMMSLFTVSTFEGWPQLLYKAIDSNAEDVGPIYNNRVEMAIFFIIYIILIAFFMMNIFVGFVIVTFQEQGETEYKNCELDKNQRQCVQYALKARPLRCYIPKNPYQYQVWYIVTSSYFEYLMFALIMLNTICLGMQHYNQSEQMNHISDILNVAFTIIFTLEMILKLMAFKARGYFGDPWNVFDFLIVIGSIIDVILSEIDTFLASSGGLYCLGGGCGNVDPDESARISSAFFRLFRVMRLIKLLSRAEGVRTLLWTFIKSFQALPYVALLIVMLFFIYAVIGMQMFGKIALVDGTQINRNNNFQTFPQAVLLLFRCATGEAWQEILLACSYGKLCDPESDYAPGEEYTCGTNFAYYYFISFYMLCAFLVINLFVAVIMDNFDYLTRDWSILGPHHLDEFKAIWAEYDPEAKGRIKHLDVVTLLRRIQPPLGFGKFCPHRVACKRLVGMNMPLNSDGTVTFNATLFALVRTALKIKTEGNFEQANEELRAIIKKIWKRTSMKLLDQVIPPIGDDEVTVGKFYATFLIQEHFRKFMKRQEEYYGYRPKKDIVQIQAGLRTIEEEAAPEICRTVSGDLAAEEELERAMVEAAMEEGIFRRTGGLFGQVDNFLERTNSLPPVMANQRPLQFAEIEMEEMESPVFLEDFPQDPRTNPLARANTNNANANVAYGNSNHSNSHVFSSVHYEREFPEETETPATRGRALGQPCRVLGPHSKPCVEMLKGLLTQRAMPRGQAPPAPCQCPRVESSMPEDRKSSTPGSLHEETPHSRSTRENTSRCSAPATALLIQKALVRGGLGTLAADANFIMATGQALADACQMEPEEVEIMATELLKGREAPEGMASSLGCLNLGSSLGSLDQHQGSQETLIPPRL

SEQ ID NO: 697 - protein, 1103 aa, unidentified
MAAGCLLALTLTLFQSLLIGPSSEEPFPSAVTIKSWVDKMQEDLVTLAKTASGVNQLVDIYEKYQDLYTVEPNNARQLVEIAARDIEKLLSNRSKALVRLALEAEKVQAAHQWREDFASNEVVYYNAKDDLDPEKNDSEPGSQRIKPVFIEDANFGRQISYQHAAVHIPTDIYEGSTIVLNELNWTSALDEVFKKNREEDPSLLWQVFGSATGLARYYPASPWVDNSRTPNKIDLYDVRRRPWYIQGAASPKDMLILVDVSGSVSGLTLKLIRTSVSEMLETLSDDDFVNVASFNSNAQDVSCFQHLVQANVRNKKVLKDAVNNITAKGITDYKKGFSFAFEQLLNYNVSRANCNKIIMLFTDGGEERAQEIFNKYNKDKKVRVFTFSVGQHNYDRGPIQWMACENKGYYYEIPSIGAIRINTQEYLDVLGRPMVLAGDKAKQVQWTNVYLDALELGLVITGTLPVFNITGQFENKTNLKNQLILGVMGVDVSLEDIKRLTPRFTLCPNGYYFAIDPNGYVLLHPNLQPKPIGVGIPTINLRKRRPNIQNPKSQEPVTLDFLDAELENDIKVEIRNKMIDGESGEKTFRTLVKSQDERYIDKGNRTYTWTPVNGTDYSLALVLPTYSFYYIKAKLEETITQARYSETLKPDNFEESGYTFIAPRDYCNDLKISDNNTEFLLNFNEFIDRKTPNNPSCNADLINRVLLDAGFTNELVQNYWSKQKNIKGVKARFVVTDGGITRVYPKEAGENWQENPETYEDSFYKRSLDNDNYVFTAPYFNKSGPGAYESGIMVSKAVEIYIQGKLLKPAVVGIKIDVNSWIENFTKTSIRDPCAGPVCDCKRNSDVMDCVILDDGGFLLMANHDDYTNQIGRFFGEIDPSLMRHLVNISVYAFNKSYDYQSVCEPGAAPKQGAGHRSAYVPSVADILQIGWWATAAAWSILQQFLLSLTFPRLLEAVEMEDDDFTASLSKQSCITEQTQYFFDNDSKSFSGVLDCGNCSRIFHGEKLMNTNLIFIMVESKGTCPCDTRLLIQAEQTSDGPNPCDMVKQPRYRKGPDVCFDNNVLEDYTDCGGVSGLNPSLWYIIGIQFLLLWLVSGSTHRLL

SEQ ID NO: 698 - protein, 1091 aa, unidentified
MAGPGSPRRASRGASALLAAALLYAALGDVVRSEQQIPLSVVKLWASAFGGEIKSIAAKYSGSQLLQKKYKEYEKDVAIEEIDGLQLVKKLAKNMEEMFHKKSEAVRRLVEAAEEAHLKHEFDADLQYEYFNAVLINERDKDGNFLELGKEFILAPNDHFNNLPVNISLSDVQVPTNMYNKDPAIVNGVYWSESLNKVFVDNFDRDPSLIWQYFGSAKGFFRQYPGIKWEPDENGVIAFDCRNRKWYIQAATSPKDVVILVDVSGSMKGLRLTIAKQTVSSILDTLGDDDFFNIIAYNEELHYVEPCLNGTLVQADRTNKEHFREHLDKLFAKGIGMLDIALNEAFNILSDFNHTGQGSICSQAIMLITDGAVDTYDTIFAKYNWPDRKVRIFTYLIGREAAFADNLKWMACANKGFFTQISTLADVQENVMEYLHVLSRPKVIDQEHDVVWTEAYIDSTLPQAQKLTDDQGPVLMTTVAMPVFSKQNETRSKGILLGVVGTDVPVKELLKTIPKYKLGIHGYAFAITNNGYILTHPELRLLYEEGKKRRKPNYSSVDLSEVEWEDRDDVLRNAMVNRKTGKFSMEVKKTVDKGKRVLVMTNDYYYTDIKGTPFSLGVALSRGHGKYFFRGNVTIEEGLHDLEHPDVSLADEWSYCNTDLHPEHRHLSQLEAIKLYLKGKEPLLQCDKELIQEVLFDAVVSAPIEAYWTSLALNKSENSDKGVEVAFLGTRTGLSRINLFVGAEQLTNQDFLKAGDKENIFNADHFPLWYRRAAEQIPGSFVYSIPFSTGPVNKSNVVTASTSIQLLDERKSPVVAAVGIQMKLEFFQRKFWTASRQCASLDGKCSISCDDETVNCYLIDNNGFILVSEDYTQTGDFFGEIEGAVMNKLLTMGSFKRITLYDYQAMCRANKESSDGAHGLLDPYNAFLSAVKWIMTELVLFLVEFNLCSWWHSDMTAKAQKLKQTLEPCDTEYPAFVSERTIKETTGNIACEDCSKSFVIQQIPSSNLFMVVVDSSCLCESVAPITMAPIEIRYNESLKCERLKAQKIRRRPESCHGFHPEENARECGGAPSLQAQTVLLLLPLLLMLFSR

SEQ ID NO: 699 - protein, 1137 aa, unidentified
MVCGCSALLPLPNPRPTMPATPNFLANPSSSSRWIPLQPMPVAWAFVQKTSALLWLLLLGTSLSPAWGQAKIPLETVKLWADTFGGDLYNTVTKYSGSLLLQKKYKDVESSLKIEEVDGLELVRKFSEDMENMLRRKVEAVQNLVEAAEEADLNHEFNESLVFDYYNSVLINERDEKGNFVELGAEFLLESNAHFSNLPVNTSISSVQLPTNVYNKDPDILNGVYMSEALNAVFVENFQRDPTLTWQYFGSATGFFRIYPGIKWTPDENGVITFDCRNRGWYIQAATSPKDIVILVDVSGSMKGLRMTIAKHTITTILDTLGENDFINIIAYNDYVHYIEPCFKGILVQADRDNREHFKLLVEELMVKGVGVVDQALREAFQILKQFQEAKQGSLCNQAIMLISDGAVEDYEPVFEKYNWPDCKVRVFTYLIGREVSFADRMKWIACNNKGYYTQISTLADTQENVMEYLHVLSRPMVINHDHDIIWTEAYMDSKLLSSQAQSLTLLTTVAMPVFSKKNETRSHGILLGVVGSDVALRELMKLAPRYKLGVHGYAFLNTNNGYILSHPDLRPLYREGKKLKPKPNYNSVDLSEVEWEDQAESLRTAMINRETGTLSMDVKVPMDKGKRVLFLTNDYFFTDISDTPFSLGVVLSRGHGEYILLGNTSVEEGLHDLLHPDLALAGDWIYCITDIDPDHRKLSQLEAMIRFLTRKDPDLECDEELVREVLFDAVVTAPMEAYWTALALNMSEESEHVVDMAFLGTRAGLLRSSLFVGSEKVSDRKFLTPEDEASVFTLDRFPLWYRQASEHPAGSFVFNLRWAEGPESAGEPMVVTASTAVAVTVDKRTAIAAAAGVQMKLEFLQRKFWAATRQCSTVDGPCTQSCEDSDLDCFVIDNNGFILISKRSRETGRFLGEVDGAVLTQLLSMGVFSQVTMYDYQAMCKPSSHHHSAAQPLVSPISAFLTATRWLLQELVLFLLEWSVWGSWYDRGAEAKSVFHHSHKHKKQDPLQPCDTEYPVFVYQPAIREANGIVECGPCQKVFVVQQIPNSNLLLLVTDPTCDCSIFPPVLQEATEVKYNASVKCDRMRSQKLRRRPDSCHAFHPEENAQDCGGASDTSASPPLLLLPVCAWGLLPQLLR

SEQ ID NO: 700 - protein, 520 aa, unidentified
MSSSSYAKNGTADGPHSPTSQVARGTTTRRSRLKRSDGSTTSTSFILRQGSADSYTSRPSDSDVSLEEDREAIRQEREQQAAIQLERAKSKPVAFAVKTNVSYCGALDEDVPVPSTAISFDAKDFLHIKEKYNNDWWIGRLVKEGCEIGFIPSPLRLENIRIQQEQKRGRFHGGKSSGNSSSSLGEMVSGTFRATPTSTAKQKQKVTEHIPPYDVVPSMRPVVLVGPSLKGYEVTDMMQKALFDFLKHRFDGRISITRVTADISLAKRSVLNNPSKRAIIERSNTRSSLAEVQSEIERIFELARSLQLVVLDADTINHPAQLIKTSLAPIIVHVKVSSPKVLQRLIKSRGKSQSKHLNVQLVAADKLAQCPPEMFDVILDENQLEDACEHLGEYLEAYWRATHTTSSTPMTPLLGRNLGSTALSPYPTAISGLQSQRMRHSNHSTENSPIERRSLMTSDENYHNERARKSRNRLSSSSQHSRDHYPLVEEDYPDSYQDTYKPHRNRGSPGGYSHDSRHRL

SEQ ID NO: 701 - protein, 222 aa, unidentified
MSQTKMLKVRVTLFCILAGIVLAMTAVVTDHWAVLSPHMEHHNTTCEAAHFGLWRICTKRIPMDDSKTCGPITLPGEKNCSYFRHFNPGESSEIFEFTTQKEYSISAAAIAIFSLGFIILGSLCVLLSLGKKRDYLLRPASMFYAFAGLCILVSVEVMRQSVKRMIDSEDTVWIEYYYSWSFACACAAFILLFLGGLALLLFSLPRMPRNPWESCMDAEPEH

SEQ ID NO: 702 - protein, 323 aa, unidentified
MGLFDRGVQMLLTTVGAFAAFSLMTIAVGTDYWLYSRGVCKTKSVSENETSKKNEEVMTHSGLWRTCCLEGNFKGLCKQIDHFPEDADYEADTAEYFLRAVRASSIFPILSVILLFMGGLCIAASEFYKTRHNIILSAGIFFVSAGLSNIIGIIVYISANAGDPSKSDSKKNSYSYGWSFYFGALSFIIAEMVGVLAVHMFIDRHKQLRATARATDYLQASAITRIPSYRYRYQRRSRSSSRSTEPSHSRDASPVGIKGFNTLPSTEISMYTLSRDPLKAATTPTATYNSDRDNSFLQVHNCIQKENKDSLHSNTANRRTTPV

SEQ ID NO: 703 - protein, 315 aa, unidentified
MRMCDRGIQMLITTVGAFAAFSLMTIAVGTDYWLYSRGVCRTKSTSDNETSRKNEEVMTHSGLWRTCCLEGAFRGVCKKIDHFPEDADYEQDTAEYLLRAVRASSVFPILSVTLLFFGGLCVAASEFHRSRHNVILSAGIFFVSAGLSNIIGIIVYISANAGDPGQRDSKKSYSYGWSFYFGAFSFIIAEIVGVVAVHIYIEKHQQLRAKSHSEFLKKSTFARLPPYRYRFRRRSSSRSTEPRSRDLSPISKGFHTIPSTDISMFTLSRDPSKITMGTLLNSDRDHAFLQFHNSTPKEFKESLHNNPANRRTTPV

SEQ ID NO: 704 - protein, 327 aa, unidentified
MVRCDRGLQMLLTTAGAFAAFSLMAIAIGTDYWLYSSAHICNGTNLTMDDGPPPRRARGDLTHSGLWRVCCIEGIYKGHCFRINHFPEDNDYDHDSSEYLLRIVRASSVFPILSTILLLLGGLCIGAGRIYSRKNNIVLSAGILFVAAGLSNIIGIIVYISSNTGDPSDKRDEDKKNHYNYGWSFYFGALSFIVAETVGVLAVNIYIEKNKELRFKTKREFLKASSSSPYARMPSYRYRRRRSRSSSRSTEASPSRDVSPMGLKITGAIPMGELSMYTLSREPLKVTTAASYSPDQEASFLQVHDFFQQDLKEGFHVSMLNRRTTPV

SEQ ID NO: 705 - protein, 275 aa, unidentified
MSACGRKALTLLSSVFAVCGLGLLGIAVSTDYWLYLEEGVIVPQNQSTEIKMSLHSGLWRVCFLAGEERGRCFTIEYVMPMNTQLTSESTVNVLKMIRSATPFPLVSLFFMFIGFILNNIGHIRPHRTILAFVSGIFFILSGLSLVVGLVLYISSINDEMLNRTKDAETYFNYKYGWSFAFAAISFLLTESAGVMSVYLFMKRYTAEDMYRPHPGFYRPRLSNCSDYSGQFLHPDAWVRGRSPSDISSEASLQMNSNYPALLKCPDYDQMSSSPC

SEQ ID NO: 706 - protein, 189 aa, unidentified
MMWSNFFLQEENRRRGAAGRRRAHGQGRSGLTPEREGKVKLALLLAAVGATLAVLSVGTEFWVELNTYKANGSAVCEAAHLGLWKACTKRLWQADVPVDRDTCGPAELPGGLLLLVSLEVFRHSVRALLQRVSPEPPPAPRLTYEYSWSLGCGVGAGLILLLGAGCFLLLTLPSWPWGSLCPKRGHRAT

SEQ ID NO: 707 - protein, 275 aa, unidentified
MSHCSSRALTLLSSVFGACGLLLVGIAVSTDYWLYMEEGTVLPQNQTTEVKMALHAGLWRVCFFAGREKGRCVASEYFLEPEINLVTENTENILKTVRTATPFPMVSLFLVFTAFVISNIGHIRPQRTILAFVSGIFFILSGLSLVVGLVLYISSINDEVMNRPSSSEQYFHYRYGWSFAFAASSFLLKEGAGVMSVYLFTKRYAEEEMYRPHPAFYRPRLSDCSDYSGQFLQPEAWRRGRSPSDISSDVSIQMTQNYPPAIKYPDHLHISTSPC

SEQ ID NO: 708 - protein, 425 aa, unidentified
MESLKRWNEERGLWCEKGVQVLLTTVGAFAAFGLMTIAISTDYWLYTRALICNTTNLTAGGDDGTPHRGGGGASEKKDPGGLTHSGLWRICCLEGLKRGVCVKINHFPEDTDYDHDSAEYLLRVVRASSIFPILSAILLLLGGVCVAASRVYKSKRNIILGAGILFVAAGLSNIIGVIVYISANAGEPGPKRDEEKKNHYSYGWSFYFGGLSFILAEVIGVLAVNIYIERSREAHCQSRSDLLKAGGGAGGSGGSGPSAILRLPSYRFRYRRRSRSSSRSSEPSPSRDASPGGPGGPGFASTDISMYTLSRDPSKGSVAAGLAGAGGGGGGAVGAFGGAAGGAGGGGGGGGGAGAERDRGGASGFLTLHNAFPKEAGGGVTVTVTGPPAPPAPAPPAPSAPAPGTLAKEAAASNTNTLNRKTTPV

SEQ ID NO: 709 - protein, 442 aa, unidentified
MASVVLPSGSQCAAAAAAAAPPGLRLRLLLLLFSAAALIPTGDGQNLFTKDVTVIEGEVATISCQVNKSDDSVIQLLNPNRQTIYFRDFRPLKDSRFQLLNFSSSELKVSLTNVSISDEGRYFCQLYTDPPQESYTTITVLVPPRNLMIDIQKDTAVEGEEIEVNCTAMASKPATTIRWFKGNTELKGKSEVEEWSDMYTVTSQLMLKVHKEDDGVPVICQVEHPAVTGNLQTQRYLEVQYKPQVHIQMTYPLQGLTREGDALELTCEAIGKPQPVMVTWVRVDDEMPQHAVLSGPNLFINNLNKTDNGTYRCEASNIVGKAHSDYMLYVYDPPTTIPPPTTTTTTTTTTTTTILTIITDSRAGEEGSIRAVDHAVIGGVVAVVVFAMLCLLIILGRYFARHKGTYFTHEAKGADDAADADTAIINAEGGQNNSEEKKEYFI

SEQ ID NO: 710 - protein, 435 aa, unidentified
MIWKRSAVLRFYSVCGLLLQGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKDVKYLKEEDANRKTFTVSSTLDFRVDRSDDGVAVICRVDHESLNATPQVAMQVLEIHYTPSVKIIPSTPFPQEGQPLILTCESKGKPLPEPVLWTKDGGELPDPDRMVVSGRELNILFLNKTDNGTYRCEATNTIGQSSAEYVLIVHDVPNTLLPTTIIPSLTTATVTTTVAITTSPTTSATTSSIRDPNALAGQNGPDHALIGGIVAVVVFVTLCSIFLLGRYLARHKGTYLTNEAKGAEDAPDADTAIINAEGSQVNAEEKKEYFI

SEQ ID NO: 711 - protein, 398 aa, unidentified
MGAPAASLLLLLLLFACCWAPGGANLSQDDSQPWTSDETVVAGGTVVLKCQVKDHEDSSLQWSNPAQQTLYFGEKRALRDNRIQLVTSTPHELSISISNVALADEGEYTCSIFTMPVRTAKSLVTVLGIPQKPIITGYKSSLREKDTATLNCQSSGSKPAARLTWRKGDQELHGEPTRIQEDPNGKTFTVSSSVTFQVTREDDGASIVCSVNHESLKGADRSTSQRIEVLYTPTAMIRPDPPHPREGQKLLLHCEGRGNPVPQQYLWEKEGSVPPLKMTQESALIFPFLNKSDSGTYGCTATSNMGSYKAYYTLNVNDPSPVPSSSSTYHAIIGGIVAFIVFLLLIMLIFLGHYLIRHKGTYLTHEAKGSDDAPDADTAIINAEGGQSGGDDKKEYFI

SEQ ID NO: 712 - protein, 388 aa, unidentified
MGRARRFQWPLLLLWAAAAGPGAGQEVQTENVTVAEGGVAEITCRLHQYDGSIVVIQNPARQTLFFNGTRALKDERFQLEEFSPRRVRIRLSDARLEDEGGYFCQLYTEDTHHQIATLTVLVAPENPVVEVREQAVEGGEVELSCLVPRSRPAATLRWYRDRKELKGVSSSQENGKVWSVASTVRFRVDRKDDGGIIICEAQNQALPSGHSKQTQYVLDVQYSPTARIHASQAVVREGDTLVLTCAVTGNPRPNQIRWNRGNESLPERAEAVGETLTLPGLVSADNGTYTCEASNKHGHARALYVLVVYDPGAVVEAQTSVPYAIVGGILALLVFLIICVLVGMVWCSVRQKGSYLTHEASGLDEQGEAREAFLNGSDGHKRKEEFFI

SEQ ID NO: 713 - protein, 461 aa, unidentified
MEKKCTLNFLVLLPFFMILVTAELEESPEDSIQLGVTRNKIMTAQYECYQKIMQDPIQQAEGVYCNRTWDGWLCWNDVAAGTESMQLCPDYFQDFDPSEKVTKICDQDGNWFRHPASNRTWTNYTQCNVNTHEKVKTALNLFYLTIIGHGLSIASLLISLGIFFYFKSLSCQRITLHKNLFFSFVCNSVVTIIHLTAVANNQALVATNPVSCKVSQFIHLYLMGCNYFWMLCEGIYLHTLIVVAVFAEKQHLMWYYFLGWGFPLIPACIHAIARSLYYNDNCWISSDTHLLYIIHGPICAALLVNLFFLLNIVRVLITKLKVTHQAESNLYMKAVRATLILVPLLGIEFVLIPWRPEGKIAEEVYDYIMHILMHFQGLLVSTIFCFFNGEVQAILRRNWNQYKIQFGNSFSNSEALRSASYTVSTISDGPGYSHDCPSEHLNGKSIHDIENVLLKPENLYN

SEQ ID NO: 714 - protein, 346 aa, unidentified
MMDKFRMIFQFLQSNQESFMNGICGIMALASAQMYSAFDFNCPCLPGYNAAYSAGILLAPPLVLFLLGLVMNNNVSMLAEEWKRPLGRRAKDPAVLRYMFCSMAQRALIAPVVWVAVTLLDGKCFLCAFCTAVPVSALGNGSLAPGLPAPELARLLARVPCPEIYDGDWLLAREVAVRYLRCISQALGWSFVLLTTLLAFVVRSVRPCFTQAAFLKSKYWSHYIDIERKLFDETCTEHAKAFAKVCIQQFFEAMNHDLELGHTHGTLATAPASAAAPTTPDGAEEEREKLRGITDQGTMNRLLTSWHKCKPPLRLGQEEPPLMGNGWAGGGPRPPRKEVATYFSKV

SEQ ID NO: 715 - protein, 323 aa, unidentified
MAALIAENFRFLSLFFKSKDVMIFNGLVALGTVGSQELFSVVAFHCPCSPARNYLYGLAAIGVPALVLFIIGIILNNHTWNLVAECQHRRTKNCSAAPTFLLLSSILGRAAVAPVTWSVISLLRGEAYVCALSEFVDPSSLTAREEHFPSAHATEILARFPCKENPDNLSDFREEVSRRLRYESQLFGWLLIGVVAILVFLTKCLKHYCSPLSYRQEAYWAQYRANEDQLFQRTAEVHSRVLAANNVRRFFGFVALNKDDEELIANFPVEGTQPRPQWNAITGVYLYRENQGLPLYSRLHKWAQGLAGNGAAPDNVEMALLPS

SEQ ID NO: 716 - protein, 344 aa, unidentified
MDKFRMLFQHFQSSSESVMNGICLLLAAVTVKLYSSFDFNCPCLVHYNALYGLGLLLTPPLALFLCGLLANRQSVVMVEEWRRPAGHRRKDPGIIRYMCSSVLQRALAAPLVWILLALLDGKCFVCAFSSSVDPEKFLDFANMTPSQVQLFLAKVPCKEDELVRDSPARKAVSRYLRCLSQAIGWSVTLLLIIAAFLARCLRPCFDQTVFLQRRYWSNYVDLEQKLFDETCCEHARDFAHRCVLHFFASMRSELQARGLRRGNAGRRLELPAVPEPPEGLDSGSGKAHLRAISSREQVDRLLSTWYSSKPPLDLAASPGLCGGGLSHRAPTLALGTRLSQHTDV

SEQ ID NO: 717 - protein, 219 aa, unidentified
MPFHHVTAGLLYKGNYLNRSLSAGSDSEQLANISVEELDEIREAFRVLDRDGNGFISKQELGMAMRSLGYMPSEVELAIIMQRLDMDGDGQVDFDEFMTILGPKLVSSEGRDGFLGNTIDSIFWQFDMQRITLEELKHILYHAFRDHLTMKDIENIIINEEESLNETSGNCQTEFEGVHSQKQNRQTCVRKSLICAFAMAFIISVMLIAANQILRSGME

SEQ ID NO: 718 - protein, 217 aa, unidentified
MVKLGCSFSGKPGKDPGDQDGAAMDSVPLISPLDISQLQPPLPDQVVIKTQTEYQLSSPDQQNFPDLEGQRLNCSHPEEGRRLPTARMIAFAMALLGCVLIMYKAIWYDQFTCPDGFLLRHKICTPLTLEMYYTEMDPERHRSILAAIGAYPLSRKHGTETPAAWGDGYRAAKEERKGPTQAGAAAAATEPPGKPSAKAEKEAARKAAGSAAPPPAQ

SEQ ID NO: 719 - protein, 370 aa, unidentified
MLGAVEGPRWKQAEDIRDIYDFRDVLGTGAFSEVILAEDKRTQKLVAIKCIAKEALEGKEGSMENEIAVLHKIKHPNIVALDDIYESGGHLYLIMQLVSGGELFDRIVEKGFYTERDASRLIFQVLDAVKYLHDLGIVHRDLKPENLLYYSLDEDSKIMISDFGLSKMEDPGSVLSTACGTPGYVAPEVLAQKPYSKAVDCWSIGVIAYILLCGYPPFYDENDAKLFEQILKAEYEFDSPYWDDISDSAKDFIRHLMEKDPEKRFTCEQALQHPWIAGDTALDKNIHQSVSEQIKKNFAKSKWKQAFNATAVVRHMRKLQLGTSQEGQGQTASHGELLTPVAGGPAAGCCCRDCCVEPGTELSPTLPHQL

SEQ ID NO: 720 - protein, 385 aa, unidentified
MARENGESSSSWKKQAEDIKKIFEFKETLGTGAFSEVVLAEEKATGKLFAVKCIPKKALKGKESSIENEIAVLRKIKHENIVALEDIYESPNHLYLVMQLVSGGELFDRIVEKGFYTEKDASTLIRQVLDAVYYLHRMGIVHRDLKPENLLYYSQDEESKIMISDFGLSKMEGKGDVMSTACGTPGYVAPEVLAQKPYSKAVDCWSIGVIAYILLCGYPPFYDENDSKLFEQILKAEYEFDSPYWDDISDSAKDFIRNLMEKDPNKRYTCEQAARHPWIAGDTALNKNIHESVSAQIRKNFAKSKWRQAFNATAVVRHMRKLHLGSSLDSSNASVSSSLSLASQKDCLAPSTLCSFISSSSGVSGVGAERRPRPTTVTAVHSGSK

SEQ ID NO: 721 - protein, 476 aa, unidentified [sequence omitted]

SEQ ID NO: 722 - protein, 478 aa, unidentified
MATITCTRFTEEYQLFEELGKGAFSVVRRCVKVLAGQEYAAKIINTKKLSARDHQKLEREARICRLLKHPNIVRLHDSISEEGHHYLIFDLVTGGELFEDIVAREYYSEADASHCIQQILEAVLHCHQMGVVHRDLKPENLLLASKLKGAAVKLADFGLAIEVEGEQQAWFGFAGTPGYLSPEVLRKDPYGKPVDLWACGVILYILLVGYPPFWDEDQHRLYQQIKAGAYDFPSPEWDTVTPEAKDLINKMLTINPSKRITAAEALKHPWISHRSTVASCMHRQETVDCLKKFNARRKLKGAILTTMLATRNFSGGKSGGNKKSDGVKESSESTNTTIEDEDTKVRKQEIIKVTEQLIEAISNGDFESYTKMCDPGMTAFEPEALGNLVEGLDFHRFYFENLWSRNSKPVHTTILNPHIHLMGDESACIAYIRITQYLDAGGIPRTAQSEETRVWHRRDGKWQIVHFHRSGAPSVLPH

SEQ ID NO: 723 - protein, 666 aa, unidentified
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTINPAKRITAHEALKHPWVCQRSTVASMMHRQETVECLKKFNARRKLKGAILTTMLATRNFSVGRQTTAPATMSTAASGTTMGLVEQAKSLLNKKADGVKPQTNSTKNSAAATSPKGTLPPAALEPQTTVIHNPVDGIKESSDSANTTIEDEDAKAPRVPDILSSVRRGSGAPEAEGPLPCPSPAPFSPLPAPSPRISDILNSVRRGSGTPEAEGPLSAGPPPCLSPALLGPLSSPSPRISDILNSVRRGSGTPEAEGPSPVGPPPCPSPTIPGPLPTPSRKQEIIKTTEQLIEAVNNGDFEAYAKICDPGLTSFEPEALGNLVEGMDFHRFYFENLLAKNSKPIHTTILNPHVHVIGEDAACIAYIRLTQYIDGQGRPRTSQSEETRVWHRRDGKWQNVHFHCSGAPVAPLQ

SEQ ID NO: 724 - protein, 499 aa, unidentified
MASTTTCTRFTDEYQLFEELGKGAFSVVRRCMKIPTGQEYAAKIINTKKLSARDHQKLEREARICRLLKHPNIVRLHDSISEEGFHYLVFDLVTGGELFEDIVAREYYSEADASHCIQQILESVNHCHLNGIVHRDLKPENLLLASKSKGAAVKLADFGLAIEVQGDQQAWFGFAGTPGYLSPEVLRKDPYGKPVDMWACGVILYILLVGYPPFWDEDQHRLYQQIKAGAYDFPSPEWDTVTPEAKDLINKMLTINPAKRITASEALKHPWICQRSTVASMMHRQETVDCLKKFNARRKLKGAILTTMLATRNFSAAKSLLKKPDGVKESTESSNTTIEDEDVKARKQEIIKVTEQLIEAINNGDFEAYTKICDPGLTAFEPEALGNLVEGMDFHRFYFENALSKSNKPIHTIILNPHVHLVGDDAACIAYIRLTQYMDGSGMPKTMQSEETRVWHRRDGKWQNVHFHRSGSPTVPIKPPCIPNGKENFSGGTSLWQNI

SEQ ID NO: 725 - protein, 558 aa, unidentified
MATTATCTRFTDDYQLFEELGKGAFSVVRRCVKKTSTQEYAAKIINTKKLSARDHQKLEREARICRLLKHPNIVRLHDSISEEGFHYLVFDLVTGGELFEDIVAREYYSEADASHCIHQILESVNHIHQHDIVHRDLKPENLLLASKCKGAAVKLADFGLAIEVQGEQQAWFGFAGTPGYLSPEVLRKDPYGKPVDIWACGVILYILLVGYPPFWDEDQHKLYQQIKAGAYDFPSPEWDTVTPEAKNLINQMLTINPAKRITADQALKHPWVCQRSTVASMMHRQETVECLRKFNARRKLKGAILTTMLVSRNFSAAKSLLNKKSDGGVKKRKSSSSVHLMPQSNNKNSLVSPAQEPAPLQTAMEPQTTVVHNATDGIKGSTESCNTTTEDEDLKGRVPEGRSSRDRTAPSAGMQPQPSLCSSAMRKQEIIKITEQLIEAINNGDFEAYTKICDPGLTSFEPEALGNLVEGMDFHKFYFENLLSKNSKPIHTTILNPHVHVIGEDAACIAYIRLTQYIDGQGRPRTSQSEETRVWHRRDGKWLNVHYHCSGAPAAPLQ

SEQ ID NO: 726 - protein, 473 aa, unidentified
MLKVTVPSCSASSCSSVTASAAPGTASLVPDYWIDGSNRDALSDFFEVESELGRGATSIVYRCKQKGTQKPYALKVLKKTVDKKIVRTEIGVLLRLSHPNIIKLKEIFETPTEISLVLELVTGGELFDRIVEKGYYSERDAADAVKQILEAVAYLHENGIVHRDLKPENLLYATPAPDAPLKIADFGLSKIVEHQVLMKTVCGTPGYCAPEILRGCAYGPEVDMWSVGIITYILLCGFEPFYDERGDQFMFRRILNCEYYFISPWWDEVSLNAKDLVRKLIVLDPKKRLTTFQALQHPWVTGKAANFVHMDTAQKKLQEFNARRKLKAAVKAVVASSRLGSASSSHGSIQESHKASRDPSPIQDGNEDMKAIPEGEKIQGDGAQAAVKGAQAELMKVQALEKVKGADINAEEAPKMVPKAVEDGIKVADLELEEGLAEEKLKTVEEAAAPREGQGSSAVGFEVPQQDVILPEY

SEQ ID NO: 727 - protein, 588 aa, unidentified
MSSCVSSQPSSNRAAPQDELGGRGSSSSESQKPCEALRGLSSLSIHLGMESFIVVTECEPGCAVDLGLARDRPLEADGQEVPLDTSGSQARPHLSGRKLSLQERSQGGLAAGGSLDMNGRCICPSLPYSPVSSPQSSPRLPRRPTVESHHVSITGMQDCVQLNQYTLKDEIGKGSYGVVKLAYNENDNTYYAMKVLSKKKLIRQAGFPRRPPPRGTRPAPGGCIQPRGPIEQVYQEIAILKKLDHPNVVKLVEVLDDPNEDHLYMVFELVNQGPVMEVPTLKPLSEDQARFYFQDLIKGIEYLHYQKIIHRDIKPSNLLVGEDGHIKIADFGVSNEFKGSDALLSNTVGTPAFMAPESLSETRKIFSGKALDVWAMGVTLYCFVFGQCPFMDERIMCLHSKIKSQALEFPDQPDIAEDLKDLITRMLDKNPESRIVVPEIKLHPWVTRHGAEPLPSEDENCTLVEVTEEEVENSVKHIPSLATVILVKTMIRKRSFGNPFEGSRREERSLSAPGNLLTKKPTRECESLSELKEARQRRQPPGHRPAPRGGGGSALVRGSPCVESCWAPAPGSPARMHPLRPEEAMEPE

SEQ ID NO: 728 - protein, 296 aa, unidentified
MESMAVATDGGERPGVPAGSGLSASQRRAELRRRKLLMNSEQRINRIMGFHRPGSGAEEESQTKSKQQDSDKLNSLSVPSVSKRVVLGDSVSTGTTDQQGGVAEVKGTQLGDKLDSFIKPPECSSDVNLELRQRNRGDLTADSVQRGSRHGLEQYLSRFEEAMKLRKQLISEKPSQEDGNTTEEFDSFRIFRLVGCALLALGVRAFVCKYLSIFAPFLTLQLAYMGLYKYFPKSEKKIKTTVLTAALLLSGIPAEVINRSMDTYSKMGEVFTDLCVYFFTFIFCHELLDYWGSEVP

SEQ ID NO: 729 - protein, 401 aa, unidentified
MPVQLSEHPEWNESMHSLRISVGGLPVLASMTKAADPRFRPRWKVILTFFVGAAILWLLCSHRPAPGRPPTHNAHNWRLGQAPANWYNDTYPLSPPQRTPAGIRYRIAVIADLDTESRAQEENTWFSYLKKGYLTLSDSGDKVAVEWDKDHGVLESHLAEKGRGMELSDLIVFNGKLYSVDDRTGVVYQIEGSKAVPWVILSDGDGTVEKGFKAEWLAVKDERLYVGGLGKEWTTTTGDVVNENPEWVKVVGYKGSVDHENWVSNYNALRAAAGIQPPGYLIHESACWSDTLQRWFFLPRRASQERYSEKDDERKGANLLLSASPDFGDIAVSHVGAVVPTHGFSSFKFIPNTDDQIIVALKSEEDSGRVASYIMAFTLDGRFLLPETKIGSVKYEGIEFI

SEQ ID NO: 730 - protein, 592 aa, unidentified
MEGKWLLCMLLVLGTAIVEAHDGHDDDVIDIEDDLDDVIEEVEDSKPDTTAPPSSPKVTYKAPVPTGEVYFADSFDRGTLSGWILSKAKKDDTDDEIAKYDGKWEVEEMKESKLPGDKGLVLMSRAKHHAISAKLNKPFLFDTKPLIVQYEVNFQNGIECGGAYVKLLSKTPELNLDQFHDKTPYTIMFGPDKCGEDYKLHFIFRHKNPKTGIYEEKHAKRPDADLKTYFTDKKTHLYTLILNPDNSFEILVDQSVVNSGNLLNDMTPPVNPSREIEDPEDRKPEDWDERPKIPDPEAVKPDDWDEDAPAKIPDEEATKPEGWLDDEPEYVPDPDAEKPEDWDEDMDGEWEAPQIANPRCESAPGCGVWQRPVIDNPNYKGKWKPPMIDNPSYQGIWKPRKIPNPDFFEDLEPFRMTPFSAIGLELWSMTSDIFFDNFIICADRRIVDDWANDGWGLKKAADGAAEPGVVGQMIEAAEERPWLWVVYILTVALPVFLVILFCCSGKKQTSGMEYKKTDAPQPDVKEEEEEKEEEKDKGDEEEEGEEKLEEKQKSDAEEDGGTVSQEEEDRKPKAEEDEILNRSPRNRKPRRE

SEQ ID NO: 731 - protein, 228 aa, unidentified
MTDQTYCDRLVQDTPFLTGHGRLSEQQVDRIILQLNRYYPQILTNKEAEKFRNPKASLRVRLCDLLSHLQRSGERDCQEFYRALYIHAQPLHSRLPSRHALRKFHITNHACLVLARGGHPSLPLMAWMSSMTTQVCCSPGLASPLASAPPQRPPSGPEGRVWQAQAVQMLVSVSHFLPLPPSLSHGSFHTAWGILYVHSCPSFSNLIPRGSLHVCVDSNLVPTAAWRS

SEQ ID NO: 732 - protein, 797 aa, unidentified
MAALAYNLGKREINHYFSVRSAKVLALVAVLLLAACHLASRRYRGNDSCEYLLSSGRFLGEKVWQPHSCMMHKYKISEAKNCLVDKHIAFIGDSRIRQLFYSFVKIINPQFKEEGNKHENIPFEDKTASVKVDFLWHPEVNGSMKQCIKVWTEDSIAKPHVIVAGAATWSIKIHNGSSEALSQYKMNITSIAPLLEKLAKTSDVYWVLQDPVYEDLLSENRKMITNEKIDAYNEAAVSILNSSTRNSKSNVKMFSVSKLIAQETIMESLDGLHLPESSRETTAMILMNVYCNKILKPVDGSCCQPRPPVTLIQKLAACFFTLSIIGYLIFYIIHRNAHRKNKPCTDLESGEEKKNIINTPVSSLEILLQSFCKLGLIMAYFYMCDRANLFMKENKFYTHSSFFIPIIYILVLGVFYNENTKETKVLNREQTDEWKGWMQLVILIYHISGASTFLPVYMHIRVLVAAYLFQTGYGHFSYFWIKGDFGIYRVCQVLFRLNFLVVVLCIVMDRPYQFYYFVPLVTVWFMVIYVTLALWPQIIQKKANGNCFWHFGLLLKLGFLLLFICFLAYSQGAFEKIFSLWPLSKCFELKGNVYEWWFRWRLDRYVVFHGMLFAFIYLALQKRQILSEGKGEPLFSNKISNFLLFISVVSFLTYSIWASSCKNKAECNELHPSVSVVQILAFILIRNIPGYARSVYSSFFAWFGKISLELFICQYHIWLAADTRGILVLIPGNPMLNIIVSTFIFVCVAHEISQITNDLAQIIIPKDNSSLLKRLACIAAFFCGLLILSSIQDKSKH

SEQ ID NO: 733 - protein, 926 aa, unidentified
MADDDVLFEDVYELCEVIGKGPFSVVRRCINRETGQQFAVKIVDVAKFTSSPGLSTEDLKREASICHMLKHPHIVELLETYSSDGMLYMVFEFMDGADLCFEIVKRADAGFVYSEAVASHYMRQILEALRYCHDNNIIHRDVKPHCVLLASKENSAPVKLGGFGVAIQLGESGLVAGGRVGTPHFMAPEVVKREPYGKPVDVWGCGVILFILLSGCLPFYGTKERLFEGIIKGKYKMNPRQWSHISESAKDLVRRMLMLDPAERITVYEALNHPWLKERDRYAYKIHLPETVEQLRKFNARRKLKGAVLAAVSSHKFNSFYGDPPEELPDFSEDPTSSGLLAAERAVSQVLDSLEEIHALTDCSEKDLDFLHSVFQDQHLHTLLDLYDKINTKSSPQIRNPPSDAVQRAKEVLEEISCYPENNDAKELKRILTQPHFMALLQTHDVVAHEVYSDEALRVTPPPTSPYLNGDSPESANGDMDMENVTRVRLVQFQKNTDEPMGITLKMNELNHCIVARIMHGGMIHRQGTLHVGDEIREINGISVANQTVEQLQKMLREMRGSITFKIVPSYRTQSSSCERDSPSTSRQSPANGHSSTNNSVSDLPSTTQPKGRQIYVRAQFEYDPAKDDLIPCKEAGIRFRVGDIIQIISKDDHNWWQGKLENSKNGTAGLIPSPELQEWRVACIAMEKTKQEQQASCTWFGKKKKQYKDKYLAKHNAVFDQLDLVTYEEVVKLPAFKRKTLVLLGAHGVGRRHIKNTLITKHPDRFAYPIPHTTRPPKKDEENGKNYYFVSHDQMMQDISNNEYLEYGSHEDAMYGTKLETIRKIHEQGLIAILDVEPQALKVLRTAEFAPFVVFIAAPTITPGLNEDESLQRLQKESDILQRTYAHYFDLTIINNEIDETIRHLEEAVELVCTAPQWVPVSWVY

SEQ ID NO: 734 - protein, 1078 aa, unidentified
MAFYSCCWVLLALTWHTSAYGPDQRAQKKGDIILGGLFPIHFGVAAKDQDLKSRPESVECIRYNFRGFRWLQAMIFAIEEINSSPALLPNLTLGYRIFDTCNTVSKALEATLSFVAQNKIDSLNLDEFCNCSEHIPSTIAVVGATGSGVSTAVANLLGLFYIPQVSYASSSRLLSNKNQFKSFLRTIPNDEHQATAMADIIEYFRWNWVGTIAADDDYGRPGIEKFREEAEERDICIDFSELISQYSDEEEIQHVVEVIQNSTAKVIVVFSSGPDLEPLIKEIVRRNITGKIWLASEAWASSSLIAMPQYFHVVGGTIGFALKAGQIPGFREFLKKVHPRKSVHNGFAKEFWEETFNCHLQEGAKGPLPVDTFLRGHEESGDRFSNSSTAFRPLCTGDENISSVETPYIDYTHLRISYNVYLAVYSIAHALQDIYTCLPGRGLFTNGSCADIKKVEAWQVLKHLRHLNFTNNMGEQVTFDECGDLVGNYSIINWHLSPEDGSIVFKEVGYYNVYAKKGERLFINEEKILWSGFSREVPFSNCSRDCLAGTRKGIIEGEPTCCFECVECPDGEYSDETDASACNKCPDDFWSNENHTSCIAKEIEFLSWTEPFGIALTLFAVLGIFLTAFVLGVFIKFRNTPIVKATNRELSYLLLFSLLCCFSSSLFFIGEPQDWTCRLRQPAFGISFVLCISCILVKTNRVLLVFEAKIPTSFHRKWWGLNLQFLLVFLCTFMQIVICVIWLYTAPPSSYRNQELEDEIIFITCHEGSLMALGFLIGYTCLLAAICFFFAFKSRKLPENFNEAKFITFSMLIFFIVWISFIPAYASTYGKFVSAVEVIAILAASFGLLACIFFNKIYIILFKPSRNTIEEVRCSTAAHAFKVAARATLRRSNVSRKRSSSLGGSTGSTPSSSISSKSNSEDPFPQPERQKQQQPLALTQQEQQQQPLTLPQQQRSQQQPRCKQKVIFGSGTVTFSLSFDEPQKNAMAHRNSTHQNSLEAQKSSDTLTRHEPLLPLQCGETDLDLTVQETGLQGPVGGDQRPEVEDPEELSPALVVSSSQSFVISGGGSTVTENVVNS

SEQ ID NO: 735 - protein, 780 aa, unidentified
MDQNSVPEKAQNEADTNNADRFFRSHSSPPHHRPGHSRALHHYELHHHGVPHQRGESHHPPEFQDFHDQALSSHVHQSHHHSEARNHGRAHGPTGFGLAPSQGAVPSHRSYGEDYHDELQRDGRRHHDGSQYGGFHQQSDSHYHRGSHHGRPQYLGENLSHYSSGVPHHGEASHHGGSYLPHGPNPYSESFHHSEASHLSGLQHDESQHHQVPHRGWPHHHQVHHHGRSRHHEAHQHGKSPHHGETISPHSSVGSYQRGISDYHSEYHQGDHHPSEYHHGDHPHHTQHHYHQTHRHRDYHQHQDHHGAYHSSYLHGDYVQSTSQLSIPHTSRSLIHDAPGPAASRTGVFPYHVAHPRGSAHSMTRSSSTIRSRVTQMSKKVHTQDISTKHSEDWGKEEGQFQKRKTGRLQRTRKKGHSTNLFQWLWEKLTFLIQGFREMIRNLTQSLAFETFIFFVVCLNTVMLVAQTFAEVEIRGEWYFMALDSIFFCIYVVEALLKIIALGLSYFFDFWNNLDFFIMAMAVLDFLLMQTHSFAIYHQSLFRILKVFKSLRALRAIRVLRRLSFLTSVQEVTGTLGQSLPSIAAILILMFTCLFLFSAVLRALFRKSDPKRFQNIFTTIFTLFTLLTLDDWSLIYMDSRAQGAWYIIPILVIYIIIQYFIFLNLVITVLVDSFQTALFKGLEKAKQERAARIQEKLLEDSLTELRAAEPKEVASEGTMLKRLIEKKFGTMTEKQQELLFHYLQLVASVEQEQQKFRSQAAVIDEIVDTTFEAGEEDFRN

SEQ ID NO: 736 - protein, 530 aa, unidentified
MAAYQQEEQMQLPRADAIRSRLIDTFSLIEHLQGLSQAVPRHTIRELLDPSRQKKLVLGDQHQLVRFSIKPQRIEQISHAQRLLSRLHVRCSQRPPLSLWAGWVLECPLFKNFIIFLVFLNTIILMVEIELLESTNTKLWPLKLTLEVAAWFILLIFILEILLKWLSNFSVFWKSAWNVFDFVVTMLSLLPEVVVLVGVTGQSVWLQLLRICRVLRSLKLLAQFRQIQIIILVLVRALKSMTFLLMLLLIFFYIFAVTGVYVFSEYTRSPRQDLEYHVFFSDLPNSLVTVFILFTLDHWYALLQDVWKVPEVSRIFSSIYFILWLLLGSIIFRSIIVAMMVTNFQNIRKELNEEMARREVQLKADMFKRQIIQRRKNMSHEALTSSHSKIEDSSRGASQQRESLDLSEVSEVESNYGATEEDLITSASKTEETLSKKREYQSSSCVSSTSSSYSSSSESRFSESIGRLDWETLVHENLPGLMEMDQDDRVWPRDSLFRYFELLEKLQYNLEERKKLQEFAVQALMNLEDK

SEQ ID NO: 737 - protein, 398 aa, unidentified
MSQHRHQRHSRVISSSPVDTTSVGFCPTFKKFKRNDDECRAFVKRVIMSRFFKIIMISTVTSNAFFMALWTSYDIRYRLFRLLEFSEIFFVSICTSELSMKVYVDPINYWKNGYNLLDVIIIIVMFLPYALRQLMGKQFTYLYIADGMQSLRILKLIGYSQGIRTLITAVGQTVYTVASVLLLLFLLMYIFAILGFCLFGSPDNGDHDNWGNLAAAFFTLFSLATVDGWTDLQKQLDNREFALSRAFTIIFILLASFIFLNMFVGVMIMHTEDSIRKFERELMLEQQEMLMGEKQVILQRQQEEISRLMHIQKNADCTSFSELVENFKKTLSHTDPMVLDDFGTSLPFIDIYFSTLDYQDTTVHKLQELYYEIVHVLSLMLEDLPQEKPQSLEKVDEK

SEQ ID NO: 738 - protein, 472 aa, unidentified
MRDNEKAWWQQWTSHTGLEGWGGTQEDRMGFGGAVAALRGRPSPLQSTIHESYGRPEEQVLINRQEITNKADAWDMQEFITHMYIKQLLRHPAFQLLLALLLVINAITIALRTNSYLDQKHYELFSTIDDIVLTILLCEVLLGWLNGFWIFWKDGWNILNFIIVFILLLRFFINEINIPSINYTLRALRLVHVCMAVEPLARIIRVILQSVPDMANIMVLILFFMLVFSVFGVTLFGAFVPKHFQNIQVALYTLFICITQDGWVDIYSDFQTEKREYAMEIGGAIYFTIFITIGAFIGINLFVIVVTTNLEQMMKAGEQGQQQRITFSETGAEEEEENDQLPLVHCVVARSEKSGLLQEPLAGGPLSNLSENTCDNFCLVLEAIQENLRQYKEIRDELNMIVEEVRAIRFNQEQESEVLNRRSSTSGSLETTSSKDIRQMSQQQDLLSALVSMEKVHDSSSQILLKKHKSSH

SEQ ID NO: 739 - protein, 1116 aa, unidentified
MESPLIYVSVLLLNIFEFSSGIVYNKDDTEKRFACSNKGFPQENEIIKLYLFLENLKIQCFFQTENEIASKAMLSVFTSGGLAPSLGIMNSTYNGIFHFNLTLFSDRILWLVDIPRENITQSTDIAAVEEWLVRITLHHGLNIYATEGTLLDVIREPILQWTPGDVIPESEISKLYPHVVDLKVTKCPCANDVALLGFIVDTIVDGVYIGITFGGFWHDYDTTWFNMTQTIYSQLQEEYEDLSLVDMVLTNHFLVILTSLGLFVSEDLRYPSRHSLSFSRADFCGFERVDYVKGKLWYNERCFANREHFEVDYVTVTFERNRTLSESSSCFYSQEPFLEWVPCLPHIFKGIKIFPTVLTFLVDQERGTGVYLFYNKVRKTAIASVSTLRNNEPNSQSKFPIFRFPSSFSSPVGMVFHPRSHFLYAYGNQIWLSVDGGNTFQLIANFHDDIIKKTFHSFYTSAITFVSQRGKVYSTKAGMGRYSAVGSVTERIFTLYYDHLGFLHKLTLGRFEASGPPTAFGNSRNLFGQPPDMGFETALAPQHTSLDEIIFFAYVPENEPQETIYSKKFGNIHYGKVIHSGKTGRAYIRKVLQHTTPKGFLSSVIAEMKEPFGLEEVNESSCLSSSLLINKAGNVYKLTLDSQVVQALFEDTDIEKTVVLPGYSSFLITSILDNKNALAIATMPESAPNNMTFLKSTWFLYNFGQRNGRTWKIYSKPCNYWFQHDDSPSLNIVKYIDLGNSYVLKAKVIRNAKGFRMLEIPLLTVFVGNPNLLEVTAEVTFDDTDSYVITISAASKVLHQGSTSLAFIMWSASTECFVTTMVPTLKSSCSYLRSMHHIPSKFIPFEDWISGVHKDSQGFNLIKTLPINYRPPSNMGIAIPLTDNFYHADPSKPIPRNMFHMSKKTGKFKQCANVSTREECNCTKDQKFSHAVAFSDCREKVPRFKFPITQYPVSLEIINEDGRVPLQSPYLVTVTEVNMRHNWKLKHTVPENIKRMKQLVEPILGAAVYNPSGLNLSIKGSELFHFRVTVISGVTFCNLIEEFQIYVDEAPLPFPGHTLIAVATAVVLGGLIFIAFMFQLQGIHPWRTFQRWIRRNQEKFSSISLSELIHRSKSEE

SEQ ID NO: 740 - protein, 798 aa, unidentified
MLMLMLVAAVTMWLRPLVTAQLCRSRTVRTGKVFNLIQDVQGDRLYFHPTTTRLIKHPCEKNIALYLGKQVFFTMDNFETSLLPFTIPTSMQVGVPEVTSAHFAGSLLLLVVDQKVYIYDYENNSWSMSLGIKHPVTHVSGDNCCYTGSLFCVHVSNLVFAYFRGDQISQTYIYYSNTGGFSFWKYHYDRQAEIIGSLGGIFHFFSLSQVAMLVVNQGKGMFKYSDHPLNRSFGLSFDYNGTLDILIAPGQRGILLLWFENSLLFSHNAGQLVDTVRVKKGDQTLFSSIFEAKITIHNIAVTENELAVITREDNLYYGNLGIVPSSIIKFADQYIWSEDVALMFRSPGTLEILTPLRDTAFPAFDFQKCLVNIQALLMDPELHVGKCKIEFLTGEFIYRMYTIDMHSQLELTASLIPQPGTSLIPLVMVSNPHSLGFQATFYENGYTSDGNTKYKLDIFLKQQQHWGRTDSNFTSSLKKATMSTLTVDIANKEISCVDIKPLSTLISVGCDLDKKIVIQNKVSACSMGILDPLTLQDNYSFIIEKEFYDPGFQGQQSSEDLHVFYSYQQLGCPLLVYYDTLWKPVVELWRKDSFQEVIDAEYVLLEVNGQFSYSYSLTAQSAMCTSQPQNWTTMIKEFGGPFFWNRENYVSCHDPNNNAPLRWPDVQYQILGGRTANQIIFGHNGFYVFYISIVDPYYSYCQLETIFSIYVYGAFPVQLVSAGVVILLIISSILGSVWLAYKTPKLLRTARGRRIKKCATQLCRRCKTVCQFRASATARAGTEPPGRHRTPHGGRSDH

SEQ ID NO: 741 - protein, 1159 aa, unidentified
MCGPAMFPAGPPWPRVRVVQVLWALLAVLLASWRLWAIKDFQECTWQVVLNEFKRVGESGVSDSFFEQEPVDTVSSLFHMLVDSPIDPSEKYLGFPYYLKINYSCEEKPSEDLVRMGHLTGLKPLVLVTFQSPVNFYRWKIEQLQIQMEAAPFRSKEPCMAEEVCSMSWYTPMPIKKGSVVMRVDISSNGLGTFIPDKRFQMNINGFLKRDRDNNIQFTVGEELFNLMPQYFVGVSSRPLWHTVDQSPVLILGGIPNEKYVLMTDTSFKDFSLVELSIDSCWVGSFYCPHSGFTATIYDTIATESTLFIRQNQLVYYFTGTYTTLYERNRGSGSWIRVLASECIKKLCPVYFHSNGSEYIMALTTGKHEGYVHFGTIRDGQVSFEMLPRQWSVCEQIGVTTCSIIWSEYIAGEYTLLLLVESGYGNASKRFQVVSYNTASDDLELLYHIPEFIPEARGLEFLMILGTESYTSTAMAPKGIFCNPYNNLIFIWGNFLLQSSNKENFIYLADFPKELSIKYMARSFRGAVAIVTETEEIWYLLEGSYRVYQLFPSKGWQVHISLKLMQQSSLYASNETMLTLFYEDSKLYQLVYLMNNQKGQLVKRLVPVEQLLMYQQHTSHYDLERKGGYLMLSFIDFCPFSVMRLRSLPSPQRYTRQERYRARPPRVLERSGFHNENSLAIYQGLVYYLLWLHSVYDKPYADPVHDPTWRWWANNKQDQDYYFFLASNWRSAGGVSIEMDSYEKIYNLESAYELPERIFLDKGTEYSFAIFLSAQGHSFRTQSELGTAFQLHSQVDVGVVLADPGCIEASVKQEVLINRNSVLFSITLKDKKLCYDQGISGHHLMETSMTVNVVGSSGLCFQETHLGPHMQGNLMVPVFIGCPPGKRLAFDITYTLEYSRLKNKHYFDCVNVNPEMPCFLFRDIFYPFFLIQDLVTGDSGSFQGSYVLLVVGGGPTLDSLKDYSEDEIYRFNSPLDKTNSLIWTTRTTRTTKDSAFHIMSHESPGIEWLCLENAPCYDNVPQGIFAPEFFFKVLVSNRGVDTSTYCNYQLTFLLHIHGLPLSPKRALFIIMVSASVFVGLVIFYIAFCLLWPLVVKGCTMIRWKINNLIASESYYTYASISGISSMPSLRHSRMGSMFSSRMTEDRAEPKEAVERQLMT

SEQ ID NO: 742 - protein, 178 aa, unidentified
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 743 - protein, 162 aa, unidentified
MGLETEKADVQLFMDDDSYSHHSGLEYADPEKFADSDQDRDPHRLNSHLKLGFEDVIAEPVTTHSFDKVWICSHALFEISKYVMYKFLTVFLAIPLAFIAGILFATLSCLHIWILMPFVKTCLMVLPSVQTIWKSVTDVIIAPLCTSVGRCFSSVSLQLSQD

SEQ ID NO: 744 - protein, 151 aa, unidentified
MMAEEHTDLEAQIVKDIHCKEIDLVNRDPKNINEDIVKVDFEDVIAEPVGTYSFDGVWKVSYTTFTVSKYWCYRLLSTLLGVPLALLWGFLFACISFCHIWAVVPCIKSYLIEIQCISHIYSLCIRTFCNPLFAALGQVCSSIKVVLRKEV

SEQ ID NO: 745 - protein, 705 aa, unidentified
MQPTATMATAATTTTTTTATVALTTSWDNATGRPTAEPDPILDNYVLLVVVMSLFVGGTLVVLSGVLLLCKRCWDVHQRLNRAMEEAEKTTTTYLDNGTHPAQDPDFRGEDPECQDAETERFLSTSSTGRRVSFNEAALFEQSRKTQDKGRRYTLTEGDFHHLKNARLTHLHLPPLKIVTIHECDSGEASSATTPHPATSPKATLAIFQPPGKALTGRSVGPSSALPGDPYNSAAGATDFAEISPSASSDSGEGTSLDAGTRSTKAGGPGAAAGPGEAGPGSGAGTVLQFLTRLRRHASLDGASPYFKVKKWKLEPSQRAASLDTRGSPKRHHFQRQRAASESTEQEEGDAPQEDFIQYIARAGDAVAFPHPRPFLASPPPALGRLEAAEAAGGASPDSPPERGAGSAGPEQQQPPLEPDAERDAGPEQAQTSYRDLWSLRASLELHAAASDHSSSGNDRDSVRSGDSSGSGSGGAAPAFPPPSPPAPRPKDGEARRLLQMDSGYASIEGRGAGDDTEPPAAPARPRSPRAWPRRPRRDYSIDEKTDALFHEFLRHDPHFDDTPAAARHRARAHPHARKQWQRGRQHSDPGARAAPALAGTPAPPAGAARPARAPLRRGDSVDGPPDGRTLGGAGDDPAIPVIEEEPGGGGCPGSGLCVLPSGSVLDKLAAGLDERLFPPRLAEPVVATPALVAAAPTSPDHSPA

SEQ ID NO: 746 - protein, 283 aa, unidentified
MAGAVSLLGVVGLLLVSALSGVLGDRANPDLRAHPGNAAHPGSGATEPRRRPPLKDQRERTRAGSLPLGALYTAAVAAFVLYKCLQGKDETAVLHEEASKQQPLQSEQQLAQLTQQLAQTEQHLNNLMAQLDPLFERVTTLAGAQQELLNMKLWTIHELLQDSKPDKDMEASEPGEGSGGESAGGGDKVSETGTFLISPHTEASRPLPEDFCLKEDEEEIGDSQAWEEPTNWSTETWNLATSWEVGRGLRRRCSQAVAKGPSHSLGWEGGTTAEGRLKQSLFS

SEQ ID NO: 747 - protein, 1154 aa, unidentified
MQAMEGEVLLPALYEEEEEEEEEEEEVEEEEEQVQKGGSVGSLSVNKHRGLSLTETELEELRAQVLQLVAELEETRELAGQHEDDSLELQGLLEDERLASAQQAEVFTKQIQQLQGELRSLREEISLLEHEKESELKEIEQELHLAQAEIQSLRQAAEDSATEHESDIASLQEDLCRMQNELEDMERIRGDYEMEIASLRAEMEMKSSEPSGSLGLSDYSGLQEELQELRERYHFLNEEYRALQESNSSLTGQLADLESERTQRATERWLQSQTLSMTSAESQTSEMDFLEPDPEMQLLRQQLRDAEEQMHGMKNKCQELCCELEELQHHRQVSEEEQRRLQRELKCAQNEVLRFQTSHSVTQNEELKSRLCTLQKKYDTSQDEQNELLKMQLQLQTELRQLKVMKSTLVENQSEKELLCRLQKLHLQHQNVTCEKEKLLERQQQLQEELQCHEAELQHLRDTVASFKESNEKDTETHAQLQEMKQLYQASKDELERQKHMYDQLEQDLLLCQLELKELKASHPIPEDKGKCANKCDTLLSRLTELQEKYKASQKEMGQLQMEQCELLEDQRRMQEEQGQLQEELHRLTLPLPKSGLLLKSQELLTKLEDLCELQLLYQGMQEEQKKLIQNQDCVLKEQLEIHEELRRFKESHFQEVLENPDDSKLAKSSKCNRNKQSKLLMEQMQALQVMYDAGQAKQELLQQEQGRLLEERKRLQADLQLCLEEMQLLQVQSPSIKMSLESYGKSYGSMVPSNENCRKTYDTTVDDNESYYKSYTSTQTSSKSFLKSYDSSTSASEAYGKSYCTTSNSSITYKKSYGSTSSSDTCQKSFVSSCTDEEPAEPEDMERFEEMVVKVLIKLQAVQAMYQISQEEHSQLQEQMEKLLAKQKDLKEELDACEREFKECMECLEKPMAPQNDKNEIKELQTKLRELQLQYQASMDEQGRLLVVQEQLEGQLQCCQEELRQLREKRPSVVKEARGKNANKNMNKNANGVKMKKVTKPCSDTSESDLETRKSLEVVLYYKASQRKLDGLAKEEEKKEEMEEEKKQVKEEAKEQCGDELVAEPADPEEAKSTEDQEENEEDKEEEEKEEDSEEEEDDADSSLESPEENNPLRLSESKKSSPTPNPPIFSLPLVGLVVISALLWCWWAETSS

SEQ ID NO: 748 - protein, 1427 aa, unidentified
MASWGGEKRGGAEGSPKPAVYATRKTPSVGSQGDQWYLGYPGDQWSSGFPYSWWKNSVGSESKHGEGALDQPQHDVRLEDLGELHRAARSGDVPGVEHILAPGDTGVDKRDRKKSIQQLVPEYKEKQTPESLPQNNNPDWHPTNLTLSDETCQRSKNLKVDDKCPSVSPSMPENQSATKELGQMNLTEREKMDTGVVLLSGNDTLHDLCQSQLPENKESKEAEQDSELTSEEEQERLKGCENKQPQKTSQEPEMAKDCDREDIPIYPVLPHVQKSEEMWIEQGKLEWKNQLKLVINELKQRFGEIYEKYKIPACPEEEPLLDNSTRGTDVKDIPFNLTNNIPGCEEEDASEISVSVVFETFPEQKEPSLKNIIHPYYHPYSGSQEHVCQSSSKFHLHENKLDCDNDNKPGIGHIFSTDKNFHNDASTKKARNPEVVMVEMKEDQEFDLQMTKNMNQNSDSGSTNNYKSLKPKLENLSSLPPDSDRTSEVYLHEELQQDMQKFKNEVNTLEEEFLALKKEDVQLHKDVEEEMEKHRSNSTELSGTLTDGTTVGNDDDGLNQQIPRKENGEHDRPADKTSNEKNEVKNQIYPEADFADSMEPSEIASEDCELSHSVYENFMLLIEQLRMEYKDSASLPRIQDTFCLCEHLLKLKNNHCDQLTVKLKQMENMVSVLQNELSETKKTKLQLELQKIEWEKELYDLRLALKQENEEKRNADMLYNKDSEQLRIKEEECGKVVETKQQLKWNLRRLVKELRTVRNNLDLVVQERNDAQKQLSEEQDARILQDQILTSKQKELEMARKKMNSEISHRHQKEKDLFHEDCMLQEEIALLRLEIDTIKNQNKQKEKKYFEDIEAVKEKNDNLQKIIKLNEETLTETILQYSGQLNNLTAENKILNSELENGKQNQERLEIEMESYRCRLAAAVRDCDQSQTARDLKLDFQRTRQEWVRLHDKMKVDMSGLQAKNEILSEKLSNAESKINSLQIQLHNTRDALGRESLILERVQRDLSQTQCQKKETEQMYQIEQSKLKKYIAKQESVEERLSQLQSENMLLRQQLDDAHKKANSQEKTSSTIQDQFHSAAKNLQAESEKQILSLQEKNKELMDEYNHLKERMDQCEKEKAGRKIDLTEAQETVPSRCLHLDAENEVLQLQQTLFSMKAIQKQCETLQKNKKQLKQEVVNLKSYMERNMLERGKAEWHKLLIEERARKEIEEKLNEAILTLQKQAAVSHEQLVQLREDNTTSIKTQMELTIKDLESEISRIKTSQADFNKTELERYKELYLEEVKVRESLSNELSRTNEMIAEVSTQLTVEKEQTRSRSLFTAYATRPVLESPCVGNLNDSEGLNRKHIPRKKRSALKDMESYLLKMQQKLQNDLTAEVAGSSQTGLHRIPQCSSFSSSSLHLLLCSICQPFFLILQLLLNMNLDPI

SEQ ID NO: 749 - protein, 562 aa, unidentified
MDLPEGPVGGPTAEMYLRERPEEARLGMPVSLEEQILNSTFEACDPQRTGTVAVAQVLAYLEAVTGQGPQDARLQTLANSLDPNGEGPKATVDLDTFLVVMRDWIAACQLHGGLELEEETAFQGALTSRQLPSGCPEAEEPANLESFGGEDPRPELQATADLLSSLEDLELSNRRLVGENAKLQRSMETAEEGSARLGEEILALRKQLHSTQQALQFAKAMDEELEDLKTLARSLEEQNRSLLAQARQAEKEQQHLVAEMETLQEENGKLLAERDGVKKRSQELAMEKDTLKRQLFECEHLICQRDTILSERTRDVESLAQTLEEYRVTTQELRLEISRLEEQLSQTYEGPDELPEGAQLRRVGWTELLPPSLGLEIEAIRQKQEVATADLSNPLCGVWQWEEVIHETSEETEFPSEAPAGGQRNFQGEPAHPEEGRKEPSMWLTRREEEEDAESQVTADLPVPLGAPRPGDIPENPPERPARRELQQALVPVMKKLVPVRRRAWGQLCLPPQRLRVTRHPLIPAPVLGLLLLLLLSVLLLGPSPPPTWPHLQLCYLQPPPV

SEQ ID NO: 750 - protein, 97 aa, unidentified
MTKKKRENLGVALEIDGLEEKLSQCRRDLEAVNSRLHSRELSPEARRSLEKEKNSLMNKASNYEKELKFLRQENRKNMLLSVAIFILLTLVYAYWTM

SEQ ID NO: 751 - protein, 483 aa, unidentified
MKAFHTFCVVLLVFGSVSEAKFDDFEDEEDIVEYDDNDFAEFEDVMEDSVTESPQRVIITEDDEDETTVELEGQDENQEGDFEDADTQEGDTESEPYDDEEFEGYEDKPDTSSSKNKDPITIVDVPAHLQNSWESYYLEILMVTGLLAYIMNYIIGKNKNSRLAQAWFNTHRELLESNFTLVGDDGTNKEATSTGKLNQENEHIYNLWCSGRVCCEGMLIQLRFLKRQDLLNVLARMMRPVSDQVQIKVTMNDEDMDTYVFAVGTRKALVRLQKEMQDLSEFCSDKPKSGAKYGLPDSLAILSEMGEVTDGMMDTKMVHFLTHYADKIESVHFSDQFSGPKIMQEEGQPLKLPDTKRTLLFTFNVPGSGNTYPKDMEALLPLMNMVIYSIDKAKKFRLNREGKQKADKNRARVEENFLKLTHVQRQEAAQSRREEKKRAEKERIMNEEDPEKQRRLEEAALRREQKKLEKKQMKMKQIKVKAM

SEQ ID NO: 752 - protein, 411 aa, unidentified
MMGRSPGFAMQHIVGVPHVLVRRGLLGRDLFMTRTLCSPGPSQPGEKRPEEVALGLHHRLPALGRALGHSIQQRATSTAKTWWDRYEEFVGLNEVREAQGKVTEAEKVFMVARGLVREAREDLEVHQAKLKEVRDRLDRVSREDSQYLELATLEHRMLQEEKRLRTAYLRAEDSEREKFSLFSAAVRESHEKERTRAERTKNWSLIGSVLGALIGVAGSTYVNRVRLQELKALLLEAQKGPVSLQEAIREQASSYSRQQRDLHNLMVDLRGLVHAAGPGQDSGSQAGSPPTRDRDVDVLSAALKEQLSHSRQVHSCLEGLREQLDGLEKTCSQMAGVVQLVKSAAHPGLVEPADGAMPSFLLEQGSMILALSDTEQRLEAQVNRNTIYSTLVTCVTFVATLPVLYMLFKAS

SEQ ID NO: 753 - protein, 254 aa, unidentified
MNSRQAWRLFLSQGRGDRWVSRPRGHFSPALRREFFTTTTKEGYDRRPVDITPLEQRKLTFDTHALVQDLETHGFDKTQAETIVSALTALSNVSLDTIYKEMVTQAQQEITVQQLMAHLDAIRKDMVILEKSEFANLRAENEKMKIELDQVKQQLMHETSRIRADNKLDINLERSRVTDMFTDQEKQLMETTTEFTKKDTQTKSIISETSNKIDAEIASLKTLMESNKLETIRYLAASVFTCLAIALGFYRFWK

SEQ ID NO: 754 - protein, 428 aa, unidentified
MDVVDSLLVNGSNITPPCELGLENETLFCLDQPRPSKEWQPAVQILLYSLIFLLSVLGNTLVITVLIRNKRMRTVTNIFLLSLAVSDLMLCLFCMPFNLIPNLLKDFIFGSAVCKTTTYFMGTSVSVSTFNLVAISLERYGAICKPLQSRVWQTKSHALKVIAATWCLSFTIMTPYPIYSNLVPFTKNNNQTANMCRFLLPNDVMQQSWHTFLLLILFLIPGIVMMVAYGLISLELYQGIKFEASQKKSAKERKPSTTSSGKYEDSDGCYLQKTRPPRKLELRQLSTGSSSRANRIRSNSSAANLMAKKRVIRMLIVIVVLFFLCWMPIFSANAWRAYDTASAERRLSGTPISFILLLSYTSSCVNPIIYCFMNKRFRLGFMATFPCCPNPGPPGARGEVGEEEEGGTTGASLSRFSYSHMSASVPPQ

SEQ ID NO: 755 - protein, 447 aa, unidentified
MELLKLNRSVQGTGPGPGASLCRPGAPLLNSSSVGNLSCEPPRIRGAGTRELELAIRITLYAVIFLMSVGGNMLIIVVLGLSRRLRTVTNAFLLSLAVSDLLLAVACMPFTLLPNLMGTFIFGTVICKAVSYLMGVSVSVSTLSLVAIALERYSAICRPLQARVWQTRSHAARVIVATWLLSGLLMVPYPVYTVVQPVGPRVLQCVHRWPSARVRQTWSVLLLLLLFFIPGVVMAVAYGLISRELYLGLRFDGDSDSDSQSRVRNQGGLPGAVHQNGRCRPETGAVGEDSDGCYVQLPRSRPALELTALTAPGPGSGSRPTQAKLLAKKRVVRMLLVIVVLFFLCWLPVYSANTWRAFDGPGAHRALSGAPISFIHLLSYASACVNPLVYCFMHRRFRQACLETCARCCPRPPRARPRALPDEDPPTPSIASLSRLSYTTISTLGPG

SEQ ID NO: 756 - protein, 91 aa, unidentified
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 757 - protein, 99 aa, unidentified
MKASAALLCLLLTAAAFSPQGLAQPVGINTSTTCCYRFINKKIPKQRLESYRRTTSSHCPREAVIFKTKLDKEICADPTQKWVQDFMKHLDKKTQTPKL

SEQ ID NO: 758 - protein, 757 aa, unidentified
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDELNDMKDYLSQCQQEQESFIDYKSLKENLARCWTLTEAEKMSFETQKTNLATENQYLRVSLEKEEKALSSLQEELNKLREQIRILEDKGTSTELVKENQKLKQHLEEEKQKKHSFLSQRETLLTEAKMLKRELERERLVTTALRGELQQLSGSQLHGKSDSPNVYTEKKEIAILRERLTELERKLTFEQQRSDLWERLYVEAKDQNGKQGTDGKKKGGRGSHRAKNKSKETFLGSVKETFDAMKNSTKEFVRHHKEKIKQAKEAVKENLKKFSDSVKSTFRHFKDTTKNIFDEKGNKRFGATKEAAEKPRTVFSDYLHPQYKAPTENHHNRGPTMQNDGRKEKPVHFKEFRKNTNSKKCSPGHDCRENSHSFRKACSGVFDCAQQESMSLFNTVVNPIRMDEFRQIIQRYMLKELDTFCHWNELDQFINKFFLNGVFIHDQKLFTDFVNDVKDYLRNMKEYEVDNDGVFEKLDEYIYRHFFGHTFSPPYGPRSVYIKPCHYSSL

SEQ ID NO: 759 - protein, 355 aa, unidentified
METPNTTEDYDTTTEFDYGDATPCQKVNERAFGAQLLPPLYSLVFVIGLVGNILVVLVLVQYKRLKNMTSIYLLNLAISDLLFLFTLPFWIDYKLKDDWVFGDAMCKILSGFYYTGLYSEIFFIILLTIDRYLAIVHAVFALRARTVTFGVITSIIIWALAILASMPGLYFSKTQWEFTHHTCSLHFPHESLREWKLFQALKLNLFGLVLPLLVMIICYTGIIKILLRRPNEKKSKAVRLIFVIMIIFFLFWTPYNLTILISVFQDFLFTHECEQSRHLDLAVQVTEVIAYTHCCVNPVIYAFVGERFRKYLRQLFHRRVAVHLVKWLPFLSVDRLERVSSTSPSTGEHELSAGF

SEQ ID NO: 760 - protein, 362 aa, unidentified
MGTEATEQVSWGHYSGDEEDAYSAEPLPELCYKADVQAFSRAFQPSVSLTVAALGLAGNGLVLATHLAARRAARSPTSAHLLQLALADLLLALTLPFAAAGALQGWSLGSATCRTISGLYSASFHAGFLFLACISADRYVAIARALPAGPRPSTPGRAHLVSVIVWLLSLLLALPALLFSQDGQREGQRRCRLIFPEGLTQTVKGASAVAQVALGFALPLGVMVACYALLGRTLLAARGPERRRALRVVVALVAAFVVLQLPYSLALLLDTADLLAARERSCPASKRKDVALLVTSGLALARCGLNPVLYAFLGLRFRQDLRRLLRGGSCPSGPQPRRGCPRRPRLSSCSAPTETHSLSWDN

SEQ ID NO: 761 - protein, 374 aa, unidentified
MLSTSRSRFIRNTNESGEEVTTFFDYDYGAPCHKFDVKQIGAQLLPPLYSLVFIFGFVGNMLVVLILINCKKLKCLTDIYLLNLAISDLLFLITLPLWAHSAANEWVFGNAMCKLFTGLYHIGYFGGIFFIILLTIDRYLAIVHAVFALKARTVTFGVVTSVITWLVAVFASVPGIIFTKCQKEDSVYVCGPYFPRGWNNFHTIMRNILGLVLPLLIMVICYSGILKTLLRCRNEKKRHRAVRVIFTIMIVYFLFWTPYNIVILLNTFQEFFGLSNCESTSQLDQATQVTETLGMTHCCINPIIYAFVGEKFRSLFHIALGCRIAPLQKPVCGGPGVRPGKNVKVTTQGLLDGRGKGKSIGRAPEASLQDKEGA

SEQ ID NO: 762 - protein, 355 aa, unidentified
MTTSLDTVETFGTTSYYDDVGLLCEKADTRALMAQFVPPLYSLVFTVGLLGNVVVVMILIKYRRLRIMTNIYLLNLAISDLLFLVTLPFWIHYVRGHNWVFGHGMCKLLSGFYHTGLYSEIFFIILLTIDRYLAIVHAVFALRARTVTFGVITSIVTWGLAVLAALPEFIFYETEELFEETLCSALYPEDTVYSWRHFHTLRMTIFCLVLPLLVMAICYTGIIKTLLRCPSKKKYKAIRLIFVIMAVFFIFWTPYNVAILLSSYQSILFGNDCERSKHLDLVMLVTEVIAYSHCCMNPVIYAFVGERFRKYLRHFFHRHLLMHLGRYIPFLPSEKLERTSSVSPSTAEPELSIVF

SEQ ID NO: 763 - protein, 360 aa, unidentified
MNPTDIADTTLDESIYSNYYLYESIPKPCTKEGIKAFGELFLPPLYSLVFVFGLLGNSVVVLVLFKYKRLRSMTDVYLLNLAISDLLFVFSLPFWGYYAADQWVFGLGLCKMISWMYLVGFYSGIFFVMLMSIDRYLAIVHAVFSLRARTLTYGVITSLATWSVAVFASLPGFLFSTCYTERNHTYCKTKYSLNSTTWKVLSSLEINILGLVIPLGIMLFCYSMIIRTLQHCKNEKKNKAVKMIFAVVVLFLGFWTPYNIVLFLETLVELEVLQDCTFERYLDYAIQATETLAFVHCCLNPIIYFFLGEKFRKYILQLFKTCRGLFVLCQYCGLLQIYSADTPSSSYTQSTMDHDLHDAL

SEQ ID NO: 764 - protein, 352 aa, unidentified [sequence omitted]

SEQ ID NO: 765 - protein, 374 aa, unidentified
MSGESMNFSDVFDSSEDYFVSVNTSYYSVDSEMLLCSLQEVRQFSRLFVPIAYSLICVFGLLGNILVVITFAFYKKARSMTDVYLLNMAIADILFVLTLPFWAVSHATGAWVFSNATCKLLKGIYAINFNCGMLLLTCISMDRYIAIVQATKSFRLRSRTLPRSKIICLVVWGLSVIISSSTFVFNQKYNTQGSDVCEPKYQTVSEPIRWKLLMLGLELLFGFFIPLMFMIFCYTFIVKTLVQAQNSKRHKAIRVIIAVVLVFLACQIPHNMVLLVTAANLGKMNRSCQSEKLIGYTKTVTEVLAFLHCCLNPVLYAFIGQKFRNYFLKILKDLWCVRRKYKSSGFSCAGRYSENISRQTSETADNDNASSFTM

SEQ ID NO: 766 - protein, 378 aa, unidentified
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 767 - protein, 355 aa, unidentified
MDYTLDLSVTTVTDYYYPDIFSSPCDAELIQTNGKLLLAVFYCLLFVFSLLGNSLVILVLVVCKKLRSITDVYLLNLALSDLLFVFSFPFQTYYLLDQWVFGTVMCKVVSGFYYIGFYSSMFFITLMSVDRYLAVVHAVYALKVRTIRMGTTLCLAVWLTAIMATIPLLVFYQVASEDGVLQCYSFYNQQTLKWKIFTNFKMNILGLLIPFTIFMFCYIKILHQLKRCQNHNKTKAIRLVLIVVIASLLFWVPFNVVLFLTSLHSMHILDGCSISQQLTYATHVTEIISFTHCCVNPVIYAFVGEKFKKHLSEIFQKSCSQIFNYLGRQMPRESCEKSSSCQQHSSRSSSVDYIL

SEQ ID NO: 768 - protein, 369 aa, unidentified
MTPTDFTSPIPNMADDYGSESTSSMEDYVNFNFTDFYCEKNNVRQFASHFLPPLYWLVFIVGALGNSLVILVYWYCTRVKTMTDMFLLNLAIADLLFLVTLPFWAIAAADQWKFQTFMCKVVNSMYKMNFYSCVLLIMCISVDRYIAIAQAMRAHTWREKRLLYSKMVCFTIWVLAAALCIPEILYSQIKEESGIAICTMVYPSDESTKLKSAVLTLKVILGFFLPFVVMACCYTIIIHTLIQAKKSSKHKALKVTITVLTVFVLSQFPYNCILLVQTIDAYAMFISNCAVSTNIDICFQVTQTIAFFHSCLNPVLYVFVGERFRRDLVKTLKNLGCISQAQWVSFTRREGSLKLSSMLLETTSGALSL

SEQ ID NO: 769 - protein, 344 aa, unidentified
MANYTLAPEDEYDVLIEGELESDEAEQCDKYDAQALSAQLVPSLCSAVFVIGVLDNLLVVLILVKYKGLKRVENIYLLNLAVSNLCFLLTLPFWAHAGGDPMCKILIGLYFVGLYSETFFNCLLTVQRYLVFLHKGNFFSARRRVPCGIITSVLAWVTAILATLPEFVVYKPQMEDQKYKCAFSRTPFLPADETFWKHFLTLKMNISVLVLPLFIFTFLYVQMRKTLRFREQRYSLFKLVFAIMVVFLLMWAPYNIAFFLSTFKEHFSLSDCKSSYNLDKSVHITKLIATTHCCINPLLYAFLDGTFSKYLCRCFHLRSNTPLQPRGQSAQGTSREEPDHSTEV

SEQ ID NO: 770 - protein, 1021 aa, unidentified
MAGISYVASFFLLLTKLSIGQREVTVQKGPLFRAEGYPVSIGCNVTGHQGPSEQHFQWSVYLPTNPTQEVQIISTKDAAFSYAVYTQRVRSGDVYVERVQGNSVLLHISKLQMKDAGEYECHTPNTDEKYYGSYSAKTNLIVIPDTLSATMSSQTLGKEEGEPLALTCEASKATAQHTHLSVTWYLTQDGGGSQATEIISLSKDFILVPGPLYTERFAASDVQLNKLGPTTFRLSIERLQSSDQGQLFCEATEWIQDPDETWMFITKKQTDQTTLRIQPAVKDFQVNITADSLFAEGKPLELVCLVVSSGRDPQLQGIWFFNGTEIAHIDAGGVLGLKNDYKERASQGELQVSKLGPKAFSLKIFSLGPEDEGAYRCVVAEVMKTRTGSWQVLQRKQSPDSHVHLRKPAARSVVMSTKNKQQVVWEGETLAFLCKAGGAESPLSVSWWHIPRDQTQPEFVAGMGQDGIVQLGASYGVPSYHGNTRLEKMDWATFQLEITFTAITDSGTYECRVSEKSRNQARDLSWTQKISVTVKSLESSLQVSLMSRQPQVMLTNTFDLSCVVRAGYSDLKVPLTVTWQFQPASSHIFHQLIRITHNGTIEWGNFLSRFQKKTKVSQSLFRSQLLVHDATEEETGVYQCEVEVYDRNSLYNNRPPRASAISHPLRIAVTLPESKLKVNSRSQVQELSINSNTDIECSILSRSNGNLQLAIIWYFSPVSTNASWLKILEMDQTNVIKTGDEFHTPQRKQKFHTEKVSQDLFQLHILNVEDSDRGKYHCAVEEWLLSTNGTWHKLGEKKSGLTELKLKPTGSKVRVSKVYWTENVTEHREVAIRCSLESVGSSATLYSVMWYWNRENSGSKLLVHLQHDGLLEYGEEGLRRHLHCYRSSSTDFVLKLHQVEMEDAGMYWCRVAEWQLHGHPSKWINQASDESQRMVLTVLPSEPTLPSRICSSAPLLYFLFICPFVLLLLLLISLLCLYWKARKLSTLRSNTRKEKALWVDLKEAGGVTTNRREDEEEDEGN

SEQ ID NO: 771 - protein, 1445 aa, unidentified
MQGPPLLTAAHLLCVCTAALAVAPGPRFLVTAPGIIRPGGNVTIGVELLEHCPSQVTVKAELLKTASNLTVSVLEAEGVFEKGSFKTLTLPSLPLNSADEIYELRVTGRTQDEILFSNSTRLSFETKRISVFIQTDKALYKPKQEVKFRIVTLFSDFKPYKTSLNILIKDPKSNLIQQWLSQQSDLGVISKTFQLSSHPILGDWSIQVQVNDQTYYQSFQVSEYVLPKFEVTLQTPLYCSMNSKHLNGTITAKYTYGKPVKGDVTLTFLPLSFWGKKKNITKTFKINGSANFSFNDEEMKNVMDSSNGLSEYLDLSSPGPVEILTTVTESVTGISRNVSTNVFFKQHDYIIEFFDYTTVLKPSLNFTATVKVTRADGNQLTLEERRNNVVITVTQRNYTEYWSGSNSGNQKMEAVQKINYTVPQSGTFKIEFPILEDSSELQLKAYFLGSKSSMAVHSLFKSPSKTYIQLKTRDENIKVGSPFELVVSGNKRLKELSYMVVSRGQLVAVGKQNSTMFSLTPENSWTPKACVIVYYIEDDGEIISDVLKIPVQLVFKNKIKLYWSKVKAEPSEKVSLRISVTQPDSIVGIVAVDKSVNLMNASNDITMENVVHELELYNTGYYLGMFMNSFAVFQECGLWVLTDANLTKDYIDGVYDNAEYAERFMEENEGHIVDIHDFSLGSSPHVRKHFPETWIWLDTNMGYRIYQEFEVTVPDSITSWVATGFVISEDLGLGLTTTPVELQAFQPFFIFLNLPYSVIRGEEFALEITIFNYLKDATEVKVIIEKSDKFDILMTSNEINATGHQQTLLVPSEDGATVLFPIRPTHLGEIPITVTALSPTASDAVTQMILVKAEGIEKSYSQSILLDLTDNRLQSTLKTLSFSFPPNTVTGSERVQITAIGDVLGPSINGLASLIRMPYGCGEQNMINFAPNIYILDYLTKKKQLTDNLKEKALSFMRQGYQRELLYQREDGSFSAFGNYDPSGSTWLSAFVLRCFLEADPYIDIDQNVLHRTYTWLKGHQKSNGEFWDPGRVIHSELQGGNKSPVTLTAYIVTSLLGYRKYQPNIDVQESIHFLESEFSRGISDNYTLALITYALSSVGSPKAKEALNMLTWRAEQEGGMQFWVSSESKLSDSWQPRSLDIEVAAYALLSHFLQFQTSEGIPIMRWLSRQRNSLGGFASTQDTTVALKALSEFAALMNTERTNIQVTVTGPSSPSPVKFLIDTHNRLLLQTAELAVVQPTAVNISANGFGFAICQLNVVYNVKASGSSRRRRSIQNQEAFDLDVAVKENKDDLNHVDLNVCTSFSGPGRSGMALMEVNLLSGFMVPSEAISLSETVKKVEYDHGKLNLYLDSVNETQFCVNIPAVRNFKVSNTQDASVSIVDYYEPRRQAVRSYNSEVKLSSCDLCSDVQGCRPCEDGASGSHHHSSVIFIFCFKLLYFMELWL

SEQ ID NO: 772 - protein, 253 aa, unidentified
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVVPDSCCKTVVALCGQRDHASNIYKVEGGCITKLETFIQEHLRVIGAVGIGIACVQVFGMIFTCCLYRSLKLEHY

SEQ ID NO: 773 - protein, 1156 aa, unidentified
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAIWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSENSHESADFSAAELISVSKFLPISGMEKEAILSHTEKENGNL

SEQ ID NO: 774 - protein, 1453 aa, unidentified
MMLPQNSWHIDFGRCCCHQNLFSAVVTCILLLNSCFLISSFNGTDLELRLVNGDGPCSGTVEVKFQGQWGTVCDDGWNTTASTVVCKQLGCPFSFAMFRFGQAVTRHGKIWLDDVSCYGNESALWECQHREWGSHNCYHGEDVGVNCYGEANLGLRLVDGNNSCSGRVEVKFQERWGTICDDGWNLNTAAVVCRQLGCPSSFISSGVVNSPAVLRPIWLDDILCQGNELALWNCRHRGWGNHDCSHNEDVTLTCYDSSDLELRLVGGTNRCMGRVELKIQGRWGTVCHHKWNNAAADVVCKQLGCGTALHFAGLPHLQSGSDVVWLDGVSCSGNESFLWDCRHSGTVNFDCLHQNDVSVICSDGADLELRLADGSNNCSGRVEVRIHEQWWTICDQNWKNEQALVVCKQLGCPFSVFGSRRAKPSNEARDIWINSISCTGNESALWDCTYDGKAKRTCFRRSDAGVICSDKADLDLRLVGAHSPCYGRLEVKYQGEWGTVCHDRWSTRNAAVVCKQLGCGKPLHVFGMTYFKEASGPIWLDDVSCIGNESNIWDCEHSGWGKHNCVHREDVIVTCSGDATWGLRLVGGSNRCSGRLEVYFQGRWGTVCDDGWNSKAAAVVCSQLDCPSSIIGMGLGNASTGYGKIWLDDVSCDGDESDLWSCRNSGWGNNDCSHSEDVGVICSDASDMELRLVGGSSRCAGKVEVNVQGAVGILCANGWGMNIAEVVCRQLECGSAIRVSREPHFTERTLHILMSNSGCTGGEASLWDCIRWEWKQTACHLNMEASLICSAHRQPRLVGADMPCSGRVEVKHADTWRSVCDSDFSLHAANVLCRELNCGDAISLSVGDHFGKGNGLTWAEKFQCEGSETHLALCPIVQHPEDTCIHSREVGVVCSRYTDVRLVNGKSQCDGQVEINVLGHWGSLCDTHWDPEDARVLCRQLSCGTALSTTGGKYIGERSVRVWGHRFHCLGNESLLDNCQMTVLGAPPCIHGNTVSVICTGSLTQPLFPCLANVSDPYLSAVPEGSALICLEDKRLRLVDGDSRCAGRVEIYHDGFWGTICDDGWDLSDAHVVCQKLGCGVAFNATVSAHFGEGSGPIWLDDLNCTGMESHLWQCPSRGWGQHDCRHKEDAGVICSEFTALRLYSETETESCAGRLEVFYNGTWGSVGRRNITTAIAGIVCRQLGCGENGVVSLAPLSKTGSGFMWVDDIQCPKTHISIWQCLSAPWERRISSPAEETWITCEDRIRVRGGDTECSGRVEIWHAGSWGTVCDDSWDLAEAEVVCQQLGCGSALAALRDASFGQGTGTIWLDDMRCKGNESFLWDCHAKPWGQSDCGHKEDAGVRCSGQSLKSLNASSGHLALILSSIFGLLLLVLFILFLTWCRVQKQKHLPLRVSTRRRGSLEENLFHEMETCLKREDPHGTRTSDDTPNHGCEDASDTSLLGVLPASEATK

SEQ ID NO: 775 - protein, 197 aa, unidentified
MSRLSRSLLWAATCLGVLCVLSADKNTTQHPNVTTLAPISNVTSAPVTSLPLVTTPAPETCEGRNSCVSCFNVSVVNTTCFWIECKDESYCSHNSTVSDCQVGNTTDFCSVSTATPVPTANSTAKPTVQPSPSTTSKTVTTSGTTNNTVTPTSQPVRKSTFDAASFIGGIVLVLGVQAVIFFLYKFCKSKERNYHTL

SEQ ID NO: 776 - protein, 174 aa, unidentified
MEAPGPRALRTALCGGCCCLLLCAQLAVAGKGARGFGRGALIRLNIWPAVQGACKQLEVCEHCVEGDGARNLSSCVWEQCRPEEPGHCVAQSEVVKEGCSIYNRSEACPAAHHHPTYEPKTVTTGSPPVPEAHSPGFDGASFIGGVVLVLSLQAVAFFVLHFLKAKDSTYQTLI

SEQ ID NO: 777 - protein, 661 aa, unidentified
MAFDVSCFFWVVLFSAGCKVITSWDQMCIEKEANKTYNCENLGLSEIPDTLPNTTEFLEFSFNFLPTIHNRTFSRLMNLTFLDLTRCQINWIHEDTFQSHHQLSTLVLTGNPLIFMAETSLNGPKSLKHLFLIQTGISNLEFIPVHNLENLESLYLGSNHISSIKFPKDFPARNLKVLDFQNNAIHYISREDMRSLEQAINLSLNFNGNNVKGIELGAFDSTIFQSLNFGGTPNLSVIFNGLQNSTTQSLWLGTFEDIDDEDISSAMLKGLCEMSVESLNLQEHRFSDISSTTFQCFTQLQELDLTATHLKGLPSGMKGLNLLKKLVLSVNHFDQLCQISAANFPSLTHLYIRGNVKKLHLGVGCLEKLGNLQTLDLSHNDIEASDCCSLQLKNLSHLQTLNLSHNEPLGLQSQAFKECPQLELLDLAFTRLHINAPQSPFQNLHFLQVLNLTYCFLDTSNQHLLAGLPVLRHLNLKGNHFQDGTITKTNLLQTVGSLEVLILSSCGLLSIDQQAFHSLGKMSHVDLSHNSLTCDSIDSLSHLKGIYLNLAANSINIISPRLLPILSQQSTINLSHNPLDCTCSNIHFLTWYKENLHKLEGSEETTCANPPSLRGVKLSDVKLSCGITAIGIFFLIVFLLLLAILLFFAVKYLLRWKYQHI

SEQ ID NO: 778 - protein, 556 aa, unidentified [sequence omitted]

SEQ ID NO: 779 - protein, 327 aa, unidentified
MLFLLLPLLAVLPGDGNADGLKEPLSFHVTWIASFYNHSWKQNLVSGWLSDLQTHTWDSNSSTIVFLCPWSRGNFSNEEWKELETLFRIRTIRSFEGIRRYAHELQFEYPFEIQVTGGCELHSGKVSGSFLQLAYQGSDFVSFQNNSWLPYPVAGNMAKHFCKVLNQNQHENDITHNLLSDTCPRFILGLLDAGKAHLQRQVKPEAWLSHGPSPGPGHLQLVCHVSGFYPKPVWVMWMRGEQEQQGTQRGDILPSADGTWYLRATLEVAAGEAADLSCRVKHSSLEGQDIVLYWEHHSSVGFIILAVIVPLLLLIGLALWFRKRCFC

SEQ ID NO: 780 - protein, 333 aa, unidentified
MLLLPFQLLAVLFPGGNSEHAFQGPTSFHVIQTSSFTNSTWAQTQGSGWLDDLQIHGWDSDSGTAIFLKPWSKGNFSDKEVAELEEIFRVYIFGFAREVQDFAGDFQMKYPFEIQGIAGCELHSGGAIVSFLRGALGGLDFLSVKNASCVPSPEGGSRAQKFCALIIQYQGIMETVRILLYETCPRYLLGVLNAGKADLQRQVKPEAWLSSGPSPGPGRLQLVCHVSGFYPKPVWVMWMRGEQEQQGTQLGDILPNANWTWYLRATLDVADGEAAGLSCRVKHSSLEGQDIILYWRNPTSIGSIVLAIIVPSLLLLLCLALWYMRRRSYQNIP

SEQ ID NO: 781 - protein, 333 aa, unidentified
MLFLQFLLLALLLPGGDNADASQEHVSFHVIQIFSFVNQSWARGQGSGWLDELQTHGWDSESGTIIFLHNWSKGNFSNEELSDLELLFRFYLFGLTREIQDHASQDYSKYPFEVQVKAGCELHSGKSPEGFFQVAFNGLDLLSFQNTTWVPSPGCGSLAQSVCHLLNHQYEGVTETVYNLIRSTCPRFLLGLLDAGKMYVHRQVRPEAWLSSRPSLGSGQLLLVCHASGFYPKPVWVTWMRNEQEQLGTKHGDILPNADGTWYLQVILEVASEEPAGLSCRVRHSSLGGQDIILYWGHHFSMNWIALVVIVPLVILIVLVLWFKKHCSYQDIL

SEQ ID NO: 782 - protein, 335 aa, unidentified
MGCLLFLLLWALLQAWGSAEVPQRLFPLRCLQISSFANSSWTRTDGLAWLGELQTHSWSNDSDTVRSLKPWSQGTFSDQQWETLQHIFRVYRSSFTRDVKEFAKMLRLSYPLELQVSAGCEVHPGNASNNFFHVAFQGKDILSFQGTSWEPTQEAPLWVNLAIQVLNQDKWTRETVQWLLNGTCPQFVSGLLESGKSELKKQVKPKAWLSRGPSPGPGRLLLVCHVSGFYPKPVWVKWMRGEQEQQGTQPGDILPNADETWYLRATLDVVAGEAAGLSCRVKHSSLEGQDIVLYWGGSYTSMGLIALAVLACLLFLLIVGFTSRFKRQTSYQGVL

SEQ ID NO: 783 - protein, 388 aa, unidentified
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQRGDVLPNADETWYLRATLDVAAGEAAGLSCRVKHSSLGGHDLIIHWGGYSIFLILICLTVIVTLVILVVVDSRLKKQSSNKNILSPHTPSPVFLMGANTQDTKNSRHQFCLAQVSWIKNRVLKKWKTRLNQLW

SEQ ID NO: 784 - protein, 351 aa, unidentified
MSFPCKFVASFLLIFNVSSKGAVSKEITNALETWGALGQDINLDIPSFQMSDDIDDIKWEKTSDKKKIAQFRKEKETFKEKDTYKLFKNGTLKIKHLKTDDQDIYKVSIYDTKGKNVLEKIFDLKIQERVSKPKISWTCINTTLTCEVMNGTDPELNLYQDGKHLKLSQRVITHKWTTSLSAKFKCTAGNKVSKESSVEPVSCPEKGLDIYLIIGICGGGSLLMVFVALLVFYITKRKKQRSRRNDEELETRAHRVATEERGRKPHQIPASTPQNPATSQHPPPPPGHRSQAPSHRPPPPGHRVQHQPQKRPPAPSGTQVHQQKGPPLPRPRVQPKPPHGAAENSLSPSSN

SEQ ID NO: 785 - protein, 278 aa, unidentified
MERLVIRMPFSHLSTYSLVWVMAAVVLCTAQVQVVTQDEREQLYTPASLKCSLQNAQEALIVTWQKKKAVSPENMVTFSENHGVVIQPAYKDKINITQLGLQNSTITFWNITLEDEGCYMCLFNTFGFGKISGTACLTVYVQPIVSLHYKFSEDHLNITCSATARPAPMVFWKVPRSGIENSTVTLSHPNGTTSVTSILHIKDPKNQVGKEVICQVLHLGTVTDFKQTVNKGYWFSVPLLLSIVSLVILLVLISILLYWKRHRNQDRGELSQGVQKMT

SEQ ID NO: 786 - protein, 325 aa, unidentified [sequence omitted]

SEQ ID NO: 787 - protein, 271 aa, unidentified
MSAPRLLISIIIMVSASSSSCMGGKQMTQNYSTIFAEGNISQPVLMDINAVLCCPPIALRNLIIITWEIILRGQPSCTKAYKKETNETKETNCTVERITWVSRPDQNSDLQIRPVDTTHDGYYRGIVVTPDGNFHRGYHLQVLVTPEVNLFQSRNITAVCKAVTGKPAAQISWIPEGSILATKQEYWGNGTVTVKSTCPWEGHKSTVTCHVSHLTGNKSLSVKLNSGLRTSGSPALSLLIILYVKLSLFVVILVTTGFVFFQRINHVRKVL

SEQ ID NO: 788 - protein, 328 aa, unidentified
MTVEKEAPDAHFTVDKQNISLWPREPPPKSGPSLVPGKTPTVRAALICLTLVLVASVLLQAVLYPRFMGTISDVKTNVQLLKGRVDNISTLDSEIKKNSDGMEAAGVQIQMVNESLGYVRSQFLKLKTSVEKANAQIQILTRSWEEVSTLNAQIPELKSDLEKASALNTKIRALQGSLENMSKLLKRQNDILQVVSQGWKYFKGNFYYFSLIPKTWYSAEQFCVSRNSHLTSVTSESEQEFLYKTAGGLIYWIGLTKAGMEGDWSWVDDTPFNKVQSVRFWIPGEPNNAGNNEHCGNIKAPSLQAWNDAPCDKTFLFICKRPYVPSEP

SEQ ID NO: 789 - protein, 404 aa, unidentified
MSDSKEPRLQQLGLLEEEQLRGLGFRQTRGYKSLAGCLGHGPLVLQLLSFTLLAGLLVQVSKVPSSISQEQSRQDAIYQNLTQLKAAVGELSEKSKLQEIYQELTQLKAAVGELPEKSKLQEIYQELTRLKAAVGELPEKSKLQEIYQELTWLKAAVGELPEKSKMQEIYQELTRLKAAVGELPEKSKQQEIYQELTRLKAAVGELPEKSKQQEIYQELTRLKAAVGELPEKSKQQEIYQELTQLKAAVERLCHPCPWEWTFFQGNCYFMSNSQRNWHDSITACKEVGAQLVVIKSAEEQNFLQLQSSRSNRFTWMGLSDLNQEGTWQWVDGSPLLPSFKQYWNRGEPNNVGEEDCAEFSGNGWNDDKCNLAKFWICKKSAASCSRDEEQFLSPAPATPNPPPA

SEQ ID NO: 790 - protein, 847 aa, unidentified
MHLLGPWLLLLVLEYLAFSDSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVALNVQYAPRDVRVRKIKPLSEIHSGNSVSLQCDFSSSHPKEVQFFWEKNGRLLGKESQLNFDSISPEDAGSYSCWVNNSIGQTASKAWTLEVLYAPRRLRVSMSPGDQVMEGKSATLTCESDANPPVSHYTWFDWNNQSLPYHSQKLRLEPVKVQHSGAYWCQGTNSVGKGRSPLSTLTVYYSPETIGRRVAVGLGSCLAILILAICGLKLQRRWKRTQSQQGLQENSSGQSFFVRNKKVRRAPLSEGPHSLGCYNPMMEDGISYTTLRFPEMNIPRTGDAESSEMQRPPPDCDDTVTYSALHKRQVGDYENVIPDFPEDEGIHYSELIQFGVGERPQAQENVDYVILKH

SEQ ID NO: 791 - protein, 336 aa, unidentified
MDYPTLLLALLHVYRALCEEVLWHTSVPFAENMSLECVYPSMGILTQVEWFKIGTQQDSIAIFSPTHGMVIRKPYAERVYFLNSTMASNNMTLFFRNASEDDVGYYSCSLYTYPQGTWQKVIQVVQSDSFEAAVPSNSHIVSEPGKNVTLTCQPQMTWPVQAVRWEKIQPRQIDLLTYCNLVHGRNFTSKFPRQIVSNCSHGRWSVIVIPDVTVSDSGLYRCYLQASAGENETFVMRLTVAEGKTDNQYTLFVAGGTVLLLLFVISITTIIVIFLNRRRRRERRDLFTESWDTQKAPNNYRSPISTSQPTNQSMDDTREDIYVNYPTFSRRPKTRV

SEQ ID NO: 792 - protein, 370 aa, unidentified
MLGQVVTLILLLLLKVYQGKGCQGSADHVVSISGVPLQLQPNSIQTKVDSIAWKKLLPSQNGFHHILKWENGSLPSNTSNDRFSFIVKNLSLLIKAAQQQDSGLYCLEVTSISGKVQTATFQVFVFESLLPDKVEKPRLQGQGKILDRGRCQVALSCLVSRDGNVSYAWYRGSKLIQTAGNLTYLDEEVDINGTHTYTCNVSNPVSWESHTLNLTQDCQNAHQEFRFWPFLVIIVILSALFLGTLACFCVWRRKRKEKQSETSPKEFLTIYEDVKDLKTRRNHEQEQTFPGGGSTIYSMIQSQSSAPTSQEPAYTLYSLIQPSRKSGSRKRNHSPSFNSTIYEVIGKSQPKAQNPARLSRKELENFDVYS

SEQ ID NO: 793 - protein, 164 aa, unidentified
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 794 - protein, 757 aa, unidentified
MLLRLLLAWAAAGPTLGQDPWAAEPRAACGPSSCYALFPRRRTFLEAWRACRELGGDLATPRTPEEAQRVDSLVGAGPASRLLWIGLQRQARQCQLQRPLRGFTWTTGDQDTAFTNWAQPASGGPCPAQRCVALEASGEHRWLEGSCTLAVDGYLCQFGFEGACPALQDEAGQAGPAVYTTPFHLVSTEFEWLPFGSVAAVQCQAGRGASLLCVKQPEGGVGWSRAGPLCLGTGCSPDNGGCEHECVEEVDGHVSCRCTEGFRLAADGRSCEDPCAQAPCEQQCEPGGPQGYSCHCRLGFRPAEDDPHRCVDTDECQIAGVCQQMCVNYVGGFECYCSEGHELEADGISCSPAGAMGAQASQDLGDELLDDGEDEEDEDEAWKAFNGGWTEMPGILWMEPTQPPDFALAYRPSFPEDREPQIPYPEPTWPPPLSAPRVPYHSSVLSVTRPVVVSATHPTLPSAHQPPVIPATHPALSRDHQIPVIAANYPDLPSAYQPGILSVSHSAQPPAHQPPMISTKYPELFPAHQSPMFPDTRVAGTQTTTHLPGIPPNHAPLVTTLGAQLPPQAPDALVLRTQATQLPIIPTAQPSLTTTSRSPVSPAHQISVPAATQPAALPTLLPSQSPTNQTSPISPTHPHSKAPQIPREDGPSPKLALWLPSPAPTAAPTALGEAGLAEHSQRDDRWLLVALLVPTCVFLVVLLALGIVYCTRCGPHAPNKRITDCYRWVIHAGSKSPTEPMPPRGSLTGVQTCRTSV

SEQ ID NO: 795 - protein, 260 aa, unidentified
MARPHPWWLCVLGTLVGLSATPAPKSCPERHYWAQGKLCCQMCEPGTFLVKDCDQHRKAAQCDPCIPGVSFSPDHHTRPHCESCRHCNSGLLVRNCTITANAECACRNGWQCRDKECTECDPLPNPSLTARSSQALSPHPQPTHLPYVSEMLEARTAGHMQTLADFRQLPARTLSTHWPPQRSLCSSDFIRILVIFSGMFLVFTLAGALFLHQRRKYRSNKGESPVEPAEPCHYSCPREEEGSTIPIQEDYRKPEPACSP

SEQ ID NO: 796 - protein, 290 aa, unidentified
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 797 - protein, 534 aa, unidentified
MLRRRGSPGMGVHVGAALGALWFCLTGALEVQVPEDPVVALVGTDATLCCSFSPEPGFSLAQLNLIWQLTDTKQLVHSFAEGQDQGSAYANRTALFPDLLAQGNASLRLQRVRVADEGSFTCFVSIRDFGSAAVSLQVAAPYSKPSMTLEPNKDLRPGDTVTITCSSYQGYPEAEVFWQDGQGVPLTGNVTTSQMANEQGLFDVHSILRVVLGANGTYSCLVRNPVLQQDAHSSVTITPQRSPTGAVEVQVPEDPVVALVGTDATLRCSFSPEPGFSLAQLNLIWQLTDTKQLVHSFTEGRDQGSAYANRTALFPDLLAQGNASLRLQRVRVADEGSFTCFVSIRDFGSAAVSLQVAAPYSKPSMTLEPNKDLRPGDTVTITCSSYRGYPEAEVFWQDGQGVPLTGNVTTSQMANEQGLFDVHSVLRVVLGANGTYSCLVRNPVLQQDAHGSVTITGQPMTFPPEALWVTVGLSVCLIALLVALAFVCWRKIKQSCEEENAGAEDQDGEGEGSKTALQPLKHSDSKEDDGQEIA

SEQ ID NO: 798 - protein, 220 aa, unidentified
MLRLLLALNLFPSIQVTGNKILVKQSPMLVAYDNAVNLSCKYSYNLFSREFRASLHKGLDSAVEVCVVYGNYSQQLQVYSKTGFNCDGKLGNESVTFYLQNLYVNQTDIYFCKIEVMYPPPYLDNEKSNGTIIHVKGKHLCPSPLFPGPSKPFWVLVVVGGVLACYSLLVTVAFIIFWVRSKRSRLLHSDYMNMTPRRPGPTRKHYQPYAPPRDFAAYRS

SEQ ID NO: 799 - protein, 299 aa, unidentified
MWLPWALLLLWVPGCFALSKCRTVAGPVGGSLSVQCPYEKEHRTLNKYWCRPPQIFLCDKIVETKGSAGKRNGRVSIRDSPANLSFTVTLENLTEEDAGTYWCGVDTPWLRDFHDPVVEVEVSVFPASTSMTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEYSTVASPREELHYASVVFDSNTNRIAAQRPREEEPDSDYSVIRKT

SEQ ID NO: 800 - protein, 224 aa, unidentified
MTARAWASWRSSALLLLLVPGYFPLSHPMTVAGPVGGSLSVQCRYEKEHRTLNKFWCRPPQILRCDKIVETKGSAGKRNGRVSIRDSPANLSFTVTLENLTEEDAGTYWCGVDTPWLRDFHDPIVEVEVSVFPAGTTTASSPQSSMGTSGPPTKLPVHTWPSVTRKDSPEPSPHPGSLFSNVRFLLLVLLELPLLLSMLGAVLWVNRPQRSSRSRQNWPKGENQ

SEQ ID NO: 801 - protein, 205 aa, unidentified
MWLLPALLLLCLSGCLSLKGPGSVTGTAGDSLTVWCQYESMYKGYNKYWCRGQYDTSCESIVETKGEEKVERNGRVSIRDHPEALAFTVTMQNLNEDDAGSYWCKIQTVWVLDSWSRDPSDLVRVYVSPAITTPRRTTHPATPPIFLVVNPGRNLSTGEVLTQNSGFRLSSPHFLLVVLLKLPLLLSMLGAVFWVNRPQWAPPGR

SEQ ID NO: 802 - protein, 201 aa, unidentified
MWLPPALLLLSLSGCFSIQGPESVRAPEQGSLTVQCHYKQGWETYIKWWCRGVRWDTCKILIETRGSEQGEKSDRVSIKDNQKDRTFTVTMEGLRRDDADVYWCGIERRGPDLGTQVKVIVDPEGAASTTASSPTNSNMAVFIGSHKRNHYMLLVFVKVPILLILVTAILWLKGSQRVPEEPGEQPIYMNFSEPLTKDMAT

SEQ ID NO: 803 - protein, 194 aa, unidentified
MWLSPSLLLLILPGYSIAAKITGPTTVNGSEQGSLTVQCAYGSGWETYLKWRCQGADWNYCNILVKTNGSEQEVKKNRVSIRDNQKNHVFTVTMENLKRDDADSYWCGTERPGIDLGVKVQVTINPGTQTAVSEWTTTTASLAFTAAATQKTSSPLTRSPLKSTHFLFLFLLELPLLLSMLGTVLWVNRPQRRS

SEQ ID NO: 804 - protein, 290 aa, unidentified
MPLLTLYLLLFWLSGYSIVTQITGPTTVNGLERGSLTVQCVYRSGWETYLKWWCRGAIWRDCKILVKTSGSEQEVKRDRVSIKDNQKNRTFTVTMEDLMKTDADTYWCGIEKTGNDLGVTVQVTIDPAPVTQEETSSSPTLTGHHLDNRHKLLKLSVLLPLIFTILLLLLVAASLLAWRMMKYQQKAAGMSPEQVLQPLEGDLCYADLTLQLAGTSPQKATTKLSSAQVDQVEVEYVTMASLPKEDISYASLTLGAEDQEPTYCNMGHLSSHLPGRGPEEPTEYSTISRP

SEQ ID NO: 805 - protein, 332 aa, unidentified
MRLLVLLWGCLLLPGYEALEGPEEISGFEGDTVSLQCTYREELRDHRKYWCRKGGILFSRCSGTIYAEEEGQETMKGRVSIRDSRQELSLIVTLWNLTLQDAGEYWCGVEKRGPDESLLISLFVFPGPCCPPSPSPTFQPLATTRLQPKAKAQQTQPPGLTSPGLYPAATTAKQGKTGAEAPPLPGTSQYGHERTSQYTGTSPHPATSPPAGSSRPPMQLDSTSAEDTSPALSSGSSKPRVSIPMVRILAPVLVLLSLLSAAGLIAFCSHLLLWRKEAQQATETQRNEKFCLSRLTAEEKEAPSQAPEGDVISMPPLHTSEEELGFSKFVSA

SEQ ID NO: 806 - protein, 232 aa, unidentified
MLRAALPALLLPLLGLAAAAVADCPSSTWIQFQDSCYIFLQEAIKVESIEDVRNQCTDHGADMISIHNEEENAFILDTLKKQWKGPDDILLGMFYDTDDASFKWFDNSNMTFDKWTDQDDDEDLVDTCAFLHIKTGEWKKGNCEVSSVEGTLCKTAIPYKRKYLSDNHILISALVIASTVILTVLGAIIWFLYKKHSDSRFTTVFSTAPQSPYNEDCVLVVGEENEYPVQFD

SEQ ID NO: 807 - protein, 282 aa, unidentified
MSGGWMAQVGAWRTGALGLALLLLLGLGLGLEAAASPLSTPTSAQAAGPSSGSCPPTKFQCRTSGLCVPLTWRCDRDLDCSDGSDEEECRIEPCTQKGQCPPPPGLPCPCTGVSDCSGGTDKKLRNCSRLACLAGELRCTLSDDCIPLTWRCDGHPDCPDSSDELGCGTNEILPEGDATTMGPPVTLESVTSLRNATTMGPPVTLESVPSVGNATSSSAGDQSGSPTAYGVIAAAAVLSASLVTATLLLLSWLRAQERLRPLGLLVAMKESLLLSEQKTSLP

SEQ ID NO: 808 - protein, 364 aa, unidentified
MPLLLLLPLLWAGALAMDPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVHGAIGGAGVTALLALCLCLIFFIVKTHRRKAARTAVGRNDTHPTTGSASPKHQKKSKLHGPTETSSCSGAAPTVEMDEELHYASLNFHGMNPSKDTSTEYSEVRTQ

SEQ ID NO: 809 - protein, 385 aa, unidentified
MLVRRGARAGPRMPRGWTALCLLSLLPSGFMSLDNNGTATPELPTQGTFSNVSTNVSYQETTTPSTLGSTSLHPVSQHGNEATTNITETTVKFTSTSVITSVYGNTNSSVQSQTSVISTVFTTPANVSTPETTLKPSLSPGNVSDLSTTSTSLATSPTKPYTSSSPILSDIKAEIKCSGIREVKLTQGICLEQNKTSSCAEFKKDRGEGLARVLCGEEQADADAGAQVCSLLLAQSEVRPQCLLLVLANRTEISSKLQLMKKHQSDLKKLGILDFTEQDVASHQSYSQKTLIALVTSGALLAVLGITGYFLMNRRSWSPTGERLGEDPYYTENGGGQGYSSGPGTSPEAQGKASVNRGAQENGTGQATSRNGHSARQHVVADTEL

SEQ ID NO: 810 - protein, 472 aa, unidentified
MGCDRNCGLIAGAVIGAVLAVFGGILMPVGDLLIQKTIKKQVVLEEGTIAFKNWVKTGTEVYRQFWIFDVQNPQEVMMNSSNIQVKQRGPYTYRVRFLAKENVTQDAEDNTVSFLQPNGAIFEPSLSVGTEADNFTVLNLAVAAASHIYQNQFVQMILNSLINKSKSSMFQVRTLRELLWGYRDPFLSLVPYPVTTTVGLFYPYNNTADGVYKVFNGKDNISKVAIIDTYKGKRNLSYWESHCDMINGTDAASFPPFVEKSQVLQFFSSDICRSIYAVFESDVNLKGIPVYRFVLPSKAFASPVENPDNYCFCTEKIISKNCTSYGVLDISKCKEGRPVYISLPHFLYASPDVSEPIDGLNPNEEEHRTYLDIEPITGFTLQFAKRLQVNLLVKPSEKIQVLKNLKRNYIVPILWLNETGTIGDEKANMFRSQVTGKINLLGLIEMILLSVGVVMFVAFMISYCACRSKTIK

SEQ ID NO: 811 - protein, 281 aa, unidentified
MSAQESCLSLIKYFLFVFNLFFFVLGSLIFCFGIWILIDKTSFVSFVGLAFVPLQIWSKVLAISGIFTMGIALLGCVGALKELRCLLGLYFGMLLLLFATQITLGILISTQRAQLERSLRDVVEKTIQKYGTNPEETAAEESWDYVQFQLRCCGWHYPQDWFQVLILRGNGSEAHRVPCSCYNLSATNDSTILDKVILPQLSRLGHLARSRHSADICAVPAESHIYREGCAQGLQKWLHNNLISIVGICLGVGLLELGFMTLSIFLCRNLDHVYNRLARYR

SEQ ID NO: 812 - protein, 171 aa, unidentified
MEHSTFLSGLVLATLLSQVSPFKIPIEELEDRVFVNCNTSITWVEGTVGTLLSDITRLDLGKRILDPRGIYRCNGTDIYKDKESTVQVHYRMCQSCVELDPATVAGIIVTDVIATLLLALGVFCFAGHETGRLSGAADTQALLRNDQVYQPLRDRDDAQYSHLGGNWARNK

SEQ ID NO: 813 - protein, 207 aa, unidentified
MQSGTHWRVLGLCLLSVGVWGQDGNEEMGGITQTPYKVSISGTTVILTCPQYPGSEILWQHNDKNIGGDEDDKNIGSDEDHLSLKEFSELEQSGYYVCYPRGSKPEDANFYLYLRARVCENCMEMDVMSVATIVIVDICITGGLLLLVYYWSKNRKAKAKPVTRGAGAGGRQRGQNKERPPPVPNPDYEPIRKGQRDLYSGLNQRRI

SEQ ID NO: 814 - protein, 182 aa, unidentified
MEQGKGLAVLILAIILLQGTLAQSIKGNHLVKVYDYQEDGSVLLTCDAEAKNITWFKDGKMIGFLTEDKKKWNLGSNAKDPRGMYQCKGSQNKSKPLQVYYRMCQNCIELNAATISGFLFAEIVSIFVLAVGVYFIAGQDGVRQSRASDKQTLLPNDQLYQPLKDREDDQYSHLQGNQLRRN

SEQ ID NO: 815 - protein, 458 aa, unidentified
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQPMALIVLGGVAGLLLFIGLGIFFCVRCRHRRRQAERMSQIKRLLSEKKTCQCPHRFQKTCSPI

SEQ ID NO: 816 - protein, 277 aa, unidentified
MVRLPLQCVLWGCLLTAVHPEPPTACREKQYLINSQCCSLCQPGQKLVSDCTEFTETECLPCGESEFLDTWNRETHCHQHKYCDPNLGLRVQQKGTSETDTICTCEEGWHCTSEACESCVLHRSCSPGFGVKQIATGVSDTICEPCPVGFFSNVSSAFEKCHPWTSCETKDLVVQQAGTNKTDVVCGPQDRLRALVVIPIIFGILFAILLVLVFIKKVAKKPTNKAPHPKQEPQEINFPDDLPGSNTAAPVQETLHGCQPVTQEDGKESRISVQERQ

SEQ ID NO: 817 - protein, 261 aa, unidentified
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 818 - protein, 742 aa, unidentified
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTIQATPSSTTEETATQKEQWFGNRWHEGYRQTPKEDSHSTTGTAAASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 819 - protein, 392 aa, unidentified [sequence omitted]

SEQ ID NO: 820 - protein, 323 aa, unidentified
MWPLVAALLLGSACCGSAQLLFNKTKSVEFTFCNDTVVIPCFVTNMEAQNTTEVYVKWKFKGRDIYTFDGALNKSTVPTDFSSAKIEVSQLLKGDASLKMDKSDAVSHTGNYTCEVTELTREGETIIELKYRVVSWFSPNENILIVIFPIFAILLFWGQFGIKTLKYRSGGMDEKTIALLVAGLVITVIVIVGAILFVPGEYSLKNATGLGLIVTSTGILILLHYYVFSTAIGLTSFVIAILVIQVIAYILAVVGLSLCIAACIPMHGPLLISGLSILALAQLLGLVYMKFVASNQKTIQPPRKAVEEPLNAFKESKGMMNDE

SEQ ID NO: 821 - protein, 243 aa, unidentified
MCSRGWDSCLALELLLLPLSLLVTSIQGHLVHMTVVSGSNVTLNISESLPENYKQLTWFYTFDQKIVEWDSRKSKYFESKFKGRVRLDPQSGALYISKVQKEDNSTYIMRVLKKTGNEQEWKIKLQVLDPVPKPVIKIEKIEDMDDNCYLKLSCVIPGESVNYTWYGDKRPFPKELQNSVLETTLMPHNYSRCYTCQVSNSVSSKNGTVCLSPPCTLARSFGVEWIASWLVVTVPTILGLLLT

SEQ ID NO: 822 - protein, 495 aa, unidentified
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIKPQKSGRVLALLCSGFQPKVQSRLVGGSSICEGTVEVRQGAQWAALCDSSSARSSLRWEEVCREQQCGSVNSYRVLDAGDPTSRGLFCPHQKLSQCHELWERNSYCKKVFVTCQDPNPAGLAAGTVASIILALVLLVVLLVVCGPLAYKKLVKKFRQKKQRQWIGPTGMNQNMSFHRNHTATVRSHAENPTASHVDNEYSQPPRNSHLSAYPALEGALHRSSMQPDNSSDSDYDLHGAQRL

SEQ ID NO: 823 - protein, 61 aa, unidentified
MKRFLFLLLTISLLVMVQIQTGLSGQNDTSQTSSPSASSNISGGIFLFFVANAIIHLFCFS

SEQ ID NO: 824 - protein, 219 aa, unidentified
MGMSSLKLLKYVLFFFNLLFWICGCCILGFGIYLLIHNNFGVLFHNLPSLTLGNVFVIVGSIIMVVAFLGCMGSIKENKCLLMSFFILLLIILLAEVTLAILLFVYEQKLNEYVAKGLTDSIHRYHSDNSTKAAWDSIQSFLQCCGINGTSDWTSGPPASCPSDRKVEGCYAKARLWFHSNFLYIGIITICVCVIEVLGMSFALTLNCQIDKTSQTIGL

SEQ ID NO: 825 - protein, 381 aa, unidentified
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 826 - protein, 250 aa, unidentified
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTNSN

SEQ ID NO: 827 - protein, 128 aa, unidentified
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 828 - protein, 668 aa, unidentified
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDAGAVCSEHQSWRLTGGADRCEGQVEVHFRGVWNTVCDSEWYPSEAKVLCQSLGCGTAVERPKGLPHSLSGRMYYSCNGEELTLSNCSWRFNNSNLCSQSLAARVLCSASRSLHNLSTPEVPASVQTVTIESSVTVKIENKESRELMLLIPSIVLGILLLGSLIFIAFILLRIKGKYALPVMVNHQHLPTTIPAGSNSYQPVPITIPKEVFMLPIQVQAPPPEDSDSGSDSDYEHYDFSAQPPVALTTFYNSQRHRVTDEEVQQSRFQMPPLEEGLEELHASHIPTANPGHCITDPPSLGPQYHPRSNSESSTSSGEDYCNSPKSKLPPWNPQVFSSERSSFLEQPPNLELAGTQPAFSAGPPADDSSSTSSGEWYQNFQPPPQPPSEEQFGCPGSPSPQPDSTDNDDYDDISAA

SEQ ID NO: 829 - protein, 238 aa, unidentified
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 830 - protein, 354 aa, unidentified
MRLAVLFSGALLGLLAAQGTGNDCPHKKSATLLPSFTVTPTVTESTGTTSHRTTKSHKTTTHRTTTTGTTSHGPTTATHNPTTTSHGNVTVHPTSNSTATSQGPSTATHSPATTSHGNATVHPTSNSTATSPGFTSSAHPEPPPPSPSPSPTSKETIGDYTWTNGSQPCVHLQAQIQIRVMYTTQGGGEAWGISVLNPNKTKVQGSCEGAHPHLLLSFPYGHLSFGFMQDLQQKVVYLSYMAVEYNVSFPHAAQWTFSAQNASLRDLQAPLGQSFSCSNSSIILSPAVHLDLLSLRLQAAQLPHTGVFGQSFSCPSDRSILLPLIIGLILLGLLALVLIAFCIIRRRPSAYQAL

SEQ ID NO: 831 - protein, 199 aa, unidentified
MSSENCFVAENSSLHPESGQENDATSPHFSTRHEGSFQVPVLCAVMNVVFITILIIALIALSVGQYNCPGQYTFSMPSDSHVSSCSEDWVGYQRKCYFISTVKRSWTSAQNACSEHGATLAVIDSEKDMNFLKRYAGREEHWVGLKKEPGHPWKWSNGKEFNNWFNVTGSDKCVFLKNTEVSSMECEKNLYWICNKPYK

SEQ ID NO: 832 - protein, 240 aa, unidentified
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 833 - protein, 193 aa, unidentified
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 834 - protein, 359 aa, unidentified
MAEAITYADLRFVKAPLKKSISSRLGQDPGADDDGEITYENVQVPAVLGVPSSLASSVLGDKAAVKSEQPTASWRAVTSPAVGRILPCRTTCLRYLLLGLLLTCLLLGVTAICLGVRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPSGWIMHQKSCFYISLTSKNWQESQKQCETLSSKLATFSEIYPQSHSYYFLNSLLPNGGSGNSYWTGLSSNKDWKLTDDTQRTRTYAQSSKCNKVHKTWSWWTLESESCRSSLPYICEMTAFRFPD

SEQ ID NO: 835 - protein, 296 aa, unidentified
MHRRRSRSCREDQKPVMDDQRDLISNNEQLPMLGRRPGAPESKCSRGALYTGFSILVTLLLAGQATTAYFLYQQQGRLDKLTVTSQNLQLENLRMKLPKPPKPVSKMRMATPLLMQALPMGALPQGPMQNATKYGNMTEDHVMHLLQNADPLKVYPPLKGSFPENLRHLKNTMETIDWKVFESWMHHWLLFEMSRHSLEQKPTDAPPKVLTKCQEEVSHIPAVHPGSFRPKCDENGNYLPLQCYGSIGYCWCVFPNGTEVPNTRSRGHHNCSESLELEDPSSGLGVTKQDLGPVPM

SEQ ID NO: 836 - protein, 226 aa, unidentified
MPGGPGVLQALPATIFLLFLLSAVYLGPGCQALWMHKVPASLMVSLGEDAHFQCPHNSSNNANVTWWRVLHGNYTWPPEFLGPGEDPNGTLIIQNVNKSHGGIYVCRVQEGNESYQQSCGTYLRVRQPPPRPFLDMGEGTKNRIITAEGIILLFCAVVPGTLLLFRKRWQNEKLGLDAGDEYEDENLYEGLNLDDCSMYEDISRGLQGTYQDVGSLNIGDVQLEKP

SEQ ID NO: 837 - protein, 229 aa, unidentified
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 838 - protein, 288 aa, unidentified
MGHTRRQGTSPSKCPYLNFFQLLVLAGLSHFCSGVIHVTKEVKEVATLSCGHNVSVEELAQTRIYWQKEKKMVLTMMSGDMNIWPEYKNRTIFDITNNLSIVILALRPSDEGTYECVVLKYEKDAFKREHLAEVTLSVKADFPTPSISDFEIPTSNIRRIICSTSGGFPEPHLSWLENGEELNAINTTVSQDPETELYAVSSKLDFNMTTNHSFMCLIKYGHLRVNQTFNWNTTKQEHFPDNLLPSWAITLISVNGIFVICCLTYCFAPRCRERRRNERLRRESVRPV

SEQ ID NO: 839 - protein, 236 aa, unidentified
MGVEGCTKCIKYLLFVFNFVFWLAGGVILGVALWLRHDPQTTNLLYLELGDKPAPNTFYVGIYILIAVGAVMMFVGFLGCYGAIQESQCLLGTFFTCLVILFACEVAAGIWGFVNKDQIAKDVKQFYDQALQQAVVDDDANNAKAVVKTFHETLDCCGSSTLTALTTSVLKNNLCPSGSNIISNLFKEDCHQKIDDLFSGKLYLIGIAAIVVAVIMIFEMILSMVLCCGIRNSSVY

SEQ ID NO: 840 - protein, 267 aa, unidentified
MGSACIKVTKYFLFLFNLIFFILGAVILGFGVWILADKSSFISVLQTSSSSLRMGAYVFIGVGAVTMLMGFLGCIGAVNEVRCLLGLYFAFLLLILIAQVTAGALFYFNMGKLKQEMGGIVTELIRDYNSSREDSLQDAWDYVQAQVKCCGWVSFYNWTDNAELMNRPEVTYPCSCEVKGEEDNSLSVRKGFCEAPGNRTQSGNHPEDWPVYQEGCMEKVQAWLQENLGIILGVGVGVAIIELLGMVLSICLCRHVHSEDYSKVPKY

SEQ ID NO: 841 - protein, 205 aa, unidentified
MSRGLQLLLLSCAYSLAPATPEVKVACSEDVDLPCTAPWDPQVPYTVSWVKLLEGGEERMETPQEDHLRGQHYHQKGQNGSFDAPNERPYSLKIRNTTSCNSGTYRCTLQDPDGQRNLSGKVILRVTGCPAQRKEETFKKYRAEIVLLLALVIFYLTLIIFTCKFARLQSIFPDFSKAGMERAFLPVTSPNKHLGLVTPHKTELV

SEQ ID NO: 842 - protein, 345 aa, unidentified
MAQHHLWILLLCLQTWPEAAGKDSEIFTVNGILGESVTFPVNIQEPRQVKIIAWTSKTSVAYVTPGDSETAPVVTVTHRNYYERIHALGPNYNLVISDLRMEDAGDYKADINTQADPYTTTKRYNLQIYRRLGKPKITQSLMASVNSTCNVTLTCSVEKEEKNVTYNWSPLGEEGNVLQIFQTPEDQELTYTCTAQNPVSNNSDSISARQLCADIAMGFRTHHTGLLSVLAMFFLLVLILSSVFLFRLFKRRQGRIFPEGSCLNTFTKNPYAASKKTIYTYIMASRNTQPAESRIYDEILQSKVLPSKEEPVNTVYSEVQFADKMGKASTQDSKPPGTSSYEIVI

SEQ ID NO: 843 - protein, 329 aa, unidentified
MDPQCTMGLSNILFVMAFLLSGAAPLKIQAYFNETADLPCQFANSQNQSLSELVVFWQDQENLVLNEVYLGKEKFDSVHSKYMGRTSFDSDSWTLRLHNLQIKDKGLYQCIIHHKKPTGMIRIHQMNSELSVLANFSQPEIVPISNITENVYINLTCSSIHGYPEPKKMSVLLRTKNSTIEYDGVMQKSQDNVTELYDVSISLSVSFPDVTSNMTIFCILETDKTRLLSSPFSIELEDPQPPPDHIPWITAVLPTVIICVMVFCLILWKWKKKKRPRNSYKCGTNTMEREESEQTKKREKIHIPERSDEAQRVFKSSKTSSCDKSDTCF

SEQ ID NO: 844 - protein, 235 aa, unidentified
MALPVTALLLPLALLLHAARPSQFRVSPLDRTWNLGETVELKCQVLLSNPTSGCSWLFQPRGAAASPTFLLYLSQNKPKAAEGLDTQRFSGKRLGDTFVLTLSDFRRENEGYYFCSALSNSIMYFSHFVPVFLPAKPTTTPAPRPPTPAPTIASQPLSLRPEACRPAAGGAVHTRGLDFACDIYIWAPLAGTCGVLLLSLVITLYCNHRNRRRVCKCPRPVVKSGDKPSLSARYV

SEQ ID NO: 845 - protein, 210 aa, unidentified
MRPRLWLLLAAQLTVLHGNSVLQQTPAYIKVQTNKMVMLSCEAKISLSNMRIYWLRQRQAPSSDSHHEFLALWDSAKGTIHGEEVEQEKIAVFRDASRFILNLTSVKPEDSGIYFCMIVGSPELTFGKGTQLSVVDFLPTTAQPTKKSTLKKRVCRLPRPETQKGPLCSPITLGLLVAGVLVLLVSLGVAIHLCCRRRRARLRFMKQFYK

SEQ ID NO: 846 - protein, 228 aa, unidentified
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 847 - protein, 652 aa, unidentified
MATSMGLLLLLLLLLTQPGAGTGADTEAVVCVGTACYTAHSGKLSAAEAQNHCNQNGGNLATVKSKEEAQHVQRVLAQLLRREAALTARMSKFWIGLQREKGKCLDPSLPLKGFSWVGGGEDTPYSNWHKELRNSCISKRCVSLLLDLSQPLLPSRLPKWSEGPCGSPGSPGSNIEGFVCKFSFKGMCRPLALGGPGQVTYTTPFQTTSSSLEAVPFASAANVACGEGDKDETQSHYFLCKEKAPDVFDWGSSGPLCVSPKYGCNFNNGGCHQDCFEGGDGSFLCGCRPGFRLLDDLVTCASRNPCSSSPCRGGATCVLGPHGKNYTCRCPQGYQLDSSQLDCVDVDECQDSPCAQECVNTPGGFRCECWVGYEPGGPGEGACQDVDECALGRSPCAQGCTNTDGSFHCSCEEGYVLAGEDGTQCQDVDECVGPGGPLCDSLCFNTQGSFHCGCLPGWVLAPNGVSCTMGPVSLGPPSGPPDEEDKGEKEGSTVPRAATASPTRGPEGTPKATPTTSRPSLSSDAPITSAPLKMLAPSGSPGVWREPSIHHATAASGPQEPAGGDSSVATQNNDGTDGQKLLLFYILGTVVAILLLLALALGLLVYRKRRAKREEKKEKKPQNAADSYSWVPERAESRAMENQYSPTPGTDC

SEQ ID NO: 848 - protein, 585 aa, unidentified
MEKKWKYCAVYYIIQIHFVKGVWEKTVNTEENVYATLGSDVNLTCQTQTVGFFVQMQWSKVTNKIDLIAVYHPQYGFYCAYGRPCESLVTFTETPENGSKWTLHLRNMSCSVSGRYECMLVLYPEGIQTKIYNLLIQTHVTADEWNSNHTIEIEINQTLEIPCFQNSSSKISSEFTYAWSVENSSTDSWVLLSKGIKEDNGTQETLISQNHLISNSTLLKDRVKLGTDYRLHLSPVQIFDDGRKFSCHIRVGPNKILRSSTTVKVFAKPEIPVIVENNSTDVLVERRFTCLLKNVFPKANITWFIDGSFLHDEKEGIYITNEERKGKDGFLELKSVLTRVHSNKPAQSDNLTIWCMALSPVPGNKVWNISSEKITFLLGSEISSTDPPLSVTESTLDTQPSPASSVSPARYPATSSVTLVDVSALRPNTTPQPSNSSMTTRGFNYPWTSSGTDTKKSVSRIPSETYSSSPSGAGSTLHDNVFTSTARAFSEVPTTANGSTKTNHVHITGIVVNKPKDGMSWPVIVAALLFCCMILFGLGVRKWCQYQKEIMERPPPFKPPPPPIKYTCIQEPNESDLPYHEMETL

SEQ ID NO: 849 - protein, 185 aa, unidentified
MARGAALALLLFGLLGVLVAAPDGGFDLSDALPDNENKKPTAIPKKPSAGDDFDLGDAVVDGENDDPRPPNPPKPMPNPNPNHPSSSGSFSDADLADGVSGGEGKGGSDGGGSHRKEGEEADAPGVIPGIVGAVVVAVAGAISSFIAYQKKKLCFKENAEQGEVDMESHRNANAEPAVQRTLLEK

SEQ ID NO: 850 - protein, 262 aa, unidentified
MVAWRSAFLVCLAFSLATLVQRGSGDFDDFNLEDAVKETSSVKQPWDHTTTTTTNRPGTTRAPAKPPGSGLDLADALDDQDDGRRKPGIGGRERWNHVTTTTKRPVTTRAPANTLGNDFDLADALDDRNDRDDGRRKPIAGGGGFSDKDLEDIVGGGEYKPDKGKGDGRYGSNDDPGSGMVAEPGTIAGVASALAMALIGAVSSYISYQQKKFCFSIQQGLNADYVKGENLEAVVCEEPQVKYSTLHTQSAEPPPPPEPARI

SEQ ID NO: 851 - protein, 1227 aa, unidentified
MAAVLESLLREEVSVAAVVRWIARSTQGSEDNAGEAAALSSLRALRKEFVPFLLNFLREQSSRVLPQGPPTPAKTPGASAALPGRPGGPPRGSRGARSQLFPPTEAQSTAAEAPLARRGGRRRGPGPARERGGRGLEEGVSGESLPGAGGRRLRGSGSPSRPSLTLSDPPNLSNLEEFPPVGSVPPGPTGTKPSRRINPTPVSEERSLSKPKTCFTSPPISCVPSSQPSALDTSPWGLGLPPGCRSLQEEREMLRKERSKQLQQSPTPTCPTPELGSPLPSRTGSLTDEPADPARVSSRQRLELVALVYSSCIAENLVPNLFLELFFVFQLLTARRMVTAKDSDPELSPAVLDSLESPLFQSIHDCVFFAVQVLECHFQVLSNLDKGTLKLLAENERLLCFSPALQGRLRAAYEGSVAKVSLVMPPSTQAVSFQPETDNRANFSSDRAFHTFKKQRDVFYEVLREWEDHHEEPGWDFEKGLGSRIRAMMGQLSAACSHSHFVRLFQKQLLQMCQSPGGAGGTVLGEAPDVLSMLGADKLGRLWRLQERLMAPQSSGGPCPPPTFPGCQGFFRDFILSASSFQFNQHLMDSLSLKIQELNGLALPQHEPNDEDGESDVDWQGERKQFAVVLLSLRLLAKFLGFVAFLPYRGPEPPPTGELQDSILALRSQVPPVLDVRTLLQRGLQARRAVLTVPWLVEFLSFADHVVPLLEYYRDIFTLLLRLHRSLVLSQESEGKMCFLNKLLLLAVLGWLFQIPTVPEDLFFLEEGPSYAFEVDTVAPEHGLDNAPVVDQQLLYTCCPYIGELRKLLASWVSGSSGRSGGFMRKITPTTTTSLGAQPSQTSQGLQAQLAQAFFHNQPPSLRRTVEFVAERIGSNCVKHIKATLVADLVRQAESLLQEQLVTQGEEGGDPAQLLEILCSQLCPHGAQALALGREFCQRKSPGAVRALLPEETPAAVLSSAENIAVGLATEKACAWLSANITALIRREVKAAVSRTLRAQGPEPAARGERRGCSRACEHHAPLPSHLISEIKDVLSLAVGPRDPDEGVSPEHLEQLLGQLGQTLRCRQFLCPPAEQHLAKCSVELASLLVADQIPILGPPAQYRLERGQARRLLHMLLSLWKEDFQGPVPLQLLLSPRNVGLLADTRPREWDLLLFLLRELVEKGLMGRMEIEACLGSLHQAQWPGDFAEELATLSNLFLAEPHLPEPQLRACELVQPNRGTVLAQS

SEQ ID NO: 852 - protein, 498 aa, unidentified
MKRKSERRSSWAAAPPCSRRCSSTSPGVKKIRSSTQQDPRRRDPQDDVYLDITDRLCFAILYSRPKSASNVHYFSIDNELEYENFYADFGPLNLAMVYRYCCKINKKLKSITMLRKKIVHFTGSDQRKQANAAFLVGCYMVIYLGRTPEEAYRILIFGETSYIPFRDAAYGSCNFYITLLDCFHAVKKAMQYGFLNFNSFNLDEYEHYEKAENGDLNWIIPDRFIAFCGPHSRARLESGYHQHSPETYIQYFKNHNVTTIIRLNKRMYDAKRFTDAGFDHHDLFFADGSTPTDAIVKEFLDICENAEGAIAVHCKAGLGRTGTLIACYIMKHYRMTAAETIAWVRICRPGSVIGPQQQFLVMKQTNLWLEGDYFRQKLKGQENGQHRAAFSKLLSGVDDISINGVENQDQQEPEPYSDDDEINGVTQGDRLRALKSRRQSKTNAIPLTVILQSSVQSCKTSEPNISGSAGITKRTTRSASRKSSVKSLSISRTKTVLR

SEQ ID NO: 853 - protein, 836 aa, unidentified
MAGLNCGVSIALLGVLLLGAARLPRGAEAFEIALPRESNITVLIKLGTPTLLAKPCYIVISKRHITMLSIKSGERIVFTFSCQSPENHFVIEIQKNIDCMSGPCPFGEVQLQPSTSLLPTLNRTFIWDVKAHKSIGLELQFSIPRLRQIGPGESCPDGVTHSISGRIDATVVRIGTFCSNGTVSRIKMQEGVKMALHLPWFHPRNVSGFSIANRSSIKRLCIIESVFEGEGSATLMSANYPEGFPEDELMTWQFVVPAHLRASVSFLNFNLSNCERKEERVEYYIPGSTTNPEVFKLEDKQPGNMAGNFNLSLQGCDQDAQSPGILRLQFQVLVQHPQNESNKIYVVDLSNERAMSLTIEPRPVKQSRKFVPGCFVCLESRTCSSNLTLTSGSKHKISFLCDDLTRLWMNVEKTISCTDHRYCQRKSYSLQVPSDILHLPVELHDFSWKLLVPKDRLSLVLVPAQKLQQHTHEKPCNTSFSYLVASAIPSQDLYFGSFCPGGSIKQIQVKQNISVTLRTFAPSFQQEASRQGLTVSFIPYFKEEGVFTVTPDTKSKVYLRTPNWDRGLPSLTSVSWNISVPRDQVACLTFFKERSGVVCQTGRAFMIIQEQRTRAEEIFSLDEDVLPKPSFHHHSFWVNISNCSPTSGKQLDLLFSVTLTPRTVDLTVILIAAVGGGVLLLSALGLIICCVKKKKKKTNKGPAVGIYNDNINTEMPRQPKKFQKGRKDNDSHVYAVIEDTMVYGHLLQDSSGSFLQPEVDTYRPFQGTMGVCPPSPPTICSRAPTAKLATEEPPPRSPPESESEPYTFSHPNNGDVSSKDTDIPLLNTQEPMEPAE

SEQ ID NO: 854 - protein, 449 aa, unidentified
MLAEWGACLLLAVALLGPGLQAQAMEGVKCGGVLSAPSGNFSSPNFPRLYPYNTECSWLIVVAEGSSVLLTFHAFDLEYHDTCSFDFLEIYNGASPDKGNLLGRFCGKVPPPPFTSSWHVMSVIFHSDKHVASHGFSAGYQKDVCGGVLTGLSGVLTSPEYPNNYPNSMECHWVIRAAGPAHVKLVFVDFQVEGNEECTYDYVAVLGGPGPTRGHHYCGSTRPPTLVSLGHELQVVFKSDFNIGGRGFKAYYFSGECQEVYMAMRGNFSSPQYPSSYPNNIRCHWTIRLPPGYQVKVFFLDLDLEEPNSLTKTCDFDHLAAFDGASEEAPLLGNWCGHHLPPPVTSSHNQLLLLLHTDRSTTRRGFSVAYIGGQLGCGSGSTEGEGEALQPQSLQSPSSIPPVCPAPPMNGLLQLLLHWLHPCPLSGPLRLDGTAPACFHYCRASFPSF

SEQ ID NO: 855 - protein, 882 aa, unidentified
MGPWSRSLSALLLLLQVSSWLCQEPEPCHPGFDAESYTFTVPRRHLERGRVLGRVNFEDCTGRQRTAYFSLDTRFKVGTDGVITVKRPLRFHNPQIHFLVYAWDSTYRKFSTKVTLNTVGHHHRPPPHQASVSGIQAELLTFPNSSPGLRRQKRDWVIPPISCPENEKGPFPKNLVQIKSNKDKEGKVFYSITGQGADTPPVGVFIIERETGWLKVTEPLDRERIATYTLFSHAVSSNGNAVEDPMEILITVTDQNDNKPEFTQEVFKGSVMEGALPGTSVMEVTATDADDDVNTYNAAIAYTILSQDPELPDKNMFTINRNTGVISVVTTGLDRESFPTYTLVVQAADLQGEGLSTTATAVITVTDTNDNPPIFNPTTYKGQVPENEANVVITTLKVTDADAPNTPAWEAVYTILNDDGGQFVVTTNPVNNDGILKTAKGLDFEAKQQYILHVAVTNVVPFEVSLTTSTATVTVDVLDVNEAPIFVPPEKRVEVSEDFGVGQEITSYTAQEPDTFMEQKITYRIWRDTANWLEINPDTGAISTRAELDREDFEHVKNSTYTALIIATDNGSPVATGTGTLLLILSDVNDNAPIPEPRTIFFCERNPKPQVINIIDADLPPNTSPFTAELTHGASANWTIQYNDPTQESIILKPKMALEVGDYKINLKLMDNQNKDQVTTLEVSVCDCEGAAGVCRKAQPVEAGLQIPAILGILGGILALLILILLLLLFLRRRAVVKEPLLPPEDDTRDNVYYYDEEGGGEEDQDFDLSQLHRGLDARPEVTRNDVAPTLMSVPRYLPRPANPDEIGNFIDENLKAADTDPTAPPYDSLLVFDYEGSGSEAASLSSLNSSESDKDQDYDYLNEWGNRFKKLADMYGGGEDD

SEQ ID NO: 856 - protein, 788 aa, unidentified
MTIHQFLLLFLFWVCLPHFCSPEIMFRRTPVPQQRILSSRVPRSDGKILHRQKRGWMWNQFFLLEEYTGSDYQYVGKLHSDQDKGDGSLKYILSGDGAGTLFIIDEKTGDIHATRRIDREEKAFYTLRAQAINRRTLRPVEPESEFVIKIHDINDNEPTFPEEIYTASVPEMSVVGTSVVQVTATDADDPSYGNSARVIYSILQGQPYFSVEPETGIIRTALPNMNRENREQYQVVIQAKDMGGQMGGLSGTTTVNITLTDVNDNPPRFPQNTIHLRVLESSPVGTAIGSVKATDADTGKNAEVEYRIIDGDGTDMFDIVTEKDTQEGIITVKKPLDYESRRLYTLKVEAENTHVDPRFYYLGPFKDTTIVKISIEDVDEPPVFSRSSYLFEVHEDIEVGTIIGTVMARDPDSISSPIRFSLDRHTDLDRIFNIHSGNGSLYTSKPLDRELSQWHNLTVIAAEINNPKETTRVAVFVRILDVNDNAPQFAVFYDTFVCENARPGQLIQTISAVDKDDPLGGQKFFFSLAAVNPNFTVQDNEDNTARILTRKNGFNRHEISTYLLPVVISDNDYPIQSSTGTLTIRVCACDSQGNMQSCSAEALLLPAGLSTGALIAILLCIIILLVIVVLFAALKRQRKKEPLILSKEDIRDNIVSYNDEGGGEEDTQAFDIGTLRNPAAIEEKKLRRDIIPETLFIPRRTPTAPDNTDVRDFINERLKEHDLDPTAPPYDSLATYAYEGNDSIAESLSSLESGTTEGDQNYDYLREWGPRFNKLAEMYGGGESDKDS

SEQ ID NO: 857 - protein, 796 aa, unidentified
MKENYCLQAALVCLGMLCHSHAFAPERRGHLRPSFHGHHEKGKEGQVLQRSKRGWVWNQFFVIEEYTGPDPVLVGRLHSDIDSGDGNIKYILSGEGAGTIFVIDDKSGNIHATKTLDREERAQYTLMAQAVDRDTNRPLEPPSEFIVKVQDINDNPPEFLHETYHANVPERSNVGTSVIQVTASDADDPTYGNSAKLVYSILEGQPYFSVEAQTGIIRTALPNMDREAKEEYHVVIQAKDMGGHMGGLSGTTKVTITLTDVNDNPPKFPQSVYQMSVSEAAVPGEEVGRVKAKDPDIGENGLVTYNIVDGDGMESFEITTDYETQEGVIKLKKPVDFETKRAYSLKVEAANVHIDPKFISNGPFKDTVTVKISVEDADEPPMFLAPSYIHEVQENAAAGTVVGRVHAKDPDAANSPIRYSIDRHTDLDRFFTINPEDGFIKTTKPLDREETAWLNITVFAAEIHNRHQEAKVPVAIRVLDVNDNAPKFAAPYEGFICESDQTKPLSNQPIVTISADDKDDTANGPRFIFSLPPEIIHNPNFTVRDNRDNTAGVYARRGGFSRQKQDLYLLPIVISDGGIPPMSSTNTLTIKVCGCDVNGALLSCNAEAYILNAGLSTGALIAILACIVILLVIVVLFVTLRRQKKEPLIVFEEEDVRENIITYDDEGGGEEDTEAFDIATLQNPDGINGFIPRKDIKPEYQYMPRPGLRPAPNSVDVDDFINTRIQEADNDPTAPPYDSIQIYGYEGRGSVAGSLSSLESATTDSDLDYDYLQNWGPRFKKLADLYGSKDTFDDDS

SEQ ID NO: 858 - protein, 794 aa, unidentified
MLTRNCLSLLLWVLFDGGLLTPLQPQPQQTLATEPRENVIHLPGQRSHFQRVKRGWVWNQFFVLEEYVGSEPQYVGKLHSDLDKGEGTVKYTLSGDGAGTVFTIDETTGDIHAIRSLDREEKPFYTLRAQAVDIETRKPLEPESEFIIKVQDINDNEPKFLDGPYVATVPEMSPVGAYVLQVKATDADDPTYGNSARVVYSILQGQPYFSIDPKTGVIRTALPNMDREVKEQYQVLIQAKDMGGQLGGLAGTTIVNITLTDVNDNPPRFPKSIFHLKVPESSPIGSAIGRIRAVDPDFGQNAEIEYNIVPGDGGNLFDIVTDEDTQEGVIKLKKPLDFETKKAYTFKVEASNLHLDHRFHSAGPFKDTATVKISVLDVDEPPVFSKPLYTMEVYEDTPVGTIIGAVTAQDLDVGSSAVRYFIDWKSDGDSYFTIDGNEGTIATNELLDRESTAQYNFSIIASKVSNPLLTSKVNILINVLDVNEFPPEISVPYETAVCENAKPGQIIQIVSAADRDLSPAGQQFSFRLSPEAAIKPNFTVRDFRNNTAGIETRRNGYSRRQQELYFLPVVIEDSSYPVQSSTNTMTIRVCRCDSDGTILSCNVEAIFLPVGLSTGALIAILLCIVILLAIVVLYVALRRQKKKDTLMTSKEDIRDNVIHYDDEGGGEEDTQAFDIGALRNPKVIEENKIRRDIKPDSLCLPRQRPPMEDNTDIRDFIHQRLQENDVDPTAPPYDSLATYAYEGSGSVAESLSSIDSLTTEADQDYDYLTDWGPRFKVLADMFGEEESYNPDKVT

SEQ ID NO: 859 - protein, 814 aa, unidentified
MDAAFLLVLGLLAQSLCLSLGVPGWRRPTTLYPWRRAPALSRVRRAWVIPPISVSENHKRLPYPLVQIKSDKQQLGSVIYSIQGPGVDEEPRGVFSIDKFTGKVFLNAMLDREKTDRFRLRAFALDLGGSTLEDPTDLEIVVVDQNDNRPAFLQEAFTGRVLEGAVPGTYVTRAEATDADDPETDNAALRFSILQQGSPELFSIDELTGEIRTVQVGLDREVVAVYNLTLQVADMSGDGLTATASAIITLDDINDNAPEFTRDEFFMEAIEAVSGVDVGRLEVEDRDLPGSPNWVARFTILEGDPDGQFTIRTDPKTNEGVLSIVKALDYESCEHYELKVSVQNEAPLQAAALRAERGQAKVRVHVQDTNEPPVFQENPLRTSLAEGAPPGTLVATFSARDPDTEQLQRLSYSKDYDPEDWLQVDAATGRIQTQHVLSPASPFLKGGWYRAIVLAQDDASQPRTATGTLSIEILEVNDHAPVLAPPPPGSLCSEPHQGPGLLLGATDEDLPPHGAPFHFQLSPRLPELGRNWSLSQVNVSHARLRPRHQVPEGLHRLSLLLRDSGQPPQQREQPLNVTVCRCGKDGVCLPGAAALLAGGTGLSLGALVIVLASALLLLVLVLLVALRARFWKQSRGKGLLHGPQDDLRDNVLNYDEQGGGEEDQDAYDISQLRHPTALSLPLGPPPLRRDAPQGRLHPQPPRVLPTSPLDIADFINDGLEAADSDPSVPPYDTALIYDYEGDGSVAGTLSSILSSQGDEDQDYDYLRDWGPRFARLADMYGHPCGLEYGARWDHQAREGLSPGALLPRHRGRTA

SEQ ID NO: 860 - protein, 829 aa, unidentified
MVPAWLWLLCVSVPQALPKAQPAELSVEVPENYGGNFPLYLTKLPLPREGAEGQIVLSGDSGKATEGPFAMDPDSGFLLVTRALDREEQAEYQLQVTLEMQDGHVLWGPQPVLVHVKDENDQVPHFSQAIYRARLSRGTRPGIPFLFLEASDRDEPGTANSDLRFHILSQAPAQPSPDMFQLEPRLGALALSPKGSTSLDHALERTYQLLVQVKDMGDQASGHQATATVEVSIIESTWVSLEPIHLAENLKVLYPHHMAQVHWSGGDVHYHLESHPPGPFEVNAEGNLYVTRELDREAQAEYLLQVRAQNSHGEDYAAPLELHVLVMDENDNVPICPPRDPTVSIPELSPPGTEVTRLSAEDADAPGSPNSHVVYQLLSPEPEDGVEGRAFQVDPTSGSVTLGVLPLRAGQNILLLVLAMDLAGAEGGFSSTCEVEVAVTDINDHAPEFITSQIGPISLPEDVEPGTLVAMLTAIDADLEPAFRLMDFAIERGDTEGTFGLDWEPDSGHVRLRLCKNLSYEAAPSHEVVVVVQSVAKLVGPGPGPGATATVTVLVERVMPPPKLDQESYEASVPISAPAGSFLLTIQPSDPISRTLRFSLVNDSEGWLCIEKFSGEVHTAQSLQGAQPGDTYTVLVEAQDTDEPRLSASAPLVIHFLKAPPAPALTLAPVPSQYLCTPRQDHGLIVSGPSKDPDLASGHGPYSFTLGPNPTVQRDWRLQTLNGSHAYLTLALHWVEPREHIIPVVVSHNAQMWQLLVRVIVCRCNVEGQCMRKVGRMKGMPTKLSAVGILVGTLVAIGIFLILIFTHWTMSRKKDPDQPADSVPLKATV

SEQ ID NO: 861 - protein, 832 aa, unidentified
MILQAHLHSLCLLMLYLATGYGQEGKFSGPLKPMTFSIYEGQEPSQIIFQFKANPPAVTFELTGETDNIFVIEREGLLYYNRALDRETRSTHNLQVAALDANGIIVEGPVPITIKVKDINDNRPTFLQSKYEGSVRQNSRPGKPFLYVNATDLDDPATPNGQLYYQIVIQLPMINNVMYFQINNKTGAISLTREGSQELNPAKNPSYNLVISVKDMGGQSENSFSDTTSVDIIVTENIWKAPKPVEMVENSTDPHPIKITQVRWNDPGAQYSLVDKEKLPRFPFSIDQEGDIYVTQPLDREEKDAYVFYAVAKDEYGKPLSYPLEIHVKVKDINDNPPTCPSPVTVFEVQENERLGNSIGTLTAHDRDEENTANSFLNYRIVEQTPKLPMDGLFLIQTYAGMLQLAKQSLKKQDTPQYNLTIEVSDKDFKTLCFVQINVIDINDQIPIFEKSDYGNLTLAEDTNIGSTILTIQATDADEPFTGSSKILYHIIKGDSEGRLGVDTDPHTNTGYVIIKKPLDFETAAVSNIVFKAENPEPLVFGVKYNASSFAKFTLIVTDVNEAPQFSQHVFQAKVSEDVAIGTKVGNVTAKDPEGLDISYSLRGDTRGWLKIDHVTGEIFSVAPLDREAGSPYRVQVVATEVGGSSLSSVSEFHLILMDVNDNPPRLAKDYTGLFFCHPLSAPGSLIFEATDDDQHLFRGPHFTFSLGSGSLQNDWEVSKINGTHARLSTRHTEFEEREYVVLIRINDGGRPPLEGIVSLPVTFCSCVEGSCFRPAGHQTGIPTVGMAVGILLTTLLVIGIILAVVFIRIKKDKGKDNVESAQASEVKPLRS

SEQ ID NO: 862 - protein, 790 aa, unidentified
MKITSTSCICPVLVCLCFVQRCYGTAHHSSIKVMRNQTKHIEGETEVHHRPKRGWVWNQFFVLEEHMGPDPQYVGKLHSNSDKGDGSVKYILTGEGAGTIFIIDDTTGDIHSTKSLDREQKTHYVLHAQAIDRRTNKPLEPESEFIIKVQDINDNAPKFTDGPYIVTVPEMSDMGTSVLQVTATDADDPTYGNSARVVYSILQGQPYFSVDPKTGVIRTALHNMDREAREHYSVVIQAKDMAGQVGGLSGSTTVNITLTDVNDNPPRFPQKHYQLYVPESAQVGSAVGKIKANDADTGSNADMTYSIINGDGMGIFSISTDKETREGILSLKKPLNYEKKKSYTLNIEGANTHLDFRFSHLGPFKDATMLKIIVGDVDEPPLFSMPSYLMEVYENAKIGTVVGTVLAQDPDSTNSLVRYFINYNVEDDRFFNIDANTGTIRTTKVLDREETPWYNITVTASEIDNPDLLSHVTVGIRVLDVNDNPPELAREYDIIVCENSKPGQVIHTISATDKDDFANGPRFNFFLDERLPVNPNFTLKDNEDNTASILTRRRRFSRTVQDVYYLPIMISDGGIPSLSSSSTLTIRVCACERDGRVRTCHAEAFLSSAGLSTGALIAILLCVLILLAIVVLFITLRRSKKEPLIISEEDVRENVVTYDDEGGGEEDTEAFDITALRNPSAAEELKYRRDIRPEVKLTPRHQTSSTLESIDVQEFIKQRLAEADLDPSVPPYDSLQTYAYEGQRSEAGSISSLDSATTQSDQDYHYLGDWGPEFKKLAELYGEIESERTT

SEQ ID NO: 863 - protein, 772 aa, unidentified
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 864 - protein, 906 aa, unidentified
MCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVINVIDMNDNRPEFLHQVWNGTVPEGSKPGTYVMTVTAIDADDPNALNGMLRYRIVSQAPSTPSPNMFTINNETGDIITVAAGLDREKVQQYTLIIQATDMEGNPTYGLSNTATAVITVTDVNDNPPEFTAMTFYGEVPENRVDIIVANLTVTDKDQPHTPAWNAVYRISGGDPTGRFAIQTDPNSNDGLVTVVKPIDFETNRMFVLTVAAENQVPLAKGIQHPPQSTATVSVTVIDVNENPYFAPNPKIIRQEEGLHAGTMLTTFTAQDPDRYMQQNIRYTKLSDPANWLKIDPVNGQITTIAVLDRESPNVKNNIYNATFLASDNGIPPMSGTGTLQIYLLDINDNAPQVLPQEAETCETPDPNSINITALDYDIDPNAGPFAFDLPLSPVTIKRNWTITRLNGDFAQLNLKIKFLEAGIYEVPIIITDSGNPPKSNISILRVKVCQCDSNGDCTDVDRIVGAGLGTGAIIAILLCIIILLILVLMFVVWMKRRDKERQAKQLLIDPEDDVRDNILKYDEEGGGEEDQDYDLSQLQQPDTVEPDAIKPVGIRRMDERPIHAEPQYPVRSAAPHPGDIGDFINEGLKAADNDPTAPPYDSLLVFDYEGSGSTAGSLSSLNSSSSGGEQDYDYLNDWGPRFKKLADMYGGGDD

SEQ ID NO: 865 - protein, 801 aa, unidentified
MWTSGRMSNAKNWLGLGMSLYFWGLMDLTTTVLSDTPTPQGELEALLSDKPQSHQRTKRSWVWNQFFVLEEYTGTDPLYVGKLHSDMDRGDGSIKYILSGEGAGIVFTIDDTTGDIHAIQRLDREERAQYTLRAQALDRRTGRPMEPESEFIIKIQDINDNEPKFLDGPYVATVPEMSPVGTSVIQVTATDADDPTYGNSARVVYSILQGQPYFSVDSKTGVIRTALMNMDREAKEYYEVIIQAKDMGGQLGGLAGTTTVNITLSDVNDNPPRFPQKHYQMSVLESAPISSTVGRVFAKDLDEGINAEMKYTIVDGDGADAFDISTDPNFQVGIITVKKPLSFESKKSYTLKVEGANPHLEMRFLNLGPFQDTTTVHISVEDVDEPPVFEPGFYFVEVPEDVAIGTTIQIISAKDPDVTNNSIRYSIDRSSDPGRFFYVDITTGALMTARPLDREEFSWHNITVLAMEMNNPSQVGSVPVTIKVLDVNDNAPEFPRFYEAFVCENAKAGQLIQTVSAVDQDDPRNGQHFYYSLAPEAANNPNFTIRDNQDNTARILTRRSGFRQQEQSVFHLPILIADSGQPVLSSTGTLTIQVCSCDDDGHVMSCSPEAYMLPVSLSRGALIAILACIFVLLVLVLLILSMRRHRKQPYIIDDEENIHENIVRYDDEGGGEEDTEAFDIAAMWNPREAQAGAAPKTRQDMLPEIESLSRYVPQTCAVNSTVHSYVLAKLYEADMDLWAPPFDSLQTYMFEGDGSVAGSLSSLQSATSDSEQSFDFLTDWGPRFRKLAELYGASEGPAPLW

SEQ ID NO: 866 - protein, 828 aa, unidentified
MRPRPEGRGLRAGVALSPALLLLLLLPPPPTLLGRLWAAGTPSPSAPGARQDGALGAGRVKRGWVWNQFFVVEEYTGTEPLYVGKIHSDSDEGDGAIKYTISGEGAGTIFLIDELTGDIHAMERLDREQKTFYTLRAQARDRATNRLLEPESEFIIKVQDINDSEPRFLHGPYIGSVAELSPTGTSVMQVMASDADDPTYGSSARLVYSVLDGEHHFTVDPKTGVIRTAVPDLDRESQERYEVVIQATDMAGQLGGLSGSTTVTIVVTDVNDNPPRFPQKMYQFSIQESAPIGTAVGRVKAEDSDVGENTDMTYHLKDESSSGGDVFKVTTDSDTQEAIIVVQKRLDFESQPVHTVILEALNKFVDPRFADLGTFRDQAIVRVAVTDVDEPPEFRPPSGLLEVQEDAQVGSLVGVVTARDPDAANRPVRYAIDRESDLDQIFDIDADTGAIVTGKGLDRETAGWHNITVLAMEADNHAQLSRASLRIRILDVNDNPPELATPYEAAVCEDAKPGQLIQTISVVDRDEPQGGHRFYFRLVPEAPSNPHFSLLDIQDNTAAVHTQHVGFNRQEQDVFFLPILVVDSGPPTLSSTGTLTIRICGCDSSGTIQSCNTTAFVMAASLSPGALIALLVCVLILVVLVLLILTLRRHHKSHLSSDEDEDMRDNVIKYNDEGGGEQDTEAYDMSALRSLYDFGELKGGDGGGSAGGGAGGGSGGGAGSPPQAHLPSERHSLPQGPPSPEPDFSVFRDFISRKVALADGDLSVPPYDAFQTYAFEGADSPAASLSSLHSGSSGSEQDFAYLSSWGPRFRPLAALYAGHRGDDEAQAS

SEQ ID NO: 867 - protein, 3354 aa, unidentified
MGRHVATSCHVAWLLVLISGCWGQVNRLPFFTNHFFDTYLLISEDTPVGSSVTQLLAQDMDNDPLVFGVSGEEASRFFAVEPDTGVVWLRQPLDRETKSEFTVEFSVSDHQGVITRKVNIQVGDVNDNAPTFHNQPYSVRIPENTPVGTPIFIVNATDPDLGAGGSVLYSFQPPSQFFAIDSARGIVTVIRELDYETTQAYQLTVNATDQDKTRPLSTLANLAIIITDVQDMDPIFINLPYSTNIYEHSPPGTTVRIITAIDQDKGRPRGIGYTIVSGNTNSIFALDYISGVLTLNGLLDRENPLYSHGFILTVKGTELNDDRTPSDATVTTTFNILVIDINDNAPEFNSSEYSVAITELAQVGFALPLFIQVVDKDENLGLNSMFEVYLVGNNSHHFIISPTSVQGKADIRIRVAIPLDYETVDRYDFDLFANESVPDHVGYAKVKITLINENDNRPIFSQPLYNISLYENVTVGTSVLTVLATDNDAGTFGEVSYFFSDDPDRFSLDKDTGLIMLIARLDYELIQRFTLTIIARDGGGEETTGRVRINVLDVNDNVPTFQKDAYVGALRENEPSVTQLVRLRATDEDSPPNNQITYSIVSASAFGSYFDISLYEGYGVISVSRPLDYEQISNGLIYLTVMAMDAGNPPLNSTVPVTIEVFDENDNPPTFSKPAYFVSVVENIMAGATVLFLNATDLDRSREYGQESIIYSLEGSTQFRINARSGEITTTSLLDRETKSEYILIVRAVDGGVGHNQKTGIATVNITLLDINDNHPTWKDAPYYINLVEMTPPDSDVTTVVAVDPDLGENGTLVYSIQPPNKFYSLNSTTGKIRTTHAMLDRENPDPHEAELMRKIVVSVTDCGRPPLKATSSATVFVNLLDLNDNDPTFQNLPFVAEVLEGIPAGVSIYQVVAIDLDEGLNGLVSYRMPVGMPRMDFLINSSSGVVVTTTELDRERIAEYQLRVVASDAGTPTKSSTSTLTIHVLDVNDETPTFFPAVYNVSVSEDVPREFRVVWLNCTDNDVGLNAELSYFITGGNVDGKFSVGYRDAVVRTVVGLDRETTAAYMLILEAIDNGPVGKRHTGTATVFVTVLDVNDNRPIFLQSSYEASVPEDIPEGHSILQLKATDADEGEFGRVWYRILHGNHGNNFRIHVSNGLLMRGPRPLDRERNSSHVLIVEAYNHDLGPMRSSVRVIVYVEDINDEAPVFTQQQYSRLGLRETAGIGTSVIVVQATDRDSGDGGLVNYRILSGAEGKFEIDESTGLIITVNYLDYETKTSYMMNVSATDQAPPFNQGFCSVYITLLNELDEAVQFSNASYEAAILENLALGTEIVRVQAYSIDNLNQITYRFNAYTSTQAKALFKIDAITGVITVQGLVDREKGDFYTLTVVADDGGPKVDSTVKVYITVLDENDNSPRFDFTSDSAVSIPEDCPVGQRVATVKAWDPDAGSNGQVVFSLASGNIAGAFEIVTTNDSIGEVFVARPLDREELDHYILQVVASDRGTPPRKKDHILQVTILDINDNPPVIESPFGYNVSVNENVGGGTAVVQVRATDRDIGINSVLSYYITEGNKDMAFRMDRISGEIATRPAPPDRERQSFYHLVATVEDEGTPTLSATTHVYVTIVDENDNAPMFQQPHYEVLLDEGPDTLNTSLITIQALDLDEGPNGTVTYAIVAGNIVNTFRIDRHMGVITAAKELDYEISHGRYTLIVTATDQCPILSHRLTSTTTVLVNVNDINDNVPTFPRDYEGPFEVTEGQPGPRVWTFLAHDRDSGPNGQVEYSIMDGDPLGEFVISPVEGVLRVRKDVELDRETIAFYNLTICARDRGMPPLSSTMLVGIRVLDINDNDPVLLNLPMNITISENSPVSSFVAHVLASDADSGCNARLTFNITAGNRERAFFINATTGIVTVNRPLDRERIPEYKLTISVKDNPENPRIARRDYDLLLIFLSDENDNHPLFTKSTYQAEVMENSPAGTPLTVLNGPILALDADQDIYAVVTYQLLGAQSGLFDINSSTGVVTVRSGVIIDREAFSPPILELLLLAEDIGLLNSTAHLLITILDDNDNRPTFSPATLTVHLLENCPPGFSVLQVTATDEDSGLNGELVYRIEAGAQDRFLIHLVTGVIRVGNATIDREEQESYRLTVVATDRGTVPLSGTAIVTILIDDINDSRPEFLNPIQTVSVLESAEPGTVIANITAIDHDLNPKLEYHIVGIVAKDDTDRLVPNQEDAFAVNINTGSVMVKSPMNRELVATYEVTLSVIDNASDLPERSVSVPNAKLTVNVLDVNDNTPQFKPFGITYYMERILEGATPGTTLIAVAAVDPDKGLNGLVTYTLLDLVPPGYVQLEDSSAGKVIANRTVDYEEVHWLNFTVRASDNGSPPRAAEIPVYLEIVDINDNNPIFDQPSYQEAVFEDVPVGTIILTVTATDADSGNFALIEYSLGDGESKFAINPTTGDIYVLSSLDREKKDHYILTALAKDNPGDVASNRRENSVQVVIQVLDVNDCRPQFSKPQFSTSVYENEPAGTSVITMMATDQDEGPNGELTYSLEGPGVEAFHVDMDSGLVTTQRPLQSYEKFSLTVVATDGGEPPLWGTTMLLVEVIDVNDNRPVFVRPPNGTILHIREEIPLRSNVYEVYATDKDEGLNGAVRYSFLKTAGNRDWEFFIIDPISGLIQTAQRLDRESQAVYSLILVASDLGQPVPYETMQPLQVALEDIDDNEPLFVRPPKGSPQYQLLTVPEHSPRGTLVGNVTGAVDADEGPNAIVYYFIAAGNEEKNFHLQPDGCLLVLRDLDREREAIFSFIVKASSNRSWTPPRGPSPTLDLVADLTLQEVRVVLEDINDQPPRFTKAEYTAGVATDAKVGSELIQVLALDADIGNNSLVFYSILAIHYFRALANDSEDVGQVFTMGSMDGILRTFDLFMAYSPGYFVVDIVARDLAGHNDTAIIGIYILRDDQRVKIVINEIPDRVRGFEEEFIHLLSNITGAIVNTDNVQFHVDKKGRVNFAQTELLIHVVNRDTNRILDVDRVIQMIDENKEQLRNLFRNYNVLDVQPAISVRLPDDMSALQMAIIVLAILLFLAAMLFVLMNWYYRTVHKRKLKAIVAGSAGNRGFIDIMDMPNTNKYSFDGANPVWLDPFCRNLELAAQAEHEDDLPENLSEIADLWNSPTRTHGTFGREPAAVKPDDDRYLRAAIQEYDNIAKLGQIIREGPIKGSLLKVVLEDYLRLKKLFAQRMVQKASSCHSSISELIQTELDEEPGDHSPGQGSLRFRHKPPVELKGPDGIHVVHGSTGTLLATDLNSLPEEDQKGLGRSLETLTAAEATAFERNARTESAKSTPLHKLRDVIMETPLEITEL

SEQ ID NO: 868 - protein, 819 aa, unidentified
MWGLVRLLLAWLGGWGCMGRLAAPARAWAGSREHPGPALLRTRRSWVWNQFFVIEEYAGPEPVLIGKLHSDVDRGEGRTKYLLTGEGAGTVFVIDEATGNIHVTKSLDREEKAQYVLLAQAVDRASNRPLEPPSEFIIKVQDINDNPPIFPLGPYHATVPEMSNVGTSVIQVTAHDADDPSYGNSAKLVYTVLDGLPFFSVDPQTGVVRTAIPNMDRETQEEFLVVIQAKDMGGHMGGLSGSTTVTVTLSDVNDNPPKFPQSLYQFSVVETAGPGTLVGRLRAQDPDLGDNALMAYSILDGEGSEAFSISTDLQGRDGLLTVRKPLDFESQRSYSFRVEATNTLIDPAYLRRGPFKDVASVRVAVQDAPEPPAFTQAAYHLTVPENKAPGTLVGQISAADLDSPASPIRYSILPHSDPERCFSIQPEEGTIHTAAPLDREARAWHNLTVLATELGWSWGPERGWVPLLVAEWSAPAAPPQRSPVGSAVGIPQDSSAQASRVQVAIQTLDENDNAPQLAEPYDTFVCDSAAPGQLIQVIRALDRDEVGNSSHVSFQGPLGPDANFTVQDNRDGSASLLLPSRPAPPRHAPYLVPIELWDWGQPALSSTATVTVSVCRCQPDGSVASCWPEAHLSAAGLSTGALLAIITCVGALLALVVLFVALRRQKQEALMVLEEEDVRENIITYDDEGGGEEDTEAFDITALQNPDGAAPPAPGPPARRDVLPRARVSRQPRPPGPADVAQLLALRLREADEDPGVPPYDSVQVYGYEGRGSSCGSLSSLGSGSEAGGAPGPAEPLDDWGPLFRTLAELYGAKEPPAP

SEQ ID NO: 869 - protein, 832 aa, unidentified
MAMRSGRHPSLLLLLVLLLWLLQVSIIDSVQQETDDLTKQTKEKIYQPLRRSKRRWVITTLELEEEDPGPFPKLIGELFNNMSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSLSSTTTVHVDVQEGNNHRPAFTQENYKVQIPEGRASQGVLRLLVQDRDSPFTSAWRAKFNILHGNEEGHFDISTDPETNEGILNVIKPLDYETRPAQSLIIVVENEERLVFCERGKLQPPRKAAASATVSVQVTDANDPPAFHPQSFIVNKEEGARPGTLLGTFNAMDPDSQIRYELVHDPANWVSVDKNSGVVITVEPIDRESPHVNNSFYVIIIHAVDDGFPPQTATGTLMLFLSDINDNVPTLRPRSRYMEVCESAVHEPLHIEAEDPDLEPFSDPFTFELDNTWGNAEDTWKLGRNWGQSVELLTLRSLPRGNYLVPLFIGDKQGLSQKQTVHVRICPCASGLTCVELADAEVGLHVGALFPVCAAFVALAVALLFLLRCYFVLEPKRHGCSVSNDEGHQTLVMYNAESKGTSAQTWSDVEGQRPALLICTAAAGPTQGVKDLEEVPPSAASQSAQARCALGSWGYGKPFEPRSVKNIHSTPAYPDATMHRQLLAPVEGRMAETLNQKLHVANVLEDDPGYLPHVYSEEGECGGAPSLSSLASLEQELQPDLLDSLGSKATPFEEIYSESGVPS

SEQ ID NO: 870 - protein, 829 aa, unidentified
MGLPRGPLASLLLLQVCWLQCAASEPCRAVFREAEVTLEAGGAEQEPGQALGKVFMGCPGQEPALFSTDNDDFTVRNGETVQERRSLKERNPLKIFPSKRILRRHKRDWVVAPISVPENGKGPFPQRLNQLKSNKDRDTKIFYSITGPGADSPPEGVFAVEKETGWLLLNKPLDREEIAKYELFGHAVSENGASVEDPMNISIIVTDQNDHKPKFTQDTFRGSVLEGVLPGTSVMQVTATDEDDAIYTYNGVVAYSIHSQEPKDPHDLMFTIHRSTGTISVISSGLDREKVPEYTLTIQATDMDGDGSTTTAVAVVEILDANDNAPMFDPQKYEAHVPENAVGHEVQRLTVTDLDAPNSPAWRATYLIMGGDDGDHFTITTHPESNQGILTTRKGLDFEAKNQHTLYVEVTNEAPFVLKLPTSTATIVVHVEDVNEAPVFVPPSKVVEVQEGIPTGEPVCVYTAEDPDKENQKISYRILRDPAGWLAMDPDSGQVTAVGTLDREDEQFVRNNIYEVMVLAMDNGSPPTTGTGTLLLTLIDVNDHGPVPEPRQITICNQSPVRQVLNITDKDLSPHTSPFQAQLTDDSDIYWTAEVNEEGDTVVLSLKKFLKQDTYDVHLSLSDHGNKEQLTVIRATVCDCHGHVETCPGPWKGGFILPVLGAVLALLFLLLVLLLLVRKKRKIKEPLLLPEDDTRDNVFYYGEEGGGEEDQDYDITQLHRGLEARPEVVLRNDVAPTIIPTPMYRPRPANPDEIGNFIIENLKAANTDPTAPPYDTLLVFDYEGSGSDAASLSSLTSSASDQDQDYDYLNEWGSRFKKLADMYGGGEDD

SEQ ID NO: 871 - protein, 916 aa, unidentified
MTAGAGVLLLLLSLSGALRAHNEDLTTRETCKAGFSEDDYTALISQNILEGEKLLQVKFSSCVGTKGTQYETNSMDFKVGADGTVFATRELQVPSEQVAFTVTAWDSQTAEKWDAVVRLLVAQTSSPHSGHKPQKGKKVVALDPSPPPKDTLLPWPQHQNANGLRRRKRDWVIPPINVPENSRGPFPQQLVRIRSDKDNDIPIRYSITGVGADQPPMEVFSIDSMSGRMYVTRPMDREEHASYHLRAHAVDMNGNKVENPIDLYIYVIDMNDNRPEFINQVYNGSVDEGSKPGTYVMTVTANDADDSTTANGMVRYRIVTQTPQSPSQNMFTINSETGDIVTVAAGLDREKVQQYTVIVQATDMEGNLNYGLSNTATAIITVTDVNDNPPEFTASTFAGEVPENRVETVVANLTVMDRDQPHSPNWNAVYRIISGDPSGHFSVRTDPVTNEGMVTVVKAVDYELNRAFMLTVMVSNQAPLASGIQMSFQSTAGVTISIMDINEAPYFPSNHKLIRLEEGVPPGTVLTTFSAVDPDRFMQQAVRYSKLSDPASWLHINATNGQITTAAVLDRESLYTKNNVYEATFLAADNGIPPASGTGTLQIYLIDINDNAPELLPKEAQICEKPNLNAINITAADADVDPNIGPYVFELPFVPAAVRKNWTITRLNGDYAQLSLRILYLEAGMYDVPIIVTDSGNPPLSNTSIIKVKVCPCDDNGDCTTIGAVAAAGLGTGAIVAILICILILLTMVLLFVMWMKRREKERHTKQLLIDPEDDVRDNILKYDEEGGGEEDQDYDLSQLQQPEAMGHVPSKAPGVRRVDERPVGAEPQYPIRPMVPHPGDIGDFINEGLRAADNDPTAPPYDSLLVFDYEGSGSTAGSVSSLNSSSSGDQDYDYLNDWGPRFKKLADMYGGGEED

SEQ ID NO: 872 - protein, 784 aa, unidentified
MQRLMMLLATSGACLGLLAVAAVAAAGANPAQRDTHSLLPTHRRQKRDWIWNQMHIDEEKNTSLPHHVGKIKSSVSRKNAKYLLKGEYVGKVFRVDAETGDVFAIERLDRENISEYHLTAVIVDKDTGENLETPSSFTIKVHDVNDNWPVFTHRLFNASVPESSAVGTSVISVTAVDADDPTVGDHASVMYQILKGKEYFAIDNSGRIITITKSLDREKQARYEIVVEARDAQGLRGDSGTATVLVTLQDINDNFPFFTQTKYTFVVPEDTRVGTSVGSLFVEDPDEPQNRMTKYSILRGDYQDAFTIETNPAHNEGIIKPMKPLDYEYIQQYSFIVEATDPTIDLRYMSPPAGNRAQVIINITDVDEPPIFQQPFYHFQLKENQKKPLIGTVLAMDPDAARHSIGYSIRRTSDKGQFFRVTKKGDIYNEKELDREVYPWYNLTVEAKELDSTGTPTGKESIVQVHIEVLDENDNAPEFAKPYQPKVCENAVHGQLVLQISAIDKDITPRNVKFKFILNTENNFTLTDNHDNTANITVKYGQFDREHTKVHFLPVVISDNGMPSRTGTSTLTVAVCKCNEQGEFTFCEDMAAQVGVSIQAVVAILLCILTITVITLLIFLRRRLRKQARAHGKSVPEIHEQLVTYDEEGGGEMDTTSYDVSVLNSVRRGGAKPPRPALDARPSLYAQVQKPPRHAPGAHGGPGEMAAMIEVKKDEADHDGDGPPYDTLHIYGYEGSESIAESLSSLGTDSSDSDVDYDFLNDWGPRFKMLAELYGSDPREELLY

SEQ ID NO: 873 - protein, 790 aa, unidentified
MRTYRYFLLLFWVGQPYPTLSTPLSKRTSGFPAKKRALELSGNSKNELNRSKRSWMWNQFFLLEEYTGSDYQYVGKLHSDQDRGDGSLKYILSGDGAGDLFIINENTGDIQATKRLDREEKPVYILRAQAINRRTGRPVEPESEFIIKIHDINDNEPIFTKEVYTATVPEMSDVGTFVVQVTATDADDPTYGNSAKVVYSILQGQPYFSVESETGIIKTALLNMDRENREQYQVVIQAKDMGGQMGGLSGTTTVNITLTDVNDNPPRFPQSTYQFKTPESSPPGTPIGRIKASDADVGENAEIEYSITDGEGLDMFDVITDQETQEGIITVKKLLDFEKKKVYTLKVEASNPYVEPRFLYLGPFKDSATVRIVVEDVDEPPVFSKLAYILQIREDAQINTTIGSVTAQDPDAARNPVKYSVDRHTDMDRIFNIDSGNGSIFTSKLLDRETLLWHNITVIATEINNPKQSSRVPLYIKVLDVNDNAPEFAEFYETFVCEKAKADQLIQTLHAVDKDDPYSGHQFSFSLAPEAASGSNFTIQDNKDNTAGILTRKNGYNRHEMSTYLLPVVISDNDYPVQSSTGTVTVRVCACDHHGNMQSCHAEALIHPTGLSTGALVAILLCIVILLVTVVLFAALRRQRKKEPLIISKEDIRDNIVSYNDEGGGEEDTQAFDIGTLRNPEAIEDNKLRRDIVPEALFLPRRTPTARDNTDVRDFINQRLKENDTDPTAPPYDSLATYAYEGTGSVADSLSSLESVTTDADQDYDYLSDWGPRFKKLADMYGGVDSDKDS

SEQ ID NO: 874 - protein, 785 aa, unidentified
MKLGKVEFCHFLQLIALFLCFSGMSQAELSRSRSKPYFQSGRSRTKRSWVWNQFFVLEEYMGSDPLYVGKLHSDVDKGDGSIKYILSGEGASSIFIIDENTGDIHATKRLDREEQAYYTLRAQALDRLTNKPVEPESEFVIKIQDINDNEPKFLDGPYTAGVPEMSPVGTSVVQVTATDADDPTYGNSARVVYSILQGQPYFSVEPKTGVIKTALPNMDREAKDQYLLVIQAKDMVGQNGGLSGTTSVTVTLTDVNDNPPRFPRRSYQYNVPESLPVASVVARIKAADADIGANAEMEYKIVDGDGLGIFKISVDKETQEGIITIQKELDFEAKTSYTLRIEAANKDADPRFLSLGPFSDTTTVKIIVEDVDEPPVFSSPLYPMEVSEATQVGNIIGTVAAHDPDSSNSPVRYSIDRNTDLERYFNIDANSGVITTAKSLDRETNAIHNITVLAMESQNPSQVGRGYVAITILDINDNAPEFAMDYETTVCENAQPGQVIQKISAVDKDEPSNGHQFYFSLTTDATNNHNFSLKDNKDNTASILTRRNGFRRQEQSVYYLPIFIVDSGSPSLSSTNTLTIRVCDCDADGVAQTCNAEAYVLPAGLSTGALIAILACVLTLLVLILLIVTMRRRKKEPLIFDEERDIRENIVRYDDEGGGEEDTEAFDMAALRNLNVIRDTKTRRDVTPEIQFLSRPAFKSIPDNVIFREFIWERLKEADVDPGAPPYDSLQTYAFEGNGSVAESLSSLDSISSNSDQNYDYLSDWGPRFKRLADMYGTGQESLYS

SEQ ID NO: 875 - protein, 799 aa, unidentified
MPERLAEMLLDLWTPLIILWITLPPCIYMAPMNQSQVLMSGSPLELNSLGEEQRILNRSKRGWVWNQMFVLEEFSGPEPILVGRLHTDLDPGSKKIKYILSGDGAGTIFQINDVTGDIHAIKRLDREEKAEYTLTAQAVDWETSKPLEPPSEFIIKVQDINDNAPEFLNGPYHATVPEMSILGTSVTNVTATDADDPVYGNSAKLVYSILEGQPYFSIEPETAIIKTALPNMDREAKEEYLVVIQAKDMGGHSGGLSGTTTLTVTLTDVNDNPPKFAQSLYHFSVPEDVVLGTAIGRVKANDQDIGENAQSSYDIIDGDGTALFEITSDAQAQDGIIRLRKPLDFETKKSYTLKVEAANVHIDPRFSGRGPFKDTATVKIVVEDADEPPVFSSPTYLLEVHENAALNSVIGQVTARDPDITSSPIRFSIDRHTDLERQFNINADDGKITLATPLDRELSVWHNITIIATEIRNHSQISRVPVAIKVLDVNDNAPEFASEYEAFLCENGKPGQVIQTVSAMDKDDPKNGHYFLYSLLPEMVNNPNFTIKKNEDNSLSILAKHNGFNRQKQEVYLLPIIISDSGNPPLSSTSTLTIRVCGCSNDGVVQSCNVEAYVLPIGLSMGALIAILACIILLLVIVVLFVTLRRHKNEPLIIKDDEDVRENIIRYDDEGGGEEDTEAFDIATLQNPDGINGFLPRKDIKPDLQFMPRQGLAPVPNGVDVDEFINVRLHEADNDPTAPPYDSIQIYGYEGRGSVAGSLSSLESTTSDSDQNFDYLSDWGPRFKRLGELYSVGESDKET

SEQ ID NO: 876 - protein, 789 aa, unidentified
MRTYHYIPLFIWTYMFHTVDTILLQEKPNSYLSSKKIAGLTKDDGKMLRRTKRGWMWNQFFLLEEYTGTDTQYVGKLHTDQDKGDGNLKYILTGDGAGSLFVIDENTGDIHAAKKLDREEKSLYILRAKAIDRKTGRQVEPESEFIIKIHDINDNEPKFTKDLYTASVPEMSGVGTSVIQVTATDADDANYGNSAKVVYSILQGQPYFSVDPESGIIKTALPDMSRENREQYQVVIQAKDMGGQMGGLSGTTTVNITLTDVNNNPPRFPQSTYQFNSPESVPLGTHLGRIKANDPDVGENAEMEYSIAEGDGADMFDVITDKDTQEGIITVKQNLDFENQMLYTLRVDASNTHPDPRFLHLGPFKDTAVVKISVEDIDEPPVFTKVSYLIEVDEDVKEGSIIGQVTAYDPDARNNLIKYSVDRHTDMDRIFGIHSENGSIFTLKALDRESSPWHNITVTATEINNPKQSSHIPVFIRILDINDHAPEFAMYYETFVCENAKPGQLIQTVSVMDKDDPPRGHKFFFEPVPEFTLNPNFTIVDNKDNTAGIMTRKDGYSRNKMSTYLLPILIFDNDYPIQSSTGTLTIRVCACDNQGNMQSCTAEALILSAGLSTGALVAILLCVLILLILVVLFAALKRQRKKEPLIISKDDVRDNIVTYNDEGGGEEDTQAFDIGTLRNPEAREDSKLRRDVMPETIFQIRRTVPLWENIDVQDFIHRRLKENDADPSAPPYDSLATYAYEGNDSIADSLSSLESLTADCNQDYDYLSDWGPRFKKLADMYGGDDSDRD

SEQ ID NO: 877 - protein, 859 aa, unidentified
MRRCRWAALALGLLRLCLAQANFAPHFFDNGVGSTNGNMALFSLPEDTPVGSHVYTLNGTDPEGDPISYHISFDPSTRSVFSVDPTFGNITLVEELDREREDEIEAIISISDGLNLVAEKVVILVTDANDEAPRFIQEPYVALVPEDIPAGSIIFKVHAVDRDTGSGGSVTYFLQNLHSPFAVDRHSGVLRLQAGATLDYERSRTHYITVVAKDGGGRLHGADVVFSATTTVTVNVEDVQDMAPVFVGTPYYGYVYEDTLPGSEVLKVVAMDGDRGKPNRILYSLVNGNDGAFEINETSGAISITQSPAQLQREVYELHVQVTEMSPAGSPAAQATVPVTIRIVDLNNHPPTFYGESGPQNRFELSMNEHPPQGEILRGLKITVNDSDQGANAKFNLQLVGPRGIFRVVPQTVLNEAQVTIIVENSAAIDFEKSKVLTFKLLAVEVNTPEKFSSTADVVIQLLDTNDNVPKFDSLYYVARIPENAPGGSSVVAVTAVDPDTGPWGEVKYSTYGTGADLFLIHPSTGLIYTQPWASLDAEATARYNFYVKAEDMEGKYSVAEVFITLLDVNDHPPQFGKSVQKKTMVLGTPVKIEAIDEDAEEPNNLVDYSITHAEPANVFDINSHTGEIWLKNSIRSLDALHNITPGRDCLWSLEVQAKDRGSPSFSTTALLKIDITDAETLSRSPMAAFLIQTKDNPMKAVGVLAGTMATVVAITVLISTATFWRNKKSNKVLPMRRVLRKRPSPAPRTIRIEWLKSKSTKAATKFMLKEKPPNENCNNNSPESSLLPRAPALPPPPSVAPSTGAAQWTVPTVSGSLTPQPTQPPPKPKTMGSPVQSTLISELKQKFEKKSVHNKAYF

SEQ ID NO: 878 - protein, 1310 aa, unidentified
MAQLWLSCFLLPALVVSVAANVAPKFLANMTSVILPEDLPVGAQAFWLVAEDQDNDPLTYGMSGPNAYFFAVTPKTGEVKLASALDYETLYTFKVTISVSDPYIQVQREMLVIVEDRNDNAPVFQNTAFSTSINETLPVGSVVFSVLAVDKDMGSAGMVVYSIEKVIPSTGDSEHLFRILANGSIVLNGSLSYNNKSAFYQLELKACDLGGMYHNTFTIQCSLPVFLSISVVDQPDLDPQFVREFYSASVAEDAAKGTSVLTVEAVDGDKGINDPVIYSISYSTRPGWFDIGADGVIRVNGSLDREQLLEADEEVQLQVTATETHLNIYGQEAKVSIWVTVRVMDVNDHKPEFYNCSLPACTFTPEEAQVNFTGYVDEHASPRIPIDDLTMVVYDPDKGSNGTFLLSLGGPDAEAFSVSPERAVGSASVQVLVRVSALVDYERQTAMAVQVVATDSVSQNFSVAMVTIHLRDINDHRPTFPQSLYVLTVPEHSATGSVVTDSIHATDPDTGAWGQITYSLLPGNGADLFQVDPVSGTVTVRNGELLDRESQAVYYLTLQATDGGNLSSSTTLQIHLLDINDNAPVVSGSYNIFVQEEEGNVSVTIQAHDNDEPGTNNSRLLFNLLPGPYSHNFSLDPDTGLLRNLGPLDREAIDPALEGRIVLTVLVSDCGEPVLGTKVNVTITVEDINDNLPIFNQSSYNFTVKEEDPGVLVGVVKAWDADQTEANNRISFSLSGSGANYFMIRGLVLGAGWAEGYLRLPPDVSLDYETQPVFNLTVSAENPDPQGGETIVDVCVNVKDVNDNPPTLDVASLRGIRVAENGSQHGQVAVVVASDVDTSAQLEIQLVNILCTKAGVDVGSLCWGWFSVAANGSVYINQSKAIDYEACDLVTLVVRACDLATDPGFQAYSNNGSLLITIEDVNDNAPYFLPENKTFVIIPELVLPNREVASVRARDDDSGNNGVILFSILRVDFISKDGATIPFQGVFSIFTSSEADVFAGSIQPVTSLDSTLQGTYQVTVQARDRPSLGPFLEATTTLNLFTVDQSYRSRLQFSTPKEEVGANRQAINAALTQATRTTVYIVDIQDIDSAARARPHSYLDAYFVFPNGSALTLDELSVMIRNDQDSLTQLLQLGLVVLGSQESQESDLSKQLISVIIGLGVALLLVLVIMTMAFVCVRKSYNRKLQAMKAAKEARKTAAGVMPSAPAIPGTNMYNTERANPMLNLPNKDLGLEYLSPSNDLDSVSVNSLDDNSVDVDKNSQEIKEHRPPHTPPEPDPEPLSVVLLGRQAGASGQLEGPSYTNAGLDTTDL

SEQ ID NO: 879 - protein, 885 aa, unidentified
MQEAIILLALLGAMSGGEALHLILLPATGNVAENSPPGTSVHKFSVKLSASLSPVIPGFPQIVNSNPLTEAFRVNWLSGTYFEVVTTGMEQLDFETGPNIFDLQIYVKDEVGVTDLQVLTVQVTDVNEPPQFQGNLAEGLHLYIVERANPGFIYQVEAFDPEDTSRNIPLSYFLISPPKSFRMSANGTLFSTTELDFEAGHRSFHLIVEVRDSGGLKASTELQVNIVNLNDEVPRFTSPTRVYTVLEELSPGTIVANITAEDPDDEGFPSHLLYSITTVSKYFMINQLTGTIQVAQRIDRDAGELRQNPTISLEVLVKDRPYGGQENRIQITFIVEDVNDNPATCQKFTFSIMVPERTAKGTLLLDLNKFCFDDDSEAPNNRFNFTMPSGVGSGSRFLQDPAGSGKIVLIGDLDYENPSNLAAGNKYTVIIQVQDVAPPYYKNNVYVYILTSPENEFPLIFDRPSYVFDVSERRPARTRVGQVRATDKDLPQSSLLYSISTGGASLQYPNVFWINPKTGELQLVTKVDCETTPIYILRIQATNNEDTSSVTVTVNILEENDEKPICTPNSYFLALPVDLKVGTNIQNFKLTCTDLDSSPRSFRYSIGPGNVNNHFTFSPNAGSNVTRLLLTSRFDYAGGFDKIWDYKLLVYVTDDNLMSDRKKAEALVETGTVTLSIKVIPHPTTIITTTPRPRVTYQVLRKNVYSPSAWYVPFVITLGSILLLGLLVYLVVLLAKAIHRHCPCKTGKNKEPLTKKGETKTAERDVVVETIQMNTIFDGEAIDPVTGETYEFNSKTGARKWKDPLTQMPKWKESSHQGAAPRRVTAGEGMGSLRSANWEEDELSGKAWAEDAGLGSRNEGGKLGNPKNRNPAFMNRAYPKPHPGK

SEQ ID NO: 880 - protein, 788 aa, unidentified
MVLLRLLVFLFAPVVSDLCSLPCFINVSESQGPGTVLQFLSFNCSSYTPTPTLELLNVQPPTTFFNPPSLARWQGTYVGKLTLSSSAQLDALMVNHYKVQLKFTCGNHVMEGSLSVDVQRDLSHIQCAGQFASPAGEMIQVPETVTPGARLYTLLLPGLELHGAQMSIISAQDLPHFPGPFSINEQGWLQAPSQGLLGQAQKVFQLQISVSFGQRQSCQGMVIVKVLPVPSSQVSFLEQAQNITIPENLAPGSEVVQVQARGVDLRYEILSPVPSPLFSIGRADGVVRTTTPLELARTSGTAVSRLQVKAFEQGQLWASAKLNLTMNVQLVNLWPPRCLPALLVSQIPETAPVGTVLNTLTCEDPDSVGATLDYKLWFRSSSNPASLCLYDRVLEVNATLDCDTPGACFQHAASILVLDGGQPQMTTEVPVLVMVTPINEFSPACAPRTFRVQEDAAPHTLLGSVVGTDMDYPHDNIEYYTSGGPTTFAVDRLSGEVHLLGPLDYEQQRLYRLTVLVIDHGQDQNPNHHLSGSCTITIEVEDVNDHAPECEPPFQELTIYAPLGRSVEVTKMSCQIPQEPQRLIYSYSIVGGNSQNRFILQGAILVHSDLVLGPFWPEQPRTYELLICVADAGPSTPHLSTTATIIVHLVPRRASTVATSTHRTTVPSTMTPMLVTDTEAFWQPQPWFVVVLTATGALLLLALGWLLGRLLQGLAQLLQAPSKPAQALLLNSIQGTEGSIEGFLEAPKMEMSQAPSSVMSLHFDGRAQDSRTGRDYLFNTHTGARRWL

SEQ ID NO: 881 - protein, 845 aa, unidentified
MGSWALLWPPLLFTGLLVRPPGTMAQAQYCSVNKDIFEVEENTNVTEPLVDIHVPEGQEVTLGALSTPFAFRIQGNQLFLNVTPDYEEKSLLEAQLLCQSGGTLVTQLRVFVSVLDVNDNAPEFPFKTKEIRVEEDTKVNSTVIPETQLQAEDRDKDDILFYTLQEMTAGASDYFSLVSVNRPALRLDRPLDFYERPNMTFWLLVRDTPGENVEPSHTATATLVLNVVPADLRPPWFLPCTFSDGYVCIQAQYHGAVPTGHILPSPLVLRPGPIYAEDGDRGINQPIIYSIFRGNVNGTFIIHPDSGNLTVARSVPSPMTFLLLVKGQQADLARYSVTQVTVEAVAAAGSPPRFPQRLYRGTVARGAGAGVVVKDAAAPSQPLRIQAQDPEFSDLNSAITYRITNHSHFRMEGEVVLTTTTLAQAGAFYAEVEAHNTVTSGTATTVIEIQVSEQEPPSTDVPPSPEAGGTTGPWTSTTSEVPRPPEPSQGPSTTSSGGGTGPHPPSGTTLRPPTSSTPGGPPGAENSTSHQPATPGGDTAQTPKPGTSQPMPPGVGTSTSHQPATPSGGTAQTPEPGTSQPMPPSMGTSTSHQPATPGGGTAQTPEAGTSQPMPPGMGTSTSHQPTTPGGGTAQTPEPGTSQPMPLSKSTPSSGGGPSEDKRFSVVDMAALGGVLGALLLLALLGLAVLVHKHYGPRLKCCCGKAPEPQPQGFDNQAFLPDHKANWAPVPSPTHDPKPAEAPMPAEPAPPGPASPGGAPEPPAAARAGGSPTAVRSILTKERRPEGGYKAVWFGEDIGTEADVVVLNAPTLDVDGASDSGSGDEGEGAGRGGGPYDAPGGDDSYI

SEQ ID NO: 882 - protein, 208 aa, unidentified
MSSEPPPPYPGGPTAPLLEEKSGAPPTPGRSSPAVMQPPPGMPLPPADIGPPPYEPPGHPMPQPGFIPPHMSADGTYMPPGFYPPPGPHPPMGYYPPGPYTPGPYPGPGGHTATVLVPSGAATTVTVLQGEIFEGAPVQTVCPHCQQAITTKISYEIGLMNFVLGFFCCFMGCDLGCCLIPCLINDFKDVTHTCPSCKAYIYTYKRLC

SEQ ID NO: 883 - protein, 213 aa, unidentified
MPDENIFLFVPNLIGYARIVFAIISFYFMPCCPLTASSFYLLSGLLDAFDGHAARALNQGTRFGAMLDMLTDRCSTMCLLVNLALLYPGATLFFQISMSLDVASHWLHLHSSVVRGSESHKMIDLSGNPVLRIYYTSRPALFTLCAGNELFYCLLYLFHFSEGPLVGSVGLFRMGLWVTAPIALLKSLISVIHLITAARNMAALDAADRAKKK

SEQ ID NO: 884 - protein, 579 aa, unidentified
MPSASCDTLLDDIEDIVSQEDSKPQDRHFVRKDVVPKVRRRNTQKYLQEEENSPPSDSTIPGIQKIWIRTWGCSHNNSDGEYMAGQLAAYGYKITENASDADLWLLNSCTVKNPAEDHFRNSIKKAQEENKKIVLAGCVPQAQPRQDYLKGLSIIGVQQIDRVVEVVEETIKGHSVRLLGQKKDNGRRLGGARLDLPKIRKNPLIEIISINTGCLNACTYCKTKHARGNLASYPIDELVDRAKQSFQEGVCEIWLTSEDTGAYGRDIGTNLPTLLWKLVEVIPEGAMLRLGMTNPPYILEHLEEMAKILNHPRVYAFLHIPVQSASDSVLMEMKREYCVADFKRVVDFLKEKVPGITIATDIICGFPGETDQDFQETVKLVEEYKFPSLFINQFYPRPGTPAAKMEQVPAQVKKQRTKDLSRVFHSYSPYDHKIGERQQVLVTEESFDSKFYVAHNQFYEQVLVPKNPAFMGKMVEVDIYESGKHFMKGQPVSDAKVYTPSISKPLAKGEVSGLTKDFRNGLGNQLSSGSHTSAASQCDSASSRMVLPMPRLHQDCALRMSVGLALLGLLFAFFVKVYN

SEQ ID NO: 885 - protein, 1287 aa, unidentified
MHPDLGPLCTLLYVTLTILCSSVSSDLAPYFTSEPLSAVQKLGGPVVLHCSAQPVTTRISWLHNGKTLDGNLEHVKIHQGTLTILSLNSSLLGYYQCLANNSIGAIVSGPATVSVAVLGDFGSSTKHVITAEEKSAGFIGCRVPESNPKAEVRYKIRGKWLEHSTENYLILPSGNLQILNVSLEDKGSYKCAAYNPVTHQLKVEPIGRKLLVSRPSSDDVHILHPTHSQALAVLSRSPVTLECVVSGVPAPQVYWLKDGQDIAPGSNWRRLYSHLATDSVDPADSGNYSCMAGNKSGDVKYVTYMVNVLEHASISKGLQDQIVSLGATVHFTCDVHGNPAPNCTWFHNAQPIHPSARHLTAGNGLKISGVTVEDVGMYQCVADNGIGFMHSTGRLEIENDGGFKPVIITAPVSAKVADGDFVTLSCNASGLPVPVIRWYDSHGLITSHPSQVLRSKSRKSQLSRPEGLNLEPVYFVLSQAGASSLHIQAVTQEHAGKYICEAANEHGTTQAEASLMVVPFETNTKAETVTLPDAAQNDDRSKRDGSETGLLSSFPVKVHPSAVESAPEKNASGISVPDAPIILSPPQTHTPDTYNLVWRAGKDGGLPINAYFVKYRKLDDGVGMLGSWHTVRVPGSENELHLAELEPSSLYEVLMVARSAAGEGQPAMLTFRTSKEKTASSKNTQASSPPVGIPKYPVVSEAANNNFGVVLTDSSRHSGVPEAPDRPTISTASETSVYVTWIPRANGGSPITAFKVEYKRMRTSNWLVAAEDIPPSKLSVEVRSLEPGSTYKFRVIAINHYGESFRSSASRPYQVVGFPNRFSSRPITGPHIAYTEAVSDTQIMLKWTYIPSSNNNTPIQGFYIYYRPTDSDNDSDYKRDVVEGSKQWHMIGHLQPETSYDIKMQCFNEGGESEFSNVMICETKVKRVPGASEYPVKDLSTPPNSLGSGGNVGPATSPARSSDMLYLIVGCVLGVMVLILMVFIAMCLWKNRQQNTIQKYDPPGYLYQGSDMNGQMVDYTTLSGASQINGNVHGGFLTNGGLSSGYSHLHHKVPNAVNGIVNGSLNGGLYSGHSNSLTRTHVDFEHPHHLVNGGGMYTAVPQIDPLECVNCRNCRNNNRCFTKTNSTFSSSPPPVVPVVAPYPQDGLEMKPLSHVKVPVCLTSAVPDCGQLPEESVKDNVEPVPTQRTCCQDIVNDVSSDGSEDPAEFSRGQEGMINLRIPDHLQLAKSCVWEGDSCAHSETEINIVSWNALILPPVPEGCAEKTMWSPPGIPLDSPTEVLQQPRET

SEQ ID NO: 886 - protein, 281 aa, unidentified
MFSCCFPTSRGCCFRNGGSESLFRQCRRRLIPHPRRLWPFVRRRTQVPQDSPGQALAGQATPEIPSGLPLHIVLVQEEIREPMEAQTHAPGPYADIAALAAPAVEPKPAWEEPPPERALEVEGAPAKDQPSQELPEIMAPTVATGLNAGAENVAGERSGREGVTSTAPASRSHAAPSPGHGGKHGGGDQGIQTGLLYLAGERLLSFAGTTALLLQGLFIVLILVGYISVKVMLKSIKTRLGRRVPAAPPALRRNLLLQAWKCVCNWASRLFAPNVLPRTGS

SEQ ID NO: 887 - protein, 461 aa, unidentified
MLELRHRGSCPGPREAVSPPHREGEAAGGDHETESTSDKETDIDDRYGDLDSRTDSDIPEIPPSSDRTPEILKKALSGLSSRWKNWWIRGILTLTMISLFFLIIYMGSFMLMLLVLGIQVKCFHEIITIGYRVYHSYDLPWFRTLSWYFLLCVNYFFYGETVADYFATFVQREEQLQFLIRYHRFISFALYLAGFCMFVLSLVKKHYRLQFYMFAWTHVTLLITVTQSHLVIQNLFEGMIWFLVPISSVICNDITAYLFGFFFGRTPLIKLSPKKTWEGFIGGFFSTVVFGFIAAYVLSKYQYFVCPVEYRSDVNSFVTECEPSELFQLQTYSLPPFLKAVLRQERVSLYPFQIHSIALSTFASLIGPFGGFFASGFKRAFKIKDFANTIPGHGGIMDRFDCQYLMATFVHVYITSFIRGPNPSKVLQQLLVLQPEQQLNIYKTLKTHLIEKGILQPTLKV

SEQ ID NO: 888 - protein, 445 aa, unidentified
MTELRQRVAHEPVAPPEDKESESEAKVDGETASDSESRAESAPLPVSADDTPEVLNRALSNLSSRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 889 - protein, 526 aa, unidentified
MGHLSAPLHRVRVPWQGLLLTASLLTFWNPPTTAQLTTESMPFNVAEGKEVLLLVHNLPQQLFGYSWYKGERVDGNRQIVGYAIGTQQATPGPANSGRETIYPNASLLIQNVTQNDTGFYTLQVIKSDLVNEEATGQFHVYPELPKPSISSNNSNPVEDKDAVAFTCEPETQDTTYLWWINNQSLPVSPRLQLSNGNRTLTLLSVTRNDTGPYECEIQNPVSANRSDPVTLNVTYGPDTPTISPSDTYYRPGANLSLSCYAASNPPAQYSWLINGTFQQSTQELFIPNITVNNSGSYTCHANNSVTGCNRTTVKTIIVTELSPVVAKPQIKASKTTVTGDKDSVNLTCSTNDTGISIRWFFKNQSLPSSERMKLSQGNTTLSINPVKREDAGTYWCEVFNPISKNQSDPIMLNVNYNALPQENGLSPGAIAGIVIGVVALVALIAVALACFLHFGKTGRASDQRDLTEHKPSVSNHTQDHSNDPPNKMNEVTYSTLNFEAQQPTQPTSASPSLTATEIIYSEVKKQ

SEQ ID NO: 890 - protein, 300 aa, unidentified
MEIPMGTQGCFSKSLLLSASILVLWMLQGSQAALYIQKIPEQPQKNQDLLLSVQGVPDTFQDFNWYLGEETYGGTRLFTYIPGIQRPQRDGSAMGQRDIVGFPNGSMLLRRAQPTDSGTYQVAITINSEWTMKAKTEVQVAEKNKELPSTHLPTNAGILAATIIGSLAAGALLISCIAYLLVTRNWRGQSHRLPAPRGQGSLSILCSAVSPVPSVTPSTWMATTEKPELGPAHDAGDNNIYEVMPSPVLLVSPISDTRSINPARPLPTPPHLQAEPENHQYQQDLLNPDPAPYCQLVPTS

SEQ ID NO: 891 - protein, 293 aa, unidentified
MGPPSACPHRECIPWQGLLLTASLLTFWNAPTTAWLFIASAPFEVAEGENVHLSVVYLPENLYSYGWYKGKTVEPNQLIAAYVIDTHVRTPGPAYSGRETISPSGDLHFQNVTLEDTGYYTLQVTYRNSQIEQASHHLRVYESVAQPSIQASSTTVTEKGSVVLTCHTNNTGTSFQWIFNNQRLQVTKRMKLSWFNHMLTIDPIRQEDAGEYQCEVSNPVSSNRSDPLKLTVKSDDNTLGILIGVLVGSLLVAALVCFLLLRKTGRASDQSDFREQQPPASTPGHGPSDSSIS

SEQ ID NO: 892 - protein, 252 aa, unidentified
MGPPSASPHRECIPWQGLLLTASLLNFWNPPTTAKLTIESMPLSVAEGKEVLLLVHNLPQHLFGYSWYKGERVDGNSLIVGYVIGTQQATPGAAYSGRETIYTNASLLIQNVTQNDIGFYTLQVIKSDLVNEEATGQFHVYQENAPGLPVGAVAGIVTGVLVGVALVAALVCFLLLAKTGRTSIQRDLKEQQPQALAPGRGPSHSSAFSMSPLSTAQAPLPNPRTAASIYEELLKHDTNIYCRMDHKAEVAS

SEQ ID NO: 893 - protein, 244 aa, unidentified
MGPPSAAPRGGHRPWQGLLITASLLTFWHPPTTVQFTIEALPSSAAEGKDVLLLACNISETIQAYYWHKGKTAEGSPLIAGYITDIQANIPGAAYSGRETVYPNGSLLFQNITLEDAGSYTLRTINASYDSDQATGQLHVHQNNVPGLPVGAVAGIVTGVLVGVALVAALVCFLLLSRTGRASIQRDLREQPPPASTPGHGPSHRSTFSAPLPSPRTATPIYEELLYSDANIYCQIDHKADVVS

SEQ ID NO: 894 - protein, 344 aa, unidentified
MGPPSAPPCRLHVPWKEVLLTASLLTFWNPPTTAKLTIESTPFNVAEGKEVLLLAHNLPQNRIGYSWYKGERVDGNSLIVGYVIGTQQATPGPAYSGRETIYPNASLLIQNVTQNDTGFYTLQVIKSDLVNEEATGQFHVYPELPKPSISSNNSNPVEDKDAVAFTCEPEVQNTTYLWWVNGQSLPVSPRLQLSNGNMTLTLLSVKRNDAGSYECEIQNPASANRSDPVTLNVLYGPDGPTISPSKANYRPGENLNLSCHAASNPPAQYSWFINGTFQQSTQELFIPNITVNNSGSYMCQAHNSATGLNRTTVTMITVSGSAPVLSAVATVGITIGVLARVALI

SEQ ID NO: 895 - protein, 265 aa, unidentified
MGSPSACPYRVCIPWQGLLLTASLLTFWNLPNSAQTNIDVVPFNVAEGKEVLLVVHNESQNLYGYNWYKGERVHANYRIIGYVKNISQENAPGPAHNGRETIYPNGTLLIQNVTHNDAGFYTLHVIKENLVNEEVTRQFYVFSEPPKPSITSNNFNPVENKDIVVLTCQPETQNTTYLWWVNNQSLLVSPRLLLSTDNRTLVLLSATKNDIGPYECEIQNPVGASRSDPVTLNVRYESVQASSPDLSAGTAVSIMIGVLAGMALI

SEQ ID NO: 896 - protein, 578 aa, unidentified
MRPALGHPRSVSSASGSFPPPPAAARLQPLFLRGGSFRGRRGSGDSSTSTSTSRGGGGGRRGGGGGSPSSSTGAEREDDDESLSVSKPLVPNAALLGPPAQVGAPAGPAPVAFSSSAATSSSTSTPTSSCSMTAADFGGGAAAGAVGGPGSRSAGGAGGTGTGSGASCCPCCCCCGCPDRPGRRGRRRGCAPSPRCRWGYQALSVVLLLAQGGLLDLYLIAVTDLYWCSWIATDLVVVVGWAIFFAKNSRGRRGGAASGAHNHHLHHHHAAPPLHLPAPSAATAGAKARGARGGAGGAGGGLGAAAAAGEFAFAYLAWLIYSIAFTPKVVLILGTSILDLIELRAPFGTTGFRLTMALSVPLLYSLVRAISEAGAPPGSAGPLLLQPQRHRAAGCFLGTCLDLLDSFTLVELMLEGRVPLPAHLRYLLIAVYFLTLASPVLWLYELNAAAAAAASWGQASGPGSCSRLLRLLGGCLVDVPLLALRCLLVVSYQQPLSIFMLKNLFFLGCRGLEALEGCWDRGNRASPSRARGGYGAPPSAPPPPPPPPQGGSQLGHCISENEGGAHGYVNTLAVASQN

SEQ ID NO: 897 - protein, 3014 aa, unidentified
MAPPPPPVLPVLLLLAAAAALPAMGLRAAAWEPRVPGGTRAFALRPGCTYAVGAACTPRAPRELLDVGRDGRLAGRRRVSGAGRPLPLQVRLVARSAPTALSRRLRARTHLPGCGARARLCGTGARLCGALCFPVPGGCAAAQHSALAAPTTLPACRCPPRPRPRCPGRPICLPPGGSVRLRLLCALRRAAGAVRVGLALEAATAGTPSASPSPSPPLPPNLPEARAGPARRARRGTSGRGSLKFPMPNYQVALFENEPAGTLILQLHAHYTIEGEEERVSYYMEGLFDERSRGYFRIDSATGAVSTDSVLDRETKETHVLRVKAVDYSTPPRSATTYITVLVKDTNDHSPVFEQSEYRERVRENLEVGYEVLTIRASDRDSPINANLRYRVLGGAWDVFQLNESSGVVSTRAVLDREEAAEYQLLVEANDQGRNPGPLSATATVYIEVEDENDNYPQFSEQNYVVQVPEDVGLNTAVLRVQATDRDQGQNAAIHYSILSGNVAGQFYLHSLSGILDVINPLDFEDVQKYSLSIKAQDGGRPPLINSSGVVSVQVLDVNDNEPIFVSSPFQATVLENVPLGYPVVHIQAVDADSGENARLHYRLVDTASTFLGGGSAGPKNPAPTPDFPFQIHNSSGWITVCAELDREEVEHYSFGVEAVDHGSPPMSSSTSVSITVLDVNDNDPVFTQPTYELRLNEDAAVGSSVLTLQARDRDANSVITYQLTGGNTRNRFALSSQRGGGLITLALPLDYKQEQQYVLAVTASDGTRSHTAHVLINVTDANTHRPVFQSSHYTVSVSEDRPVGTSIATLSANDEDTGENARITYVIQDPVPQFRIDPDSGTMYTMMELDYENQVAYTLTIMAQDNGIPQKSDTTTLEILILDANDNAPQFLWDFYQGSIFEDAPPSTSILQVSATDRDSGPNGRLLYTFQGGDDGDGDFYIEPTSGVIRTQRRLDRENVAVYNLWALAVDRGSPTPLSASVEIQVTILDINDNAPMFEKDELELFVEENNPVGSVVAKIRANDPDEGPNAQIMYQIVEGDMRHFFQLDLLNGDLRAMVELDFEVRREYVLVVQATSAPLVSRATVHILLVDQNDNPPVLPDFQILFNNYVTNKSNSFPTGVIGCIPAHDPDVSDSLNYTFVQGNELRLLLLDPATGELQLSRDLDNNRPLEALMEVSVSDGIHSVTAFCTLRVTIITDDMLTNSITVRLENMSQEKFLSPLLALFVEGVAAVLSTTKDDVFVFNVQNDTDVSSNILNVTFSALLPGGVRGQFFPSEDLQEQIYLNRTLLTTISTQRVLPFDDNICLREPCENYMKCVSVLRFDSSAPFLSSTTVLFRPIHPINGLRCRCPPGFTGDYCETEIDLCYSDPCGANGRCRSREGGYTCECFEDFTGEHCEVDARSGRCANGVCKNGGTCVNLLIGGFHCVCPPGEYERPYCEVTTRSFPPQSFVTFRGLRQRFHFTISLTFATQERNGLLLYNGRFNEKHDFIALEIVDEQVQLTFSAGETTTTVAPKVPSGVSDGRWHSVQVQYYNKPNIGHLGLPHGPSGEKMAVVTVDDCDTTMAVRFGKDIGNYSCAAQGTQTGSKKSLDLTGPLLLGGVPNLPEDFPVHNRQFVGCMRNLSVDGKNVDMAGFIANNGTREGCAARRNFCDGRRCQNGGTCVNRWNMYLCECPLRFGGKNCEQAMPHPQLFSGESVVSWSDLNIIISVPWYLGLMFRTRKEDSVLMEATSGGPTSFRLQILNNYLQFEVSHGPSDVESVMLSGLRVTDGEWHHLLIELKNVKEDSEMKHLVTMTLDYGMDQNKADIGGMLPGLTVRSVVVGGASEDKVSVRRGFRGCMQGVRMGGTPTNVATLNMNNALKVRVKDGCDVDDPCTSSPCPPNSRCHDAWEDYSCVCDKGYLGINCVDACHLNPCENMGACVRSPGSPQGYVCECGPSHYGPYCENKLDLPCPRGWWGNPVCGPCHCAVSKGFDPDCNKTNGQCQCKENYYKLLAQDTCLPCDCFPHGSHSRTCDMATGQCACKPGVIGRQCNRCDNPFAEVTTLGCEVIYNGCPKAFEAGIWWPQTKFGQPAAVPCPKGSVGNAVRHCSGEKGWLPPELFNCTTISFVDLRAMNEKLSRNETQVDGARALQLVRALRSATQHTGTLFGNDVRTAYQLLGHVLQHESWQQGFDLAATQDADFHEDVIHSGSALLAPATRAAWEQIQRSEGGTAQLLRRLEGYFSNVARNVRRTYLRPFVIVTANMILAVDIFDKFNFTGARVPRFDTIHEEFPRELESSVSFPADFFRPPEEKEGPLLRPAGRRTTPQTTRPGPGTEREAPISRRRRHPDDAGQFAVALVIIYRTLGQLLPERYDPDRRSLRLPHRPIINTPMVSTLVYSEGAPLPRPLERPVLVEFALLEVEERTKPVCVFWNHSLAVGGTGGWSARGCELLSRNRTHVACQCSHTASFAVLMDISRRENGEVLPLKIVTYAAVSLSLAALLVAFVLLSLVRMLRSNLHSIHKHLAVALFLSQLVFVIGINQTENPFLCTVVAILLHYIYMSTFAWTLVESLHVYRMLTEVRNIDTGPMRFYYVVGWGIPAIVTGLAVGLDPQGYGNPDFCWLSLQDTLIWSFAGPIGAVIIINTVTSVLSAKVSCQRKHHYYGKKGIVSLLRTAFLLLLLISATWLLGLLAVNRDALSFHYLFAIFSGLQGPFVLLFHCVLNQEVRKHLKGVLGGRKLHLEDSATTRATLLTRSLNCNTTFGDGPDMLRTDLGESTASLDSIVRDEGIQKLGVSSGLVRGSHGEPDASLMPRSCKDPPGHDSDSDSELSLDEQSSSYASSHSSDSEDDGVGAEEKWDPARGAVHSTPKGDAVANHVPAGWPDQSLAESDSEDPSGKPRLKVETKVSVELHREEQGSHRGEYPPDQESGGAARLASSQPPEQRKGILKNKVTYPPPLTLTEQTLKGRLREKLADCEQSPTSSRTSSLGSGGPDCAITVKSPGREPGRDHLNGVAMNVRTGSAQADGSDSEKP

SEQ ID NO: 898 - protein, 2923 aa, unidentified
MRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTHVFRVTAQDHGMPRRSALATLTILVTDTNDHDPVFEQQEYKESLRENLEVGYEVLTVRATDGDAPPNANILYRLLEGSGGSPSEVFEIDPRSGVIRTRGPVDREEVESYQLTVEASDQGRDPGPRSTTAAVFLSVEDDNDNAPQFSEKRYVVQVREDVTPGAPVLRVTASDRDKGSNAVVHYSIMSGNARGQFYLDAQTGALDVVSPLDYETTKEYTLRVRAQDGGRPPLSNVSGLVTVQVLDINDNAPIFVSTPFQATVLESVPLGYLVLHVQAIDADAGDNARLEYRLAGVGHDFPFTINNGTGWISVAAELDREEVDFYSFGVEARDHGTPALTASASVSVTVLDVNDNNPTFTQPEYTVRLNEDAAVGTSVVTVSAVDRDAHSVITYQITSGNTRNRFSITSQSGGGLVSLALPLDYKLERQYVLAVTASDGTRQDTAQIVVNVTDANTHRPVFQSSHYTVNVNEDRPAGTTVVLISATDEDTGENARITYFMEDSIPQFRIDADTGAVTTQAELDYEDQVSYTLAITARDNGIPQKSDTTYLEILVNDVNDNAPQFLRDSYQGSVYEDVPPFTSVLQISATDRDSGLNGRVFYTFQGGDDGDGDFIVESTSGIVRTLRRLDRENVAQYVLRAYAVDKGMPPARTPMEVTVTVLDVNDNPPVFEQDEFDVFVEENSPIGLAVARVTATDPDEGTNAQIMYQIVEGNIPEVFQLDIFSGELTALVDLDYEDRPEYVLVIQATSAPLVSRATVHVRLLDRNDNPPVLGNFEILFNNYVTNRSSSFPGGAIGRVPAHDPDISDSLTYSFERGNELSLVLLNASTGELKLSRALDNNRPLEAIMSVLVSDGVHSVTAQCALRVTIITDEMLTHSITLRLEDMSPERFLSPLLGLFIQAVAATLATPPDHVVVFNVQRDTDAPGGHILNVSLSVGQPPGPGGGPPFLPSEDLQERLYLNRSLLTAISAQRVLPFDDNICLREPCENYMRCVSVLRFDSSAPFIASSSVLFRPIHPVGGLRCRCPPGFTGDYCETEVDLCYSRPCGPHGRCRSREGGYTCLCRDGYTGEHCEVSARSGRCTPGVCKNGGTCVNLLVGGFKCDCPSGDFEKPYCQVTTRSFPAHSFITFRGLRQRFHFTLALSFATKERDGLLLYNGRFNEKHDFVALEVIQEQVQLTFSAGESTTTVSPFVPGGVSDGQWHTVQLKYYNKPLLGQTGLPQGPSEQKVAVVTVDGCDTGVALRFGSVLGNYSCAAQGTQGGSKKSLDLTGPLLLGGVPDLPESFPVRMRQFVGCMRNLQVDSRHIDMADFIANNGTVPGCPAKKNVCDSNTCHNGGTCVNQWDAFSCECPLGFGGKSCAQEMANPQHFLGSSLVAWHGLSLPISQPWYLSLMFRTRQADGVLLQAITRGRSTITLQLREGHVMLSVEGTGLQASSLRLEPGRANDGDWHHAQLALGASGGPGHAILSFDYGQQRAEGNLGPRLHGLHLSNITVGGIPGPAGGVARGFRGCLQGVRVSDTPEGVNSLDPSHGESINVEQGCSLPDPCDSNPCPANSYCSNDWDSYSCSCDPGYYGDNCTNVCDLNPCEHQSVCTRKPSAPHGYTCECPPNYLGPYCETRIDQPCPRGWWGHPTCGPCNCDVSKGFDPDCNKTSGECHCKENHYRPPGSPTCLLCDCYPTGSLSRVCDPEDGQCPCKPGVIGRQCDRCDNPFAEVTTNGCEVNYDSCPRAIEAGIWWPRTRFGLPAAAPCPKGSFGTAVRHCDEHRGWLPPNLFNCTSITFSELKGFAERLQRNESGLDSGRSQQLALLLRNATQHTAGYFGSDVKVAYQLATRLLAHESTQRGFGLSATQDVHFTENLLRVGSALLDTANKRHWELIQQTEGGTAWLLQHYEAYASALAQNMRHTYLSPFTIVTPNIVISVVRLDKGNFAGAKLPRYEALRGEQPPDLETTVILPESVFRETPPVVRPAGPGEAQEPEELARRQRRHPELSQGEAVASVIIYRTLAGLLPHNYDPDKRSLRVPKRPIINTPVVSISVHDDEELLPRALDKPVTVQFRLLETEERTKPICVFWNHSILVSGTGGWSARGCEVVFRNESHVSCQCNHMTSFAVLMDVSRRENGEILPLKTLTYVALGVTLAALLLTFFFLTLLRILRSNQHGIRRNLTAALGLAQLVFLLGINQADLPFACTVIAILLHFLYLCTFSWALLEALHLYRALTEVRDVNTGPMRFYYMLGWGVPAFITGLAVGLDPEGYGNPDFCWLSIYDTLIWSFAGPVAFAVSMSVFLYILAARASCAAQRQGFEKKGPVSGLQPSFAVLLLLSATWLLALLSVNSDTLLFHYLFATCNCIQGPFIFLSYVVLSKEVRKALKLACSRKPSPDPALTTKSTLTSSYNCPSPYADGRLYQPYGDSAGSLHSTSRSGKSQPSYIPFLLREESALNPGQGPPGLGDPGSLFLEGQDQQHDPDTDSDSDLSLEDDQSGSYASTHSSDSEEEEEEEEEEAAFPGEQGWDSLLGPGAERLPLHSTPKDGGPGPGKAPWPGDFGTTAKESSGNGAPEERLRENGDALSREGSLGPLPGSSAQPHKGILKKKCLPTISEKSSLLRLPLEQCTGSSRGSSASEGSRGGPPPRPPPRQSLQEQLNGVMPIAMSIKAGTVDEDSSGSEFLFFNFLH

SEQ ID NO: 899 - protein, 3312 aa, unidentified
MMARRPPWRGLGGRSTPILLLLLLSLFPLSQEELGGGGHQGWDPGLAATTGPRAHIGGGALALCPESSGVREDGGPGLGVREPIFVGLRGRRQSARNSRGPPEQPNEELGIEHGVQPLGSRERETGQGPGSVLYWRPEVSSCGRTGPLQRGSLSPGALSSGVPGSGNSSPLPSDFLIRHHGPKPVSSQRNAGTGSRKRVGTARCCGELWATGSKGQGERATTSGAERTAPRRNCLPGASGSGPELDSAPRTARTAPASGSAPRESRTAPEPAPKRMRSRGLFRCRFLPQRPGPRPPGLPARPEARKVTSANRARFRRAANRHPQFPQYNYQTLVPENEAAGTAVLRVVAQDPDAGEAGRLVYSLAALMNSRSLELFSIDPQSGLIRTAAALDRESMERHYLRVTAQDHGSPRLSATTMVAVTVADRNDHSPVFEQAQYRETLRENVEEGYPILQLRATDGDAPPNANLRYRFVGPPAARAAAAAAFEIDPRSGLISTSGRVDREHMESYELVVEASDQGQEPGPRSATVRVHITVLDENDNAPQFSEKRYVAQVREDVRPHTVVLRVTATDRDKDANGLVHYNIISGNSRGHFAIDSLTGEIQVVAPLDFEAEREYALRIRAQDAGRPPLSNNTGLASIQVVDINDHIPIFVSTPFQVSVLENAPLGHSVIHIQAVDADHGENARLEYSLTGVAPDTPFVINSATGWVSVSGPLDRESVEHYFFGVEARDHGSPPLSASASVTVTVLDVNDNRPEFTMKEYHLRLNEDAAVGTSVVSVTAVDRDANSAISYQITGGNTRNRFAISTQGGVGLVTLALPLDYKQERYFKLVLTASDRALHDHCYVHINITDANTHRPVFQSAHYSVSVNEDRPMGSTIVVISASDDDVGENARITYLLEDNLPQFRIDADSGAITLQAPLDYEDQVTYTLAITARDNGIPQKADTTYVEVMVNDVNDNAPQFVASHYTGLVSEDAPPFTSVLQISATDRDAHANGRVQYTFQNGEDGDGDFTIEPTSGIVRTVRRLDREAVSVYELTAYAVDRGVPPLRTPVSIQVMVQDVNDNAPVFPAEEFEVRVKENSIVGSVVAQITAVDPDEGPNAHIMYQIVEGNIPELFQMDIFSGELTALIDLDYEARQEYVIVVQATSAPLVSRATVHVRLVDQNDNSPVLNNFQILFNNYVSNRSDTFPSGIIGRIPAYDPDVSDHLFYSFERGNELQLLVVNQTSGELRLSRKLDNNRPLVASMLVTVTDGLHSVTAQCVLRVVIITEELLANSLTVRLENMWQERFLSPLLGRFLEGVAAVLATPAEDVFIFNIQNDTDVGGTVLNVSFSALAPRGAGAGAAGPWFSSEELQEQLYVRRAALAARSLLDVLPFDDNVCLREPCENYMKCVSVLRFDSSAPFLASASTLFRPIQPIAGLRCRCPPGFTGDFCETELDLCYSNPCRNGGACARREGGYTCVCRPRFTGEDCELDTEAGRCVPGVCRNGGTCTDAPNGGFRCQCPAGGAFEGPRCEVAARSFPPSSFVMFRGLRQRFHLTLSLSFATVQQSGLLFYNGRLNEKHDFLALELVAGQVRLTYSTGESNTVVSPTVPGGLSDGQWHTVHLRYYNKPRTDALGGAQGPSKDKVAVLSVDDCDVAVALQFGAEIGNYSCAAAGVQTSSKKSLDLTGPLLLGGVPNLPENFPVSHKDFIGCMRDLHIDGRRVDMAAFVANNGTMAGCQAKLHFCDSGPCKNSGFCSERWGSFSCDCPVGFGGKDCQLTMAHPHHFRGNGTLSWNFGSDMAVSVPWYLGLAFRTRATQGVLMQVQAGPHSTLLCQLDRGLLSVTVTRGSGRASHLLLDQVTVSDGRWHDLRLELQEEPGGRRGHHVLMVSLDFSLFQDTMAVGSELQGLKVKQLHVGGLPPGSAEEAPQGLVGCIQGVWLGSTPSGSPALLPPSHRVNAEPGCVVTNACASGPCPPHADCRDLWQTFSCTCQPGYYGPGCVDACLLNPCQNQGSCRHLPGAPHGYTCDCVGGYFGHHCEHRMDQQCPRGWWGSPTCGPCNCDVHKGFDPNCNKTNGQCHCKEFHYRPRGSDSCLPCDCYPVGSTSRSCAPHSGQCPCRPGALGRQCNSCDSPFAEVTASGCRVLYDACPKSLRSGVWWPQTKFGVLATVPCPRGALGAAVRLCDEAQGWLEPDLFNCTSPAFRELSLLLDGLELNKTALDTMEAKKLAQRLREVTGHTDHYFSQDVRVTARLLAHLLAFESHQQGFGLTATQDAHFNENLLWAGSALLAPETGDLWAALGQRAPGGSPGSAGLVRHLEEYAATLARNMELTYLNPMGLVTPNIMLSIDRMEHPSSPRGARRYPRYHSNLFRGQDAWDPHTHVLLPSQSPRPSPSEVLPTSSSIENSTTSSVVPPPAPPEPEPGISIIILLVYRTLGGLLPAQFQAERRGARLPQNPVMNSPVVSVAVFHGRNFLRGILESPISLEFRLLQTANRSKAICVQWDPPGLAEQHGVWTARDCELVHRNGSHARCRCSRTGTFGVLMDASPRERLEGDLELLAVFTHVVVAVSVAALVLTAAILLSLRSLKSNVRGIHANVAAALGVAELLFLLGIHRTHNQLVCTAVAILLHYFFLSTFAWLFVQGLHLYRMQVEPRNVDRGAMRFYHALGWGVPAVLLGLAVGLDPEGYGNPDFCWISVHEPLIWSFAGPVVLVIVMNGTMFLLAARTSCSTGQREAKKTSALTLRSSFLLLLLVSASWLFGLLAVNHSILAFHYLHAGLCGLQGLAVLLLFCVLNADARAAWMPACLGRKAAPEEARPAPGLGPGAYNNTALFEESGLIRITLGASTVSSVSSARSGRTQDQDSQRGRSYLRDNVLVRHGSAADHTDHSLQAHAGPTDLDVAMFHRDAGADSDSDSDLSLEEERSLSIPSSESEDNGRTRGRFQRPLCRAAQSERLLTHPKDVDGNDLLSYWPALGECEAAPCALQTWGSERRLGLDTSKDAANNNQPDPALTSGDETSLGRAQRQRKGILKNRLQYPLVPQTRGAPELSWCRAATLGHRAVPAASYGRIYAGGGTGSLSQPASRYSSREQLDLLLRRQLSRERLEEAPAPVLRPLSRPGSQECMDAAPGRLEPKDRGSTLPRRQPPRDYPGAMAGRFGSRDALDLGAPREWLSTLPPPRRTRDLDPQPPPLPLSPQRQLSRDPLLPSRPLDSLSRSSNSREQLDQVPSRHPSREALGPLPQLLRAREDSVSGPSHGPSTEQLDILSSILASFNSSALSSVQSSSTPLGPHTTATPSATASVLGPSTPRSATSHSISELSPDSEVPRSEGHS

SEQ ID NO: 900 - protein, 149 aa, unidentified [sequence omitted]

SEQ ID NO: 901 - protein, 1584 aa, unidentified
MSLTSWFLVSSGGTRHRLPREMIFVGRDDCELMLQSRSVDKQHAVINYDASTDEHLVKDLGSLNGTFVNDVRIPEQTYITLKLEDKLRFGYDTNLFTVVQGEMRVPEEALKHEKFTIQLQLSQKSSESELSKSASAKSIDSKVADAATEVQHKTTEALKSEEKAMDISAMPRGTPLYGQPSWWGDDEVDEKRAFKTNGKPEEKNHEAGTSGCGIDAKQVEEQSAAANEEVLFPFCREPSYFEIPTKEFQQPSQITESTIHEIPTKDTPSSHITGAGHASFTIEFDDSTPGKVTIRDHVTKFTSDQRHKSKKSSPGTQDLLGIQTGMMAPENKVADWLAQNNPPQMLWERTEEDSKSIKSDVPVYLKRLKGNKHDDGTQSDSENAGAHRRCSKRATLEEHLRRHHSEHKKLQKVQATEKHQDQAVTSSAHHRGGHGVPHGKLLKQKSEEPSVSIPFLQTALLRSSGSLGHRPSQEMDKMLKNQATSATSEKDNDDDQSDKGTYTIELENPNSEEVEARKMIDKVFGVDDNQDYNRPVINEKHKDLIKDWALSSAAAVMEERKPLTTSGFHHSEEGTSSSGSKRWVSQWASLAANHTRHDQEERIMEFSAPLPLENETEISESGMTVRSTGSATSLASQGERRRRTLPQLPNEEKSLESHRAKVVTQRSEIGEKQDTELQEKETPTQVYQKDKQDADRPLSKMNRAVNGETLKTGGDNKTLLHLGSSAPGKEKSETDKETSLVKQTLAKLQQQEQREEAQWTPTKLSSKNVSGQTDKCREETFKQESQPPEKNSGHSTSKGDRVAQSESKRRKAEEILKSQTPKGGDKKESSKSLVRQGSFTIEKPSPNIPIELIPHINKQTSSTPSSLALTSASRIRERSESLDPDSSMDTTLILKDTEAVMAFLEAKLREDNKTDEGPDTPSYNRDNSISPESDVDTASTISLVTGETERKSTQKRKSFTSLYKDRCSTGSPSKDVTKSSSSGAREKMEKKTKSRSTDVGSRADGRKFVQSSGRIRQPSVDLTDDDQTSSVPHSAISDIMSSDQETYSCKPHGRTPLTSADEHVHSKLEGSKVTKSKTSPVVSGSSSKSTTLPRPRPTRTSLLRRARLGEASDSELADADKASVASEVSTTSSTSKPPTGRRNISRIDLLAQPRRTRLGSLSARSDSEATISRSSASSRTAEAIIRSGARLVPSDKFSPRIRANSISRLSDSKVKSMTSAHGSASVNSRWRRFPTDYASTSEDEFGSNRNSPKHTRLRTSPALKTTRLQSAGSAMPTSSSFKHRIKEQEDYIRDWTAHREEIARISQDLALIAREINDVAGEIDSVTSSGTAPSTTVSTAATTPGSAIDTREELVDRVFDESLNFRKIPPLVHSKTPEGNNGRSGDPRPQAAEPPDHLTITRRRTWSRDEVMGDNLLLSSVFQFSKKIRQSIDKTAGKIRILFKDKDRNWDDIESKLRAESEVPIVKTSSMEISSILQELKRVEKQLQAINAMIDPDGTLEALNNMGFPSAMLPSPPKQKSSPVNNHHSPGQTPTLGQPEARALHPAAVSAAAEFENAESEADFSIHFNRFNPDGEEEDVTVQE

SEQ ID NO: 902 - protein, 821 aa, unidentified
MAGSDAEWVTIANNLLFKCHIHLRIHELQDCDANVFIALYQSILGEKVPDLIVIPRSQEDDAHNVQAVIDSLALDYLQVSLSHITGENIVKGDKESIKNLLEIFDGLLEYLTERISETSHEKSETEQYFKESDRGERLEEPESTKESKSSWKRVSFGRCSLSSEMLGPSWDGDEAESTGEIIRLGDTAHTFSLRSNGAQCPNEMLSKKALASPSSKSHEDMLYPPSVLSKSRTSFVEDTETLSVSGIPNARKLGEPIRAAIPLHPPYHPSEPRAPCPIGKEYLHSSHCSPAVNSTGEHTEFSGDLDDGLFLISKLPKGSKWEVYPAQVQGPRTRKPPKGKRNENRATASSCNSPFPQRPRKRLTEQELHDVSEKLSQRLSELDWMLKSALGDRIKEKTDHKEENTGNEEVEDGTEETLSQHSDGIVEYGPKKSRPGLSMRRKPPYRSHSLSPSPVNKHKQFHLERKRQRKPRETDVRQFQAQAFTEAFERELRRHKVQENIGPLRIHEKEEETEKIYRGEAVRKGTPECSQPWKIYSRKTTTQSLRGGLPKPNKAVPMKVSEHSLLPLMLEQFPFLYVSGPTLSKMWKQQIAQVEQLKKEACRENRSKKKLQDEIEEALRRHDLLTTLVKKEYEHNKRLQDFKDCIRRQRLTQSKIKENRQQIVRARKYYDDYRVQLCAKMMRMRTREEMIFKKLFEEGLNIQKQRLRDLRNYAKEKRDEQRRRHQDELDSMENYYKDQFSLLAEAISQEHQELKAREKSQAQTLHKVKRELRSKMEKEIQQLQDMITQNDDDVFFRELEAERFRSRLQLASFQYSKSPSL

SEQ ID NO: 903 - protein, 416 aa, unidentified
MSGHRSTRKRCGDSHPESPVGFGHMSTTGCVLNKLFQLPTPPLSRHQLKRLEEHRYQSAGRSLLEPLMQGYWEWLVRRVPSWIAPNLITIIGLSINICTTILLVFYCPTATEQAPLWAYIACACGLFIYQSLDAIDGKQARRTNSSSPLGELFDHGCDSLSTVFVVLGTCIAVQLGTNPDWMFFCCFAGTFMFYCAHWQTYVSGTLRFGIIDVTEVQIFIIIMHLLAVIGGPPFWQSMIPVLNIQMKIFPALCTVAGTIFSCTNYFRVIFTGGVGKNGSTIAGTSVLSPFLHIGSVITLAAMIYKKSAVQLFEKHPCLYILTFGFVSAKITNKLVVAHMTKSEMHLHDTAFIGPALLFLDQYFNSFIDEYIVLWIALVFSFFDLIRYCVSVCNQIASHLHIHVFRIKVSTAHSNHH

SEQ ID NO: 904 - protein, 350 aa, unidentified
MAAAGPAAGPTGPEPMPSYAQLVQRGWGSALAAARGCTDCGWGLARRGLAEHAHLAPPELLLLALGALGWTALRSAATARLFRPLAKRCCLQPRDAAKMPESAWKFLFYLGSWSYSAYLLFGTDYPFFHDPPSVFYDWTPGMAVPRDIAAAYLLQGSFYGHSIYATLYMDTWRKDSVVMLLHHVVTLILIVSSYAFRYHNVGILVLFLHDISDVQLEFTKLNIYFKSRGGSYHRLHALAADLGCLSFGFSWFWFRLYWFPLKVLYATSHCSLRTVPDIPFYFFFNALLLLLTLMNLYWFLYIVAFAAKVLTGQVHELKDLREYDTAEAQSLKPSKAEKPLRNGLVKDKRF

SEQ ID NO: 905 - protein, 380 aa, unidentified
MLQTLYDYFWWERLWLPVNLTWADLEDRDGRVYAKASDLYITLPLALLFLIVRYFFELYVATPLAALLNIKEKTRLRAPPNATLEHFYLTSGKQPKQVEVELLSRQSGLSGRQVERWFRRRRNQDRPSLLKKFREASWRFTFYLIAFIAGMAVIVDKPWFYDMKKVWEGYPIQSTIPSQYWYYMIELSFYWSLLFSIASDVKRKDFKEQIIHHVATIILISFSWFANYIRAGTLIMALHDSSDYLLESAKMFNYAGWKNTCNNIFIVFAIVFIITRLVILPFWILHCTLVYPLELYPAFFGYYFFNSMMGVLQLLHIFWAYLILRMAHKFITGKLVEDERSDREETESSEGEEAAAGGGAKSRPLANGHPILNNNHRKND

SEQ ID NO: 906 - protein, 383 aa, unidentified
MFWTFKEWFWLERFWLPPTIKWSDLEDHDGLVFVKPSHLYVTIPYAFLLLIIRRVFEKFVASPLAKSFGIKETVRKVTPNTVLENFFKHSTRQPLQTDIYGLAKKCNLTERQVERWFRSRRNQERPSRLKKFQEACWRFAFYLMITVAGIAFLYDKPWLYDLWEVWNGYPKQPLLPSQYWYYILEMSFYWSLLFRLGFDVKRKDFLAHIIHHLAAISLMSFSWCANYIRSGTLVMIVHDVADIWLESAKMFSYAGWTQTCNTLFFIFSTIFFISRLIVFPFWILYCTLILPMYHLEPFFSYIFLNLQLMILQVLHLYWGYYILKMLNRCIFMKSIQDVRSDDEDYEEEEEEEEEEATKGKEMDCLKNGLRAERHLIPNGQHGH

SEQ ID NO: 907 - protein, 394 aa, unidentified
MLSSFNEWFWQDRFWLPPNVTWTELEDRDGRVYPHPQDLLAALPLALVLLAMRLAFERFIGLPLSRWLGVRDQTRRQVKPNATLEKHFLTEGHRPKEPQLSLLAAQCGLTLQQTQRWFRRRRNQDRPQLTKKFCEASWRFLFYLSSFVGGLSVLYHESWLWAPVMCWDRYPNQTLKPSLYWWYLLELGFYLSLLIRLPFDVKRKDFKEQVIHHFVAVILMTFSYSANLLRIGSLVLLLHDSSDYLLEACKMVNYMQYQQVCDALFLIFSFVFFYTRLVLFPTQILYTTYYESISNRGPFFGYYFFNGLLMLLQLLHVFWSCLILRMLYSFMKKGQMEKDIRSDVEESDSSEEAAAAQEPLQLKNGAAGGPRPAPTDGPRSRVAGRLTNRHTTAT

SEQ ID NO: 908 - protein, 392 aa, unidentified
MATAAQGPLSLLWGWLWSERFWLPENVSWADLEGPADGYGYPRGRHILSVFPLAAGIFFVRLLFERFIAKPCALCIGIEDSGPYQAQPNAILEKVFISITKYPDKKRLEGLSKQLDWNVRKIQCWFRHRRNQDKPPTLTKFCESMWRFTFYLCIFCYGIRFLWSSPWFWDIRQCWHNYPFQPLSSGLYHYYIMELAFYWSLMFSQFTDIKRKDFLIMFVHHLVTIGLISFSYINNMVRVGTLIMCLHDVSDFLLEAAKLANYAKYQRLCDTLFVIFSAVFMVTRLGIYPFWILNTTLFESWEIIGPYASWWLLNGLLLTLQLLHVIWSYLIARIALKALIRGKVSKDDRSDVESSSEEEDVTTCTKSPCDSSSSNGANRVNGHMGGSYWAEE

SEQ ID NO: 909 - protein, 384 aa, unidentified
MAGILAWFWNERFWLPHNVTWADLKNTEEATFPQAEDLYLAFPLAFCIFMVRLIFERFVAKPCAIALNIQANGPQIAPPNAILEKVFTAITKHPDEKRLEGLSKQLDWDVRSIQRWFRQRRNQEKPSTLTRFCESMWRFSFYLYVFTYGVRFLKKTPWLWNTRHCWYNYPYQPLTTDLHYYYILELSFYWSLMFSQFTDIKRKDFGIMFLHHLVSIFLITFSYVNNMARVGTLVLCLHDSADALLEAAKMANYAKFQKMCDLLFVMFAVVFITTRLGIFPLWVLNTTLFESWEIVGPYPSWWVFNLLLLLVQGLNCFWSYLIVKIACKAVSRGKVSKDDRSDIESSSDEEDSEPPGKNPHTATTTNGTSGTNGYLLTGSCSMDD

SEQ ID NO: 910 - protein, 559 aa, unidentified
MRLHRLRARLSAVACGLLLLLVRGQGQDSASPIRTTHTGQVLGSLVHVKGANAGVQTFLGIPFAKPPLGPLRFAPPEPPESWSGVRDGTTHPAMCLQDLTAVESEFLSQFNMTFPSDSMSEDCLYLSIYTPAHSHEGSNLPVMVWIHGGALVFGMASLYDGSMLAALENVVVVIIQYRLGVLGFFSTGDKHATGNWGYLDQVAALRWVQQNIAHFGGNPDRVTIFGESAGGTSVSSLVVSPISQGLFHGAIMESGVALLPGLIASSADVISTVVANLSACDQVDSEALVGCLRGKSKEEILAINKPFKMIPGVVDGVFLPRHPQELLASADFQPVPSIVGVNNNEFGWLIPKVMRIYDTQKEMDREASQAALQKMLTLLMLPPTFGDLLREEYIGDNGDPQTLQAQFQEMMADSMFVIPALQVAHFQCSRAPVYFYEFQHQPSWLKNIRPPHMKADHGDELPFVFRSFFGGNYIKFTEEEEQLSRKMMKYWANFARNGNPNGEGLPHWPLFDQEEQYLQLNLQPAVGRALKAHRLQFWKKALPQKIQELEEPEERHTEL

SEQ ID NO: 911 - protein, 2715 aa, unidentified
MDLVITQELARAESQQDAASLKKAYELIKSANLGKSEFDPSESFSPDLFVLCAEQALKMRQPEVSEDCIQMYFKVKAPITQFLGRAHLCRAQMCAPKSAENLEEFENCVTEYMKAINFAKGEPRYYFLVYNASVLYWQMVRPFLKPGYRHHLIPSLSQIINVLSQTEEEDKEWRAELMLELLECYLQAGRKEEAARFCSTAAPFIKSHVPQKYRQIFSVMVRHELMDELQLKEEKKNSISLSVTFYINMLKAKAEQNDLPGDISVILRKAYRHLGHYNHQRFPSISEEKMLLLFELARFSLTLKCMEISSACLSDLKKMESKDPGKLIEMECLECESEALRLESKMKVYNRAAVEAQLDIIQRLDVALQRAVRLGDPRVIHVVCATQWNTCLPLLQHNLRHHLRKPLAGVADVLEKLDSLMTLLRCQVHMEMAQIEEDEDRLEPATEHLRKAARLDSLGLYRDRIQMASTRLRLCTTLYQAPERAEDKAIMAVEQAKKATPKDSVRKKRALLVNAGLALAPDAFQIVLDSENEAKVSTGKNRGRFTYLCAKAWHHTVSVDKAAGHLRRLGNENDKERIQIWAELAKVARKQGVWDVCRTASRFCLLYDNVKVKKLRLRRGKKKRGRDGSVQDTWSQPEVVLQRQVCPDLLRKFAEVGFIHAEATVHLLRSEGVELNDRAIPPEDLSQHPAGYVPEPPEVNAEWITYRTWIESLSRCAMNNWLRSAEIGQEIQEAWIVQNAVVYVLNHNHHLILAGRQKELVDALYHLLSIVKATGHSGDPVMLVTLCNTLARGLIISWIPVQAAEKSRKFMRPNAFHSPLDAGATSEIKTAVEVCEFALNLTNGSAPEETVPTGTRQQLIATWVKAKQLLQQQIGPRLGTEEQGTNEDVSSVTRVLVALEMYSCNGLGLMDFTVPSLAQLVKMASECNWSDPLVELQTLTRLTHFAHAARDHETTMACAHRALEMGIKYLKKFGPEESRLVAEMLCTATAIQGRSIMENLKGRKQLRLVAAKAFTESARFGGIAGSSALVMLAARHYWNAWLPLLSSAVYRKKAKGALKRLIGIINKTEARKQEKGKTLLLHQWPTADFQGGGTTEGYFLPGAEDDLALRAALYGLLFHSHADQDDWEGGLKVLDEAVQVLPRTAHRLLIFKHMVIVKAKLGQNFSMEIQKFKAESEDYLARMWHRLALNSPSVSGELACYNNAIQALQKPEMEWQKVEYLMEFGQWLHHRHFPLEDVVFHLRWAVEILLAMKPPGDVPEPQPTPDGEYVAVEMPPRSPVSEAEEAVSLEQLRSVRQLEALARVHILLALVLSPGAEGYEDCCLAAYAFFRHIWQVSLMTAGKSVLENRPLAATSSHLLLPKKEKENERSKEKEKERSKEKENERSKEKDKEKGKEEKVKEPKQSQSPAPIKQLEDLPMSIEEWASYSCPEEVLSVLKQDRSDSTVNPSSIQKPTYSLYFLDHLVKALQKMCLHELTVPVLQLGVLISDSVVGSKGLSDLYHLRLAHACSELKLREAAARHEEAVGQVCVSELEQASCRKEIALKKEKNKEPLLEESLPALNEQTLPVQPGEIKPLDAKDKILKMNGETGRDLDGTSFPHLWMLKAEVLLEMNLYQPARLLLSEAYLAFQELDEPCAEAQCLLLLAQLANKEKNYGQAKKMIAQAQHLGGSEEFWYNSTLTLAEALLSMEHSGREATVCHIFQKLINAFKILKKERPNRLPLLEFMITDLEARCLSLRVRVAQHSAVTEPTECSLLLKEMDDGLLEIERKFIDCGCKENCVDVKLERAKIKRLRAQNEKDEEQKTAYYLEAYGLAQGAVAEEEGRLHSIQGLYGLAQGAMAEEEGRLHSVQGLLSLQDLQNVNTPLMRKLARLKLGLVEMALDMLQFIWEEAHGQQSEQGSLEKLLADYLQNTSDYTSVGLQWFTLKRTLAHGALAQLGSLQPLSVGCVEIRARLLGLAGRALHLLAMQADPVHPTCYWEAGPSVGAKLSGLKSLELEVEEEGATKSSRDPPASRAAPEEHCRRGEDLKRRMVLAQQYLAQASEVLLQCLQVALGSGLLDVAAAASLEMVECVGTLDPATTCQFLALSQSCSASETMRDVLLAATANTSSSQLAALLQLQHQLRCQDRTTTSLGARVEQRLAAVSKAWQNLCVTEQHFNLLNEMPPTFWILFLHLSGDRSRLYGAAYEKPKFITAAKGKVQAVGGSCKVMRLAISPTAFSHLLACAQQFRKQTQAQVYSEDMALNIGSEPEGLQVEEKERPVQRLSSVLGPLEELLQPLFPLLSLSKARVQTPAVVADSGKSKGKDKERKTSTGQHSTVQPEVADKIVLVADRHLLELPLEGLSVFDEGTISSVSREFSLQMLWNRLHKEETEGGVKKEGRSRDPKKRSLAKKGRKGSIPRTIPPDCIIVDSDNFKFVVDPYEEAQGPEMLTPVSITQDILERFQDTFTSRWAGHLGSKHFPSQAQWEQALGSCSGFFFYGMESFLSHILVERLVAMNLQECQVAVLLDLARSYQSLKRHMESVEHRRSVGRWEANWRNSASPSEDEWRRGGEPRRGFSDLEGQAAAAPKLRAPSHHAQLGPVWAAAPSHRVVQAWTCLPSAAGAPALASALGSAPLPTHPHLPAPIPSSQLALPFLGLSPALGAASARDPPPATSRKAAAWTSSSACLCAPWGLRRGWSCVSSRGQDKGGLPLAALVLSCLDQKTIQTVSLFLI

SEQ ID NO: 912 - protein, 3187 aa, unidentified
MNTQKGSLTINVHRGSLAMSIQRGSLVPRDMDSSGRDMQLRVIPAEVKFLDTMAGRVYRLPITVHNICRWNQKIRFKEPVKPQFKLMLTSLDKELASGLQMTAMVEYHPDKDEDTFDRLLISIENKTTEIPLIGLIPSCQLEIESVVNFGTLVANSKVYSKEITITNHGKAPGIFKAEYHGQLPILIFPTSGIVDAKSSMVIKVDFCADQPRIVDEEAIVILQGQPEMLLSIKAHVVEQIIELLSMSSDRRLECIHFGPVFFGSSKIKHARVYNNSPEPINWVAIIQDDAVGEELGTDIQQRTDIALNNLTYIRKIKNIDTTIIISCLPNEGTLQPYQKTVITFCFTPKLMAVGKKDIGPSYRQDYALFLRFESVGSKDGFLRDDDYKTIKSERFQKVELALTGTGLPVLLQFDPGPVLNFKPCFMGERSEIQCIIKNQCELLPVTYHFKKTANFEIDPEKGKITGGGMVDVMCSFVPHQLGVFKVKQMIEIIGLVAEEDLQSLSVKSFHHVYLAFNSICKASTKKVVMKFDPGILPSIRNPTGKFVVKDLAKRKNYAPVAMLQSAMTRTHNHRSCEEPVKDMLLAFPNDRAATIRSKDHHKHFRPIFTKVPRFNYVNHDFAYTTFEKQQKKLHENYYAMYLKYLRSVRLQKKQAERERMYSYDDTDIGLEPGSGLKSPSLSEAEIEEELSSAANSIRANRLLTTRGIASQEEESVRRKVLKGLKSEPSTPQEKHDCSLMLTPKQIHQVIVGPSVLNFGNICVNSPNTHLLHVINMLPMHVLLQLDTDLEELQKTNQFSYVILPTSSTYISMVFDSPTIGKFWKSFTFTVNNVPSGHILVVAVVQPVTLELSSNELVLRPRGFFMKTCFRGTVRLYNRQNCCAQFQWQPVNTGRGIAFSICPAKGTVEAYSSLECEVTWQQGFSSPEEGEFILHVFQGNALKLKCVAHLGRTKVLLLQPRILFSNCPQGLTTWRKAILQNVGQNHAYFKVCSQSLLPIINIIPSQGIVPFGGITVLNISCKPTVAEKFDTRAKVSIRHANVIDLRIGGSAEIADVEINPDVFNFSGAYIGGTQIIPFVIKNKGITRARVEFNLKDFPDFSMDLKDKSEEFKDPAVPYIYSLELEENTSLECSITFSPKEVTVVEFIIQVQINFFESSKLYTKYLSSSPSNPKTVPLIRPCYVQATALQSPLNLSSTKFVFEIPLHEMNPNNKVTKTQNLVLYNITKHHVTWTLDLSNTGKLFKDGTFKFSVLNGILRPNEKYNVSISFCPNRPGTYTADIPMLLNYIPVCYKILHLTGEVKSPELLFDPPFIFFTPVPLDITTVMDINILPQNYFRNSTLCVQIPTVRLLDGEEIHPLSVKFPKGRVIPGSHSGINNKLTCHLSFKSSKPVSFFTNLLFCDDRKNWFSLPVTATAENCILTIYPYMAIHLDKQNIILKNDKDEYLKKTRDGVLPPYQDAKPPSPASIKKTYTTSKFNDAEPAKGNLFIGVEVLPENLHLDESETSEEDHGSLEKEKYEQFLSLEEGTKAHYFFEKVVNAAQTWFSLFGWPEGPHSFSIPETIRRDVYKMQFYSSTSPPQKFSRQNDFSKYNKTIYDVLLHLSGKMPPGINSSQSLPVDNHEKRVIQLHLQHSSLLDFLNAQGGCISHVLPEFLLEPEDYKRWIEIMSSTNTMPVSSCTPKKKCSIVIEMSKFEAWSKRAWTDVFLQIYKVLVLSRVVPYCSNNMPPICVQNTPKVNPCFASSNIYSDSERILLSWMNINYENTRHVIWKNCHKDVIPSERWIVNFDKDLSDGLVFATQLGAYCPFLIESHFINMYTRPKSPEEYLHNCLIIVNTLYEIDFDVEIQATDICDPNPILMLMLCVYMYERLPTYLPKKVVSFECTLHDTVLNKILLKNSSSRNLVYNARIVGRDAADFSLSQKGNVVTISPRNEINVTLKFTSRFIRPAEASLLLISKPKNAVRGITMTFALKGKVLDFKAIDIIKCESPCYQFQEVTVNVKNPFHTAGDFSVILVESSTFVSSPTKLTESRQYPKHDDDMSSSGSDTDQGCSDSPNVLHTSIKSTFIREFFCSMHTVHLGVKGTSSLELRFLPFNMHVRYCVIILSNKKIGQLIYVAEGKGMTPLPSSCLPMNTSSSPVYYSTTREEGPNKKYPVLYLKCKPYQILYVDLKLPMTNEAKEKALAFAAQQQMSSIEYERRLITGTLESSSIRVAIALLGLTKIETLMLFRISKLRKPKTVSYTTEVSLPKYFYIPEKISIPWIPEPQVIKLSKAKASDGSVPLPLQFLPLQSGRYPCKILLKSRYDVRAYYVEGIVNEEQPEAKFEFETPAFEALTQNIPIKNQTNDKWTFQVTIEGEWFYGPVDLHVGPDEIVEYPLTFKPIFECVITGKLILQNEVDGREHIFDIKGVGKKPSALEHITVECQVGNVTQKHITLPHFTNTALTFKVTADLPIVWGNPQITVYPYKEILYLIHVRPWKRGILKGTITFSTTRRCTTRRKHDDYEEDTDQDQALSCLDSITEQSSILDDADTYGNFNNLRFWYNLEIHSTPGPPIEIMEMTCIALDSTCIEIPLSNPKDRGLHLEVQLTSAALNGDNEIILSPLQCTKYIVWYSPATTGYSDESIIFQPEMAEEFWYLLKLTIELPKPTTMPEIQCDLGKHVTQIIPLVNCTHETLKLQVTNSNPENFVLDINRKSQLIISPHSTTELPVLFYPSALGRADHQACINFYCTQFTEWKFYLSGVGLFPQPLDTERITTRIGLQSTIVIPFKNPTMEDVLIDIILTSVEHPRNLVMDHCWDSFIYESSAFRFSSPSEIQGIALPPKGNIDISLLFIPQIMKLHKTMVIIEMTKANGKYWPIDNFDELDIKFKSIVGIDSEEIQAIHWIYPIVGLPQAPPPKSPPVVIQCQSRKRAEEKVEIILNAGFFGFSLTPDLTEVLVIPKRNSHNFCEDPNEIPKIHEFEYEIQFESEAMKSKLESCVALYMIEKSYDIMAKRITFIFNLVFTPKKPLRSHITLKIECVTEGIWKFPIMLIATEPDTDAVIDIEGVGLFKESVFELRLKSQTRNPEPFTAHFLPGSDLEFFVKPQAGELLPFNTNGTLITVGFKPKMYCRKYKATLVIQTEEMYWKYEINGLTPTTVPPKNAKAKIDATHKTHDNMPVRPHNFVRENTKLIRTGVSSTIKGAPLVKNQ

SEQ ID NO: 913 - protein, 1250 aa, unidentified
MSAVVAQTLHVFGLRSHVANNIFYFDEQIIIFPSGNHCVKYNVDQKWQKFIPGSEKSQGMLALSISPNRRYLAISETVQEKPAITIYELSSIPCRKRKVLNNFDFQVQKFISMAFSPDSKYLLAQTSPPESNLVYWLWEKQKVMAIVRIDTQNNPVYQVSFSPQDNTQVCVTGNGMFKLLRFAEGTLKQTSFQRGEPQNYLAHTWVADDKIVVGTDTGKLFLFESGDQRWETSIMVKEPTNGSKSLDVIQESESLIEFPPVSSPLPSYEQMVAASSHSQMSMPQVFAIAAYSKGFACSAGPGRVLLFEKMEEKDFYRESREIRIPVDPQSNDPSQSDKQDVLCLCFSPSEETLVASTSKNQLYSITMSLTEISKGEPAHFEYLMYPLHSAPITGLATCIRKPLIATCSLDRSIRLWNYETNTLELFKEYQEEAYSISLHPSGHFIVVGFADKLRLMNLLIDDIRSFKEYSVRGCGECSFSNGGHLFAAVNGNVIHVYTTTSLENISSLKGHTGKIRSIVWNADDSKLISGGTDGAVYEWNLSTGKRETECVLKSCSYNCVTVSPDAKIIFAVGSDHTLKEIADSLILREISAFDVTYTAIVISHSGRMMFVGTSVGTIRAMKYPLPLQKEFNEYQAHAGPITKMLLTFDDQFLLTAAEDGCLFTWKVFDKDGRGIKREREVGFAEEVLVTKTDMEEKAQVMLELKTRVEELKMENEYQLRLKDMNYSEKIKELTDKFIQEMESLKTKNQVLRTEKEKQDVYHHEHIEDLLDKQSRELQDMECCNNQKLLLEYEKYQELQLKSQRMQEEYEKQLRDNDETKSQALEELTEFYEAKLQEKTTLLEEAQEDVRQQLREFEETKKQIEEDEDREIQDIKTKYEKKLRDEKESNLRLKGETGIMRKKFSSLQKEIEERTNDIETLKGEQMKLQGVIKSLEKDIQGLKREIQERDETIQDKEKRIYDLKKKNQELGKFKFVLDYKIKELKKQIEPRENEIRVMKEQIQEMEAELENFHKQNTQLELNITELWQKLRATDQEMRRERQKERDLEALVKRFKTDLHNCVAYIQEPRLLKEKVRGLFEKYVQRADMVEIAGLNTDLQQEYTRQREHLERNLATLKKKVVKEGELHRTDYVRIMQENVSLIKEINELRRELKFTRSQVYDLEAALKLTKKVRPQEVSETEPSRDMLSTAPTARLNEQEETGRIIEMQRLEIQRLRDQIQEQEQVTGFHTLAGVRLPSLSNSEVDLEVKTN

SEQ ID NO: 914 - protein, 1237 aa, unidentified
MSVLTSPRGKVEVVHCRRTESQDVYCIKSLIRKFTCKLFGKLNIIYLLEKANLAVTLCNDKEEIMAQATFLDYPNWNVAKQDDWVSVFRELDSDIPCTPLNTLFMHLFVAVDEYSVGCCKEILRTVYKAVPELHFIFLIVPSYMSLGSTLITVFDQVGNIPCLTYEEDFAVHICHRHSHYPQLHVRKARVEDHDDLMPIFMRYDTILKETYGEYFLAELIEAQDEENHAVVCEVEGTAVGFMSVCSRVNMQLLHECFDLGPFHGLCFPHPDDVLESPQDLSVRRSQDAELRSSSQGSQKIVEELQEPVSPDTMENIQGNIAREAASEEALTAVQSGNVSEPEDIEKLSDISTGYAQYHHVSSRSLASLVLPEEPVHFRPIYRGASAAFCIQLFCIDEKYEARSLDFMNFVFSLFSDKNFCVISLPHLTPEFFLIQNFVKMVPFNTCTLEQDLYVFHRAGLLKSINIRFATLLDTPGVENLVSTLMLNKSILEDLDRYNKARKDPDGTLLQAFVAEVAEQIVGIAVIRNEMDIEYIRSHYNIEDFIYFSHHQREEHGHMHHFALNPIFRHYTKFFLKEILRLGFKSCLYYRVYPKSREGKFQNPYAHSLTSALHYLVPVRPRRQIVYPLEKLGINAPSKAVSKDPMSYALNHTNRKLTLEPKITVNAKIIVVGASSVGISFLETLVFCSHMKFNNLTLISTHGLPGKKLLDTEQRKFLASDHCFNDKDYALMSLCSWVNVVVGRMTGIDRAAKHVVLSTDEIVPYDHLILCTGQQYQVPCPTEADISQHLTNREVPNSSQRRYTGKVPCNHFTLNEEEDCFKALIWIRNNSITTEGNIIVYGNTIDTYTTVETLLNLGVSGSRIHLVQPPPASTITCINNYSVESAVADALGAAGVTMYRDAILAQWNDGLHPDPIYSASFTTPTKPFRLQCSMFFSFCEKNVDYETFKALNDACLVYDSRLVIDTNFHTNDIAIRAAGSLTKFSNRYYSNEWTHSNFSSKEIGFQLAAAMLHLFDPTLEPVTEPPANLDRLIPMYKGAKIQGGILPGSYHYLHIAKPAIPTPLEVQMAQPNYGLELVTGSAKNGTYFRIHINKYKMVETITCLSREPFPASNYIRLFGQHEQLLNNLCARYDENLITDLYSYFTEPWCLALFHDRFIDLRKELRQILASKEEEDLPSIEQLAHQIEDEEINPTEKPRQYLKRVFEESIYKTLVERSTLDYLHYNRYHLPMYAWPGIV

SEQ ID NO: 915 - protein, 1480 aa, unidentified
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKISERLVITSEMIENIQSVKAYCWEEAMEKMIENLRQTELKLTRKAAYVRYFNSSAFFFSGFFVVFLSVLPYALIKGIILRKIFTTISFCIVLRMAVTRQFPWAVQTWYDSLGAINKIQDFLQKQEYKTLEYNLTTTEVVMENVTAFWEEGFGELFEKAKQNNNNRKTSNGDDSLFFSNFSLLGTPVLKDINFKIERGQLLAVAGSTGAGKTSLLMVIMGELEPSEGKIKHSGRISFCSQFSWIMPGTIKENIIFGVSYDEYRYRSVIKACQLEEDISKFAEKDNIVLGEGGITLSGGQRARISLARAVYKDADLYLLDSPFGYLDVLTEKEIFESCVCKLMANKTRILVTSKMEHLKKADKILILHEGSSYFYGTFSELQNLQPDFSSKLMGCDSFDQFSAERRNSILTETLHRFSLEGDAPVSWTETKKQSFKQTGEFGEKRKNSILNPINSIRKFSIVQKTPLQMNGIEEDSDEPLERRLSLVPDSEQGEAILPRISVISTGPTLQARRRQSVLNLMTHSVNQGQNIHRKTTASTRKVSLAPQANLTELDIYSRRLSQETGLEISEEINEEDLKECFFDDMESIPAVTTWNTYLRYITVHKSLIFVLIWCLVIFLAEVAASLVVLWLLGNTPLQDKGNSTHSRNNSYAVIITSTSSYYVFYIYVGVADTLLAMGFFRGLPLVHTLITVSKILHHKMLHSVLQAPMSTLNTLKAGGILNRFSKDIAILDDLLPLTIFDFIQLLLIVIGAIAVVAVLQPYIFVATVPVIVAFIMLRAYFLQTSQQLKQLESEGRSPIFTHLVTSLKGLWTLRAFGRQPYFETLFHKALNLHTANWFLYLSTLRWFQMRIEMIFVIFFIAVTFISILTTGEGEGRVGIILTLAMNIMSTLQWAVNSSIDVDSLMRSVSRVFKFIDMPTEGKPTKSTKPYKNGQLSKVMIIENSHVKKDDIWPSGGQMTVKDLTAKYTEGGNAILENISFSISPGQRVGLLGRTGSGKSTLLSAFLRLLNTEGEIQIDGVSWDSITLQQWRKAFGVIPQKVFIFSGTFRKNLDPYEQWSDQEIWKVADEVGLRSVIEQFPGKLDFVLVDGGCVLSHGHKQLMCLARSVLSKAKILLLDEPSAHLDPVTYQIIRRTLKQAFADCTVILCEHRIEAMLECQQFLVIEENKVRQYDSIQKLLNERSLFRQAISPSDRVKLFPHRNSSKCKSKPQIAALKEETEEEVQDTRL

SEQ ID NO: 916 - protein, 332 aa, unidentified
MAAVFLVTLYEYSPLFYIAVVFTCFIVTTGLVLGWFGWDVPVILRNSEETQFSTRVFKKQMRQVKNPFGLEITNPSSASITTGITLTTDCLEDSLLTCYWGCSVQKLYEALQKHVYCFRISTPQALEDALYSEYLYQEQYFIKKDSKEEIYCQLPRDTKIEDFGTVPRSRYPLVALLTLADEDDREIYDIISMVSVIHIPDRTYKLSCRILYQYLLLAQGQFHDLKQLFMSANNNFTPSNNSSSEEKNTDRSLLEKVGLSESEVEPSEENSKDCVVCQNGTVNWVLLPCRHTCLCDGCVKYFQQCPMCRQFVQESFALCSQKEQDKDKPKTL

SEQ ID NO: 917 - protein, 272 aa, unidentified
MSCHNCSDPQVLCSSGQLFLQPLWDHLRSWEALLQSPFFPVIFSITTYVGFCLPFVVLDILCSWVPALRRYKIHPDFSPSAQQLLPCLGQTLYQHVMFVFPVTLLHWARSPALLPHEAPELLLLLHHILFCLLLFDMEFFVWHLLHHKVPWLYRTFHKVHHQNSSSFALATQYMSVWELFSLGFFDMMNVTLLGCHPLTTLTFHVVNIWLSVEDHSGYNFPWSTHRLVPFGWYGGVVHHDLHHSHFNCNFAPYFTHWDKILGTLRTASVPAR

SEQ ID NO: 918 - protein, 543 aa, unidentified
MSRESDVEAQQSHGSSACSQPHGSVTQSQGSSSQSQGISSSSTSTMPNSSQSSHSSSGTLSSLETVSTQELYSIPEDQEPEDQEPEEPTPAPWARLWALQDGFANLECVNDNYWFGRDKSCEYCFDEPLLKRTDKYRTYSKKHFRIFREVGPKNSYIAYIEDHSGNGTFVNTELVGKGKRRPLNNNSEIALSLSRNKVFVFFDLTVDDQSVYPKALRDEYIMSKTLGSGACGEVKLAFERKTCKKVAIKIISKRKFAIGSAREADPALNVETEIEILKKLNHPCIIKIKNFFDAEDYYIVLELMEGGELFDKVVGNKRLKEATCKLYFYQMLLAVQYLHENGIIHRDLKPENVLLSSQEEDCLIKITDFGHSKILGETSLMRTLCGTPTYLAPEVLVSVGTAGYNRAVDCWSLGVILFICLSGYPPFSEHRTQVSLKDQITSGKYNFIPEVWAEVSEKALDLVKKLLVVDPKARFTTEEALRHPWLQDEDMKRKFQDLLSEENESTALPQVLAQPSTSRKRPREGEAEGAETTKRPAVCAAVL

SEQ ID NO: 919 - protein, 224 aa, unidentified
MSILLPNMAEFDTISELEEEEEEEAATSSSSPSSSSSVSGPDDDEEDEEEEEEEEEEEEEEEEEEEEEAPPPPRVVSEEHLRRYAPDPVLVRGAGHITVFGLSNKFDTEFPSVLTGKVAPEEFKTSIGRVNACLKKALPVNVKWLLCGCLCCCCTLGCSLWPVICLNKRTRRSIQKLIEWENNRLYHKLALHWKLTKRKCETSNMMEYVILIEFLPKYPIFRPD

SEQ ID NO: 920 - protein, 165 aa, unidentified
MADFDEIYEEEEDEERALEEQLLKYSPDPVVVRGSGHVTVFGLSNKFESEFPSSLTGKVAPEEFKASINRVNSCLKKNLPVNVRWLLCGCLCCCCTLGCSMWPVICLSKRTRRSIEKLLEWENNRLYHKLCLHWRLSKRKCETNNMMEYVILIEFLPKTPIFRPD

SEQ ID NO: 921 - protein, 1208 aa, unidentified
MEPLLLGRGLIVYLMFLLLKFSKAIEIPSSVQQVPTIIKQSKVQVAFPFDEYFQIECEAKGNPEPTFSWTKDGNPFYFTDHRIIPSNNSGTFRIPNEGHISHFQGKYRCFASNKLGIAMSEEIEFIVPSVPKFPKEKIDPLEVEEGDPIVLPCNPPKGLPPLHIYWMNIELEHIEQDERVYMSQKGDLYFANVEEKDSRNDYCCFAAFPRLRTIVQKMPMKLTVNSSNSIKQRKPKLLLPPTESGSESSITILKGEILLLECFAEGLPTPQVDWNKIGGDLPKGRETKENYGKTLKIENVSYQDKGNYRCTASNFLGTATHDFHVIVEEPPRWTKKPQSAVYSTGSNGILLCEAEGEPQPTIKWRVNGSPVDNHPFAGDVVFPREISFTNLQPNHTAVYQCEASNVHGTILANANIDVVDVRPLIQTKDGENYATVVGYSAFLHCEFFASPEAVVSWQKVEEVKPLEGRRYHIYENGTLQINRTTEEDAGSYSCWVENAIGKTAVTANLDIRNATKLRVSPKNPRIPKLHMLELHCESKCDSHLKHSLKLSWSKDGEAFEINGTEDGRIIIDGANLTISNVTLEDQGIYCCSAHTALDSAADITQVTVLDVPDPPENLHLSERQNRSVRLTWEAGADHNSNISEYIVEFEGNKEEPGRWEELTRVQGKKTTVILPLAPFVRYQFRVIAVNEVGRSQPSQPSDHHETPPAAPDRNPQNIRVQASQPKEMIIKWEPLKSMEQNGPGLEYRVTWKPQGAPVEWEEETVTNHTLRVMTPAVYAPYDVKVQAINQLGSGPDPQSVTLYSGEDYPDTAPVIHGVDVINSTLVKVTWSTVPKDRVHGRLKGYQINWWKTKSLLDGRTHPKEVNILRFSGQRNSGMVPSLDAFSEFHLTVLAYNSKGAGPESEPYIFQTPEGVPEQPTFLKVIKVDKDTATLSWGLPKKLNGNLTGYLLQYQIINDTYEIGELNDINITTPSKPSWHLSNLNATTKYKFYLRACTSQGCGKPITEESSTLGEGSKGIGKISGVNLTQKTHPIEVFEPGAEHIVRLMTKNWGDNDSIFQDVIETRGREYAGLYDDISTQGWFIGLMCAIALLTLLLLTVCFVKRNRGGKYSVKEKEDLHPDPEIQSVKDETFGEYSDSDEKPLKGSLRSLNRDMQPTESADSLVEYGEGDHGLFSEDGSFIGAYAGSKEKGSVESNGSSTATFPLRA

SEQ ID NO: 922 - protein, 656 aa, unidentified
MADNLPTEFDVVIIGTGLPESILAAACSRSGQRVLHIDSRSYYGGNWASFSFSGLLSWLKEYQQNNDIGEESTVVWQDLIHETEEAITLRKKDETIQHTEAFCYASQDMEDNVEEIGALQKNPSLGVSNTFTEVLDSALPEESQLSYFNSDEMPAKHTQKSDTEISLEVTDVEESVEKEKYCGDKTCMHTVSDKDGDKDESKSTVEDKADEPIRNRITYSQIVKEGRRFNIDLVSKLLYSQGLLIDLLIKSDVSRYVEFKNVTRILAFREGKVEQVPCSRADVFNSKELTMVEKRMLMKFLTFCLEYEQHPDEYQAFRQCSFSEYLKTKKLTPNLQHFVLHSIAMTSESSCTTIDGLNATKNFLQCLGRFGNTPFLFPLYGQGEIPQGFCRMCAVFGGIYCLRHKVQCFVVDKESGRCKAIIDHFGQRINAKYFIVEDSYLSEETCSNVQYKQISRAVLITDQSILKTDLDQQTSILIVPPAEPGACAVRVTELCSSTMTCMKDTYLVHLTCSSSKTAREDLESVVKKLFTPYTETEINEEELTKPRLLWALYFNMRDSSGISRSSYNGLPSNVYVCSGPDCGLGNEHAVKQAETLFQEIFPTEEFCPPPPNPEDIIFDGDDKQPEAPGTNNVVMAKLESSEESKNLESPEKHLQN

SEQ ID NO: 923 - protein, 273 aa, unidentified
MSRVVSLLLGAALLCGHGAFCRRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPNQSTLWISKSTRKESGMEV

SEQ ID NO: 924 - protein, 406 aa, unidentified
MAAGAGAGSAPRWLRALSEPLSAAQLRRLEEHRYSAAGVSLLEPPLQLYWTWLLQWIPLWMAPNSITLLGLAVNVVTTLVLISYCPTATEEAPYWTYLLCALGLFIYQSLDAIDGKQARRTNSCSPLGELFDHGCDSLSTVFMAVGASIAARLGTYPDWFFFCSFIGMFVFYCAHWQTYVSGMLRFGKVDVTEIQIALVIVFVLSAFGGATMWDYTIPILEIKLKILPVLGFLGGVIFSCSNYFHVILHGGVGKNGSTIAGTSVLSPGLHIGLIIILAIMIYKKSATDVFEKHPCLYILMFGCVFAKVSQKLVVAHMTKSELYLQDTVFLGPGLLFLDQYFNNFIDEYVVLWMAMVISSFDMVIYFSALCLQISRHLHLNIFKTACHQAPEQVQVLSSKSHQNNMD

SEQ ID NO: 925 - protein, 412 aa, unidentified
MQKYCIYQHFQFQLLIQHLWIAANCDIADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 926 - protein, 460 aa, unidentified
MNTSAPPAVSPNITVLAPGKGPWQVAFIGITTGLLSLATVTGNLLVLISFKVNTELKTVNNYFLLSLACADLIIGTFSMNLYTTYLLMGHWALGTLACDLWLALDYVASNASVMNLLLISFDRYFSVTRPLSYRAKRTPRRAALMIGLAWLVSFVLWAPAILFWQYLVGERTVLAGQCYIQFLSQPIITFGTAMAAFYLPVTVMCTLYWRIYRETENRARELAALQGSETPGKGGGSSSSSERSQPGAEGSPETPPGRCCRCCRAPRLLQAYSWKEEEEEDEGSMESLTSSEGEEPGSEVVIKMPMVDPEAQAPTKQPPRSSPNTVKRPTKKGRDRAGKGQKPRGKEQLAKRKTFSLVKEKKAARTLSAILLAFILTWTPYNIMVLVSTFCKDCVPETLWELGYWLCYVNSTINPMCYALCNKAFRDTFRLLLLCRWDKRRWRKIPKRPGSVHRTPSRQC

SEQ ID NO: 927 - protein, 466 aa, unidentified
MNNSTNSSNNSLALTSPYKTFEVVFIVLVAGSLSLVTIIGNILVMVSIKVNRHLQTVNNYFLFSLACADLIIGVFSMNLYTLYTVIGYWPLGPVVCDLWLALDYVVSNASVMNLLIISFDRYFCVTKPLTYPVKRTTKMAGMMIAAAWVLSFILWAPAILFWQFIVGVRTVEDGECYIQFFSNAAVTFGTAIAAFYLPVIIMTVLYWHISRASKSRIKKDKKEPVANQDPVSPSLVQGRIVKPNNNNMPSSDDGLEHNKIQNGKAPRDPVTENCVQGEEKESSNDSTSVSAVASNMRDDEITQDENTVSTSLGHSKDENSKQTCIRIGTKTPKSDSCTPTNTTVEVVGSSGQNGDEKQNIVARKIVKMTKQPAKKKPPPSREKKVTRTILAILLAFIITWAPYNVMVLINTFCAPCIPNTVWTIGYWLCYINSTINPACYALCNATFKKTFKHLLMCHYKNIGATR

SEQ ID NO: 928 - protein, 590 aa, unidentified
MTLHNNSTTSPLFPNISSSWIHSPSDAGLPPGTVTHFGSYNVSRAAGNFSSPDGTTDDPLGGHTVWQVVFIAFLTGILALVTIIGNILVIVSFKVNKQLKTVNNYFLLSLACADLIIGVISMNLFTTYIIMNRWALGNLACDLWLAIDYVASNASVMNLLVISFDRYFSITRPLTYRAKRTTKRAGVMIGLAWVISFVLWAPAILFWQYFVGKRTVPPGECFIQFLSEPTITFGTAIAAFYMPVTIMTILYWRIYKETEKRTKELAGLQASGTEAETENFVHPTGSSRSCSSYELQQQSMKRSNRRKYGRCHFWFTTKSWKPSSEQMDQDHSSSDSWNNNDAAASLENSASSDEEDIGSETRAIYSIVLKLPGHSTILNSTKLPSSDNLQVPEEELGMVDLERKADKLQAQKSVDDGGSFPKSFSKLPIQLESAVDTAKTSDVNSSVGKSTATLPLSFKEATLAKRFALKTRSQITKRKRMSLVKEKKAAQTLSAILLAFIITWTPYNIMVLVNTFCDSCIPKTFWNLGYWLCYINSTVNPVCYALCNKTFRTTFKMLLLCQCDKKKRRKQQYQQRQSVIFHKRAPEQAL

SEQ ID NO: 929 - protein, 479 aa, unidentified
MANFTPVNGSSGNQSVRLVTSSSHNRYETVEMVFIATVTGSLSLVTVVGNILVMLSIKVNRQLQTVNNYFLFSLACADLIIGAFSMNLYTVYIIKGYWPLGAVVCDLWLALDYVVSNASVMNLLIISFDRYFCVTKPLTYPARRTTKMAGLMIAAAWVLSFVLWAPAILFWQFVVGKRTVPDNQCFIQFLSNPAVTFGTAIAAFYLPVVIMTVLYIHISLASRSRVHKHRPEGPKEKKAKTLAFLKSPLMKQSVKKPPPGEAAREELRNGKLEEAPPPALPPPPRPVADKDTSNESSSGSATQNTKERPATELSTTEATTPAMPAPPLQPRALNPASRWSKIQIVTKQTGNECVTAIEIVPATPAGMRPAANVARKFASIARNQVRKKRQMAARERKVTRTIFAILLAFILTWTPYNVMVLVNTFCQSCIPDTVWSIGYWLCYVNSTINPACYALCNATFKKTFRHLLLCQYRNIGTAR

SEQ ID NO: 930 - protein, 532 aa, unidentified
MEGDSYHNATTVNGTPVNHQPLERHRLWEVITIAAVTAVVSLITIVGNVLVMISFKVNSQLKTVNNYYLLSLACADLIIGIFSMNLYTTYILMGRWALGSLACDLWLALDYVASNASVMNLLVISFDRYFSITRPLTYRAKRTPKRAGIMIGLAWLISFILWAPAILCWQYLVGKRTVPLDECQIQFLSEPTITFGTAIAAFYIPVSVMTILYCRIYRETEKRTKDLADLQGSDSVTKAEKRKPAHRALFRSCLRCPRPTLAQRERNQASWSSSRRSTSTTGKPSQATGPSANWAKAEQLTTCSSYPSSEDEDKPATDPVLQVVYKSQGKESPGEEFSAEETEETFVKAETEKSDYDTPNYLLSPAAAHRPKSQKCVAYKFRLVVKADGNQETNNGCHKVKIMPCPFPVAKEPSTKGLNPNPSHQMTKRKRVVLVKERKAAQTLSAILLAFIITWTPYNIMVLVSTFCDKCVPVTLWHLGYWLCYVNSTVNPICYALCNRTFRKTFKMLLLCRWKKKKVEEKLYWQGNSKLP

SEQ ID NO: 931 - protein, 482 aa, unidentified
MEPWPLLLLFSLCSAGLVLGSEHETRLVAKLFKDYSSVVRPVEDHRQVVEVTVGLQLIQLINVDEVNQIVTTNVRLKQGDMVDLPRPSCVTLGVPLFSHLQNEQWVDYNLKWNPDDYGGVKKIHIPSEKIWRPDLVLYNNADGDFAIVKFTKVLLQYTGHITWTPPAIFKSYCEIIVTHFPFDEQNCSMKLGTWTYDGSVVAINPESDQPDLSNFMESGEWVIKESRGWKHSVTYSCCPDTPYLDITYHFVMQRLPLYFIVNVIIPCLLFSFLTGLVFYLPTDSGEKMTLSISVLLSLTVFLLVIVELIPSTSSAVPLIGKYMLFTMVFVIASIIITVIVINTHHRSPSTHVMPNWVRKVFIDTIPNIMFFSTMKRPSREKQDKKIFTEDIDISDISGKPGPPPMGFHSPLIKHPEVKSAIEGIKYIAETMKSDQESNNAAAEWKYVAMVMDHILLGVFMLVCIIGTLAVFAGRLIELNQQG

SEQ ID NO: 932 - protein, 450 aa, unidentified
MGLRSHHLSLGLLLLFLLPAECLGAEGRLALKLFRDLFANYTSALRPVADTDQTLNVTLEVTLSQIIDMDERNQVLTLYLWIRQEWTDAYLRWDPNAYGGLDAIRIPSSLVWRPDIVLYNKADAQPPGSASTNVVLRHDGAVRWDAPAITRSSCRVDVAAFPFDAQHCGLTFGSWTHGGHQLDVRPRGAAASLADFVENVEWRVLGMPARRRVLTYGCCSEPYPDVTFTLLLRRRAAAYVCNLLLPCVLISLLAPLAFHLPADSGEKVSLGVTVLLALTVFQLLLAESMPPAESVPLIGKYYMATMTMVTFSTALTILIMNLHYCGPSVRPVPAWARALLLGHLARGLCVRERGEPCGQSRPPELSPSPQSPEGGAGPPAGPCHEPRCLCRQEALLHHVATIANTFRSHRAAQRCHEDWKRLARVMDRFFLAIFFSMALVMSLLVLVQAL

SEQ ID NO: 933 - protein, 529 aa, unidentified
MGPSCPVFLSFTKLSLWWLLLTPAGGEEAKRPPPRAPGDPLSSPSPTALPQGGSHTETEDRLFKHLFRGYNRWARPVPNTSDVVIVRFGLSIAQLIDVDEKNQMMTTNVWLKQEWSDYKLRWNPTDFGNITSLRVPSEMIWIPDIVLYNNADGEFAVTHMTKAHLFSTGTVHWVPPAIYKSSCSIDVTFFPFDQQNCKMKFGSWTYDKAKIDLEQMEQTVDLKDYWESGEWAIVNATGTYNSKKYDCCAEIYPDVTYAFVIRRLPLFYTINLIIPCLLISCLTVLVFYLPSDCGEKITLCISVLLSLTVFLLLITEIIPSTSLVIPLIGEYLLFTMIFVTLSIVITVFVLNVHHRSPSTHTMPHWVRGALLGCVPRWLLMNRPPPPVELCHPLRLKLSPSYHWLESNVDAEEREVVVEEEDRWACAGHVAPSVGTLCSHGHLHSGASGPKAEALLQEGELLLSPHMQKALEGVHYIADHLRSEDADSSVKEDWKYVAMVIDRIFLWLFIIVCFLGTIGLFLPPFLAGMI

SEQ ID NO: 934 - protein, 505 aa, unidentified
MGSGPLSLPLALSPPRLLLLLLLSLLPVARASEAEHRLFERLFEDYNEIIRPVANVSDPVIIHFEVSMSQLVKVDEVNQIMETNLWLKQIWNDYKLKWNPSDYGGAEFMRVPAQKIWKPDIVLYNNAVGDFQVDDKTKALLKYTGEVTWIPPAIFKSSCKIDVTYFPFDYQNCTMKFGSWSYDKAKIDLVLIGSSMNLKDYWESGEWAIIKAPGYKHDIKYNCCEEIYPDITYSLYIRRLPLFYTINLIIPCLLISFLTVLVFYLPSDCGEKVTLCISVLLSLTVFLLVITETIPSTSLVIPLIGEYLLFTMIFVTLSIVITVFVLNVHYRTPTTHTMPSWVKTVFLNLLPRVMFMTRPTSNEGNAQKPRPLYGAELSNLNCFSRAESKGCKEGYPCQDGMCGYCHHRRIKISNFSANLTRSSSSESVDAVLSLSALSPEIKEAIQSVKYIAENMKAQNEAKEIQDDWKYVAMVIDRIFLWVFTLVCILGTAGLFLQPLMAREDA

SEQ ID NO: 935 - protein, 627 aa, unidentified
MELGGPGAPRLLPPLLLLLGTGLLRASSHVETRAHAEERLLKKLFSGYNKWSRPVANISDVVLVRFGLSIAQLIDVDEKNQMMTTNVWVKQEWHDYKLRWDPADYENVTSIRIPSELIWRPDIVLYNNADGDFAVTHLTKAHLFHDGRVQWTPPAIYKSSCSIDVTFFPFDQQNCTMKFGSWTYDKAKIDLVNMHSRVDQLDFWESGEWVIVDAVGTYNTRKYECCAEIYPDITYAFVIRRLPLFYTINLIIPCLLISCLTVLVFYLPSECGEKITLCISVLLSLTVFLLLITEIIPSTSLVIPLIGEYLLFTMIFVTLSIVITVFVLNVHHRSPRTHTMPTWVRRVFLDIVPRLLLMKRPSVVKDNCRRLIESMHKMASAPRFWPEPEGEPPATSGTQSLHPPSPSFCVPLDVPAEPGPSCKSPSDQLPPQQPLEAEKASPHPSPGPCRPPHGTQAPGLAKARSLSVQHMSSPGEAVEGGVRCRSRSIQYCVPRDDAAPEADGQAAGALASRNTHSAELPPPDQPSPCKCTCKKEPSSVSPSATVKTRSTKAPPPHLPLSPALTRAVEGVQYIADHLKAEDTDFSVKEDWKYVAMVIDRIFLWMFIIVCLLGTVGLFLPPWLAGMI

SEQ ID NO: 936 - protein, 468 aa, unidentified
MAARGSGPRALRLLLLVQLVAGRCGLAGAAGGAQRGLSEPSSIAKHEDSLLKDLFQDYERWVRPVEHLNDKIKIKFGLAISQLVDVDEKNQLMTTNVWLKQEWIDVKLRWNPDDYGGIKVIRVPSDSVWTPDIVLFDNADGRFEGTSTKTVIRYNGTVTWTPPANYKSSCTIDVTFFPFDLQNCSMKFGSWTYDGSQVDIILEDQDVDKRDFFDNGEWEIVSATGSKGNRTDSCCWYPYVTYSFVIKRLPLFYTLFLIIPCIGLSFLTVLVFYLPSNEGEKICLCTSVLVSLTVFLLVIEEIIPSSSKVIPLIGEYLVFTMIFVTLSIMVTVFAINIHHRSSSTHNAMAPLVRKIFLHTLPKLLCMRSHVDRYFTQKEETESGSGPKSSRNTLEAALDSIRYITRHIMKENDVREVVEDWKFIAQVLDRMFLWTFLFVSIVGSLGLFVPVIYKWANILIPVHIGNANK

SEQ ID NO: 937 - protein, 494 aa, unidentified
MLTSKGQGFLHGGLCLWLCVFTPFFKGCVGCATEERLFHKLFSHYNQFIRPVENVSDPVTVHFEVAITQLANVDEVNQIMETNLWLRHIWNDYKLRWDPMEYDGIETLRVPADKIWKPDIVLYNNAVGDFQVEGKTKALLKYNGMITWTPPAIFKSSCPMDITFFPFDHQNCSLKFGSWTYDKAEIDLLIIGSKVDMNDFWENSEWEIIDASGYKHDIKYNCCEEIYTDITYSFYIRRLPMFYTINLIIPCLFISFLTVLVFYLPSDCGEKVTLCISVLLSLTVFLLVITETIPSTSLVVPLVGEYLLFTMIFVTLSIVVTVFVLNIHYRTPTTHTMPRWVKTVFLKLLPQVLLMRWPLDKTRGTGSDAVPRGLARRPAKGKLASHGEPRHLKECFHCHKSNELATSKRRLSHQPLQWVVENSEHSPEVEDVINSVQFIAENMKSHNETKEVEDDWKYVAMVVDRVFLWVFIIVCVFGTAGLFLQPLLGNTGKS

SEQ ID NO: 938 - protein, 502 aa, unidentified
MRCSPGGVWLALAASLLHVSLQGEFQRKLYKELVKNYNPLERPVANDSQPLTVYFSLSLLQIMDVDEKNQVLTTNIWLQMSWTDHYLQWNVSEYPGVKTVRFPDGQIWKPDILLYNSADERFDATFHTNVLVNSSGHCQYLPPGIFKSSCYIDVRWFPFDVQHCKLKFGSWSYGGWSLDLQMQEADISGYIPNGEWDLVGIPGKRSERFYECCKEPYPDVTFTVTMRRRTLYYGLNLLIPCVLISALALLVFLLPADSGEKISLGITVLLSLTVFMLLVAEIMPATSDSVPLIAQYFASTMIIVGLSVVVTVIVLQYHHHDPDGGKMPKWTRVILLNWCAWFLRMKRPGEDKVRPACQHKQRRCSLASVEMSAVAPPPASNGNLLYIGFRGLDGVHCVPTPDSGVVCGRMACSPTHDEHLLHGGQPPEGDPDLAKILEEVRYIANRFRCQDESEAVCSEWKFAACVVDRLCLMAFSVFTIICTIGILMSAPNFVEAVSKDFA

SEQ ID NO: 939 - protein, 479 aa, unidentified
MNWSHSCISFCWIYFAASRLRAAETADGKYAQKLFNDLFEDYSNALRPVEDTDKVLNVTLQITLSQIKDMDERNQILTAYLWIRQIWHDAYLTWDRDQYDGLDSIRIPSDLVWRPDIVLYNKADDESSEPVNTNVVLRYDGLITWDAPAITKSSCVVDVTYFPFDNQQCNLTFGSWTYNGNQVDIFNALDSGDLSDFIEDVEWEVHGMPAVKNVISYGCCSEPYPDVTFTLLLKRRSSFYIVNLLIPCVLISFLAPLSFYLPAASGEKVSLGVTILLAMTVFQLMVAEIMPASENVPLIGKYYIATMALITASTALTIMVMNIHFCGAEARPVPHWARVVILKYMSRVLFVYDVGESCLSPHHSRERDHLTKVYSKLPESNLKAARNKDLSRKKDMNKRLKNDLGCQGKNPQEAESYCAQYKVLTRNIEYIAKCLKDHKATNSKGSEWKKVAKVIDRFFMWIFFIMVFVMTILIIARAD

SEQ ID NO: 940 - protein, 501 aa, unidentified
MTPGALLMLLGALGAPLAPGVRGSEAEGRLREKLFSGYDSSVRPAREVGDRVRVSVGLILAQLISLNEKDEEMSTKVYLDLEWTDYRLSWDPAEHDGIDSLRITAESVWLPDVVLLNNNDGNFDVALDISVVVSSDGSVRWQPPGIYRSSCSIQVTYFPFDWQNCTMVFSSYSYDSSEVSLQTGLGPDGQGHQEIHIHEGTFIENGQWEIIHKPSRLIQPPGDPRGGREGQRQEVIFYLIIRRKPLFYLVNVIAPCILITLLAIFVFYLPPDAGEKMGLSIFALLTLTVFLLLLADKVPETSLSVPIIIKYLMFTMVLVTFSVILSVVVLNLHHRSPHTHQMPLWVRQIFIHKLPLYLRLKRPKPERDLMPEPPHCSSPGSGWGRGTDEYFIRKPPSDFLFPKPNRFQPELSAPDLRRFIDGPNRAVALLPELREVVSSISYIARQLQEQEDHDALKEDWQFVAMVVDRLFLWTFIIFTSVGTLVIFLDATYHLPPPDPFP

SEQ ID NO: 941 - protein, 502 aa, unidentified
MARRCGPVALLLGFGLLRLCSGVWGTDTEERLVEHLLDPSRYNKLIRPATNGSELVTVQLMVSLAQLISVHEREQIMTTNVWLTQEWEDYRLTWKPEEFDNMKKVRLPSKHIWLPDVVLYNNADGMYEVSFYSNAVVSYDGSIFWLPPAIYKSACKIEVKHFPFDQQNCTMKFRSWTYDRTEIDLVLKSEVASLDDFTPSGEWDIVALPGRRNENPDDSTYVDITYDFIIRRKPLFYTINLIIPCVLITSLAILVFYLPSDCGEKMTLCISVLLALTVFLLLISKIVPPTSLDVPLVGKYLMFTMVLVTFSIVTSVCVLNVHHRSPTTHTMAPWVKVVFLEKLPALLFMQQPRHHCARQRLRLRRRQREREGAGALFFREAPGADSCTCFVNRASVQGLAGAFGAEPAPVAGPGRSGEPCGCGLREAVDGVRFIADHMRSEDDDQSVSEDWKYVAMVIDRLFLWIFVFVCVFGTIGMFLQPLFQNYTTTTFLHSDHSAPSSK

SEQ ID NO: 942 - protein, 458 aa, unidentified
MLPDFMLVLIVLGIPSSATTGFNSIAENEDALLRHLFQGYQKWVRPVLHSNDTIKVYFGLKISQLVDVDEKNQLMTTNVWLKQEWTDHKLRWNPDDYGGIHSIKVPSESLWLPDIVLFENADGRFEGSLMTKVIVKSNGTVVWTPPASYKSSCTMDVTFFPFDRQNCSMKFGSWTYDGTMVDLILINENVDRKDFFDNGEWEILNAKGMKGNRRDGVYSYPFITYSFVLRRLPLFYTLFLIIPCLGLSFLTVLVFYLPSDEGEKLSLSTSVLVSLTVFLLVIEEIIPSSSKVIPLIGEYLLFIMIFVTLSIIVTVFVINVHHRSSSTYHPMAPWVKRLFLQKLPKLLCMKDHVDRYSSPEKEESQPVVKGKVLEKKKQKQLSDGEKVLVAFLEKAADSIRYISRHVKKEHFISQVVQDWKFVAQVLDRIFLWLFLIVSVTGSVLIFTPALKMWLHSYH

SEQ ID NO: 943 - protein, 498 aa, unidentified
MRRAPSLVLFFLVALCGRGNCRVANAEEKLMDDLLNKTRYNNLIRPATSSSQLISIKLQLSLAQLISVNEREQIMTTNVWLKQEWTDYRLTWNSSRYEGVNILRIPAKRIWLPDIVLYNNADGTYEVSVYTNLIVRSNGSVLWLPPAIYKSACKIEVKYFPFDQQNCTLKFRSWTYDHTEIDMVLMTPTASMDDFTPSGEWDIVALPGRRTVNPQDPSYVDVTYDFIIKRKPLFYTINLIIPCVLTTLLAILVFYLPSDCGEKMTLCISVLLALTFFLLLISKIVPPTSLDVPLIGKYLMFTMVLVTFSIVTSVCVLNVHHRSPSTHTMAPWVKRCFLHKLPTFLFMKRPGPDSSPARAFPPSKSCVTKPEATATSTSPSNFYGNSMYFVNPASAASKSPAGSTPVAIPRDFWLRSSGRFRQDVQEALEGVSFIAQHMKNDDEDQSVVEDWKYVAMVVDRLFLWVFMFVCVLGTVGLFLPPLFQTHAASEGPYAAQRD

SEQ ID NO: 944 - protein, 517 aa, unidentified
MEGPVLTLGLLAALAVCGSWGLNEEERLIRHLFQEKGYNKELRPVAHKEESVDVALALTLSNLISLKEVEETLTTNVWIEHGWTDNRLKWNAEEFGNISVLRLPPDMVWLPEIVLENNNDGSFQISYSCNVLVYHYGFVYWLPPAIFRSSCPISVTYFPFDWQNCSLKFSSLKYTAKEITLSLKQDAKENRTYPVEWIIIDPEGFTENGEWEIVHRPARVNVDPRAPLDSPSRQDITFYLIIRRKPLFYIINILVPCVLISFMVNLVFYLPADSGEKTSVAISVLLAQSVFLLLISKRLPATSMAIPLIGKFLLFGMVLVTMVVVICVIVLNIHFRTPSTHVLSEGVKKLFLETLPELLHMSRPAEDGPSPGALVRRSSSLGYISKAEEYFLLKSRSDLMFEKQSERHGLARRLTTARRPPASSEQAQQELFNELKPAVDGANFIVNHMRDQNNYNEEKDSWNRVARTVDRLCLFVVTPVMVVGTAWIFLQGVYNQPPPQPFPGDPYSYNVQDKRFI

SEQ ID NO: 945 - protein, 493 aa, unidentified
MARAPLGVLLLLGLLGRGVGKNEELRLYHHLFNNYDPGSRPVREPEDTVTISLKVTLTNLISLNEKEETLTTSVWIGIDWQDYRLNYSKDDFGGIETLRVPSELVWLPEIVLENNIDGQFGVAYDANVLVYEGGSVTWLPPAIYRSVCAVEVTYFPFDWQNCSLIFRSQTYNAEEVEFTFAVDNDGKTINKIDIDTEAYTENGEWAIDFCPGVIRRHHGGATDGPGETDVIYSLIIRRKPLFYVINIIVPCVLISGLVLLAYFLPAQAGGQKCTVSINVLLAQTVFLFLIAQKIPETSLSVPLLGRFLIFVMVVATLIVMNCVIVLNVSQRTPTTHAMSPRLRHVLLELLPRLLGSPPPPEAPRAASPPRRASSVGLLLRAEELILKKPRSELVFEGQRHRQGTWTAAFCQSLGAAAPEVRCCVDAVNFVAESTRDQEATGEEVSDWVRMGNALDNICFWAALVLFSVGSSLIFLGAYFNRVPDLPYAPCIQP

SEQ ID NO: 946 - protein, 517 aa, unidentified
MHGGQGPLLLLLLLAVCLGAQGRNQEERLLADLMQNYDPNLRPAERDSDVVNVSLKLTLTNLISLNEREEALTTNVWIEMQWCDYRLRWDPRDYEGLWVLRVPSTMVWRPDIVLENNVDGVFEVALYCNVLVSPDGCIYWLPPAIFRSACSISVTYFPFDWQNCSLIFQSQTYSTNEIDLQLSQEDGQTIEWIFIDPEAFTENGEWAIQHRPAKMLLDPAAPAQEAGHQKVVFYLLIQRKPLFYVINIIAPCVLISSVAILIHFLPAKAGGQKCTVAINVLLAQTVFLFLVAKKVPETSQAVPLISKYLTFLLVVTILIVVNAVVVLNVSLRSPHTHSMARGVRKVFLRLLPQLLRMHVRPLAPAAVQDTQSRLQNGSSGWSITTGEEVALCLPRSELLFQQWQRQGLVAAALEKLEKGPELGLSQFCGSLKQAAPAIQACVEACNLIACARHQQSHFDNGNEEWFLVGRVLDRVCFLAMLSLFICGTAGIFLMAHYNRVPALPFPGDPRPYLPSPD

SEQ ID NO: 947 - protein, 356 aa, unidentified
MHHQWLLLAACFWVIFMFMVASKFITLTFKDPDVYSAKQEFLFLTTMPEVRKLPEEKHIPEELKPTGKELPDSQLVQPLVYMERLELIRNVCRDDALKNLSHTPVSKFVLDRIFVCDKHKILFCQTPKVGNTQWKKVLIVLNGAFSSIEEIPENVVHDHEKNGLPRLSSFSDAEIQKRLKTYFKFFIVRDPFERLISAFKDKFVHNPRFEPWYRHEIAPGIIRKYRRNRTETRGIQFEDFVRYLGDPNHRWLDLQFGDHIIHWVTYVELCAPCEIMYSVIGHHETLEDDAPYILKEAGIDHLVSYPTIPPGITVYNRTKVEHYFLGISKRDIRRLYARFEGDFKLFGYQKPDFLLN

SEQ ID NO: 948 - protein, 414 aa, unidentified
MTKARLFRLWLVLGSVFMILLIIVYWDSAGAAHFYLHTSFSRPHTGPPLPTPGPDRDRELTADSDVDEFLDKFLSAGVKQSDLPRKETEQPPAPGSMEESVRGYDWSPRDARRSPDQGRQQAERRSVLRGFCANSSLAFPTKERAFDDIPNSELSHLIVDDRHGAIYCYVPKVACTNWKRVMIVLSGSLLHRGAPYRDPLRIPREHVHNASAHLTFNKFWRRYGKLSRHLMKVKLKKYTKFLFVRDPFVRLISAFRSKFELENEEFYRKFAVPMLRLYANHTSLPASAREAFRAGLKVSFANFIQYLLDPHTEKLAPFNEHWRQVYRLCHPCQIDYDFVGKLETLDEDAAQLLQLLQVDRQLRFPPSYRNRTASSWEEDWFAKIPLAWRQQLYKLYEADFVLFGYPKPENLLRD

SEQ ID NO: 949 - protein, 376 aa, unidentified
MFPRPLTPLAAPNGAEPLGRALRRAPLGRARAGLGGPPLLLPSMLMFAVIVASSGLLLMIERGILAEMKPLPLHPPGREGTAWRGKAPKPGGLSLRAGDADLQVRQDVRNRTLRAVCGQPGMPRDPWDLPVGQRRTLLRHILVSDRYRFLYCYVPKVACSNWKRVMKVLAGVLDSVDVRLKMDHRSDLVFLADLRPEEIRYRLQHYFKFLFVREPLERLLSAYRNKFGEIREYQQRYGAEIVRRYRAGAGPSPAGDDVTFPEFLRYLVDEDPERMNEHWMPVYHLCQPCAVHYDFVGSYERLEADANQVLEWVRAPPHVRFPARQAWYRPASPESLHYHLCSAPRALLQDVLPKYILDFSLFAYPLPNVTKEACQQ

SEQ ID NO: 950 - protein, 561 aa, unidentified
MRHCINCCIQLLPDGAHKQQVNCQGGPHHGHQACPTCKGENKILFRVDSKQMNLLAVLEVRTEGNENWGGFLRFKKGKRCSLVFGLIIMTLVMASYILSGAHQELLISSPFHYGGFPSNPSLMDSENPSDTKEHHHQSSVNNISYMKDYPSIKLIINSITTRIEFTTRQLPDLEDLKKQELHMFSVIPNKFLPNSKSPCWYEEFSGQNTTDPYLTNSYVLYSKRFRSTFDALRKAFWGHLAHAHGKHFRLRCLPHFYIIGQPKCGTTDLYDRLRLHPEVKFSAIKEPHWWTRKRFGIVRLRDGLRDRYPVEDYLDLFDLAAHQIHQGLQASSAKEQSKMNTIIIGEASASTMWDNNAWTFFYDNSTDGEPPFLTQDFIHAFQPNARLIVMLRDPVERLYSDYLYFASSNKSADDFHEKVTEALQLFENCMLDYSLRACVYNNTLNNAMPVRLQVGLYAVYLLDWLSVFDKQQFLILRLEDHASNVKYTMHKVFQFLNLGPLSEKQEALMTKSPASNARRPEDRNLGPMWPITQKILRDFYRPFNARLAQVLADEAFAWKTT

SEQ ID NO: 951 - protein, 530 aa, unidentified
MSRSPQRALPPGALPRLLQAAPAAAPRALLPQWPRRPGRRWPASPLGMKVFRRKALVLCAGYALLLVLTMLNLLDYKWHKEPLQQCNPDGPLGAAAGAAGGSWGRPGPPPAGPPRAHARLDLRTPYRPPAAAVGAAPAAAAGMAGVAAPPGNGTRGTGGVGDKRQLVYVFTTWRSGSSFFGELFNQNPEVFFLYEPVWHVWQKLYPGDAVSLQGAARDMLSALYRCDLSVFQLYSPAGSGGRNLTTLGIFGAATNKVVCSSPLCPAYRKEVVGLVDDRVCKKCPPQRLARFEEECRKYRTLVIKGVRVFDVAVLAPLLRDPALDLKVIHLVRDPRAVASSRIRSRHGLIRESLQVVRSRDPRAHRMPFLEAAGHKLGAKKEGVGGPADYHALGAMEVICNSMAKTLQTALQPPDWLQGHYLVVRYEDLVGDPVKTLRRVYDFVGLLVSPEMEQFALNMTSGSGSSSKPFVVSARNATQAANAWRTALTFQQIKQVEEFCYQPMAVLGYERVNSPEEVKDLSKTLLRKPRL

SEQ ID NO: 952 - protein, 479 aa, unidentified
MEKGLTLPQDCRDFVHSLKMRSKYALFLVFVVIVFVFIEKENKIISRVSDKLKQIPQALADANSTDPALILAENASLLSLSELDSAFSQLQSRLRNLSLQLGVEPAMEAAGEEEEEQRKEEEPPRPAVAGPRRHVLLMATTRTGSSFVGEFFNQQGNIFYLFEPLWHIERTVSFEPGGANAAGSALVYRDVLKQLFLCDLYVLEHFITPLPEDHLTQFMFRRGSSRSLCEDPVCTPFVKKVFEKYHCKNRRCGPLNVTLAAEACRRKEHMALKAVRIRQLEFLQPLAEDPRLDLRVIQLVRDPRAVLASRMVAFAGKYKTWKKWLDDEGQDGLREEEVQRLRGNCESIRLSAELGLRQPAWLRGRYMLVRYEDVARGPLQKAREMYRFAGIPLTPQVEDWIQKNTQAAHDGSGIYSTQKNSSEQFEKWRFSMPFKLAQVVQAACGPAMRLFGYKLARDAAALTNRSVSLLEERGTFWVT

SEQ ID NO: 953 - protein, 411 aa, unidentified
MGMRARVPKVAHSTRRPPAARMWLPRFSSKTVTVLLLAQTTCLLLFIISRPGPSSPAGGEDRVHVLVLSSWRSGSSFLGQLFSQHPDVFYLMEPAWHVWTTLSQGSAATLHMAVRDLMRSIFLCDMDVFDAYMPQSRNLSAFFNWATSRALCSPPACSAFPRGTISKQDVCKTLCTRQPFSLAREACRSYSHVVLKEVRFFNLQVLYPLLSDPALNLRIVHLVRDPRAVLRSREAAGPILARDNGIVLGTNGKWVEADPHLRLIREVCRSHVRIAEAATLKPPPFLRGRYRLVRFEDLAREPLAEIRALYAFTGLTLTPQLEAWIHNITHGSGIGKPIEAFHTSSRNARNVSQAWRHALPFTKILRVQEVCAGALQLLGYRPVYSADQQRDLTLDLVLPRGPDHFSWASPD

SEQ ID NO: 954 - protein, 443 aa, unidentified
MQPSEMVMNPKQVFLSVLIFGVAGLLLFMYLQVWIEEQHTGRVEKRREQKVTSGWGPVKYLRPVPRIMSTEKIQEHITNQNPKFHMPEDVREKKENLLLNSERSTRLLTKTSHSQGGDQALSKSTGSPTEKLIEKRQGAKTVFNKFSNMNWPVDIHPLNKSLVKDNKWKKTEETQEKRRSFLQEFCKKYGGVSHHQSHLFHTVSRIYVEDKHKILYCEVPKAGCSNWKRILMVLNGLASSAYNISHNAVHYGKHLKKLDSFDLKGIYTRLNTYTKAVFVRDPMERLVSAFRDKFEHPNSYYHPVFGKAIIKKYRPNACEEALINGSGVKFKEFIHYLLDSHRPVGMDIHWEKVSKLCYPCLINYDFVGKFETLEEDANYFLQMIGAPKELKFPNFKDRHSSDERTNAQVVRQYLKDLTRTERQLIYDFYYLDYLMFNYTTPFL

SEQ ID NO: 955 - protein, 108 aa, unidentified
MSLTSSSSVRVEWIAAVTIAAGTAAIGYLAYKRFYVKDHRNKAMINLHIQKDNPKIVHAFDMEDLGDKAVYCRCWRSKKFPFCDGAHTKHNEETGDNVGPLIIKKKET

SEQ ID NO: 956 - protein, 135 aa, unidentified
MVLESVARIVKVQLPAYLKRLPVPESITGFARLTVSEWLRLLPFLGVLALLGYLAVRPFLPKKKQQKDSLINLKIQKENPKVVNEINIEDLCLTKAAYCRCWRSKTFPACDGSHNKHNELTGDNVGPLILKKKEV

SEQ ID NO: 957 - protein, 602 aa, unidentified
MPSAKQRGSKGGHGAASPSEKGAHPSGGADDVAKKPPPAPQQPPPPPAPHPQQHPQQHPQNQAHGKGGHRGGGGGGGKSSSSSSASAAAAAAAASSSASCSRRLGRALNFLFYLALVAAAAFSGWCVHHVLEEVQQVRRSHQDFSRQREELGQGLQGVEQKVQSLQATFGTFESILRSSQHKQDLTEKAVKQGESEVSRISEVLQKLQNEILKDLSDGIHVVKDARERDFTSLENTVEERLTELTKSINDNIAIFTEVQKRSQKEINDMKAKVASLEESEGNKQDLKALKEAVKEIQTSAKSREWDMEALRSTLQTMESDIYTEVRELVSLKQEQQAFKEAADTERLALQALTEKLLRSEESVSRLPEEIRRLEEELRQLKSDSHGPKEDGGFRHSEAFEALQQKSQGLDSRLQHVEDGVLSMQVASARQTESLESLLSKSQEHEQRLAALQGRLEGLGSSEADQDGLASTVRSLGETQLVLYGDVEELKRSVGELPSTVESLQKVQEQVHTLLSQDQAQAARLPPQDFLDRLSSLDNLKASVSQVEADLKMLRTAVDSLVAYSVKIETNENNLESAKGLLDDLRNDLDRLFVKVEKIHEKV

SEQ ID NO: 958 - protein, 152 aa, unidentified
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGVFALVTAVCCLADGALIYRKLLFNPSGPYQKKPVHEKKEVL

SEQ ID NO: 959 - protein, 115 aa, unidentified
MDNVQPKIKHRPFCFSVKGHVKMLRLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 960 - protein, 943 aa, unidentified
MTQRSIAGPICNLKFVTLLVALSSELPFLGAGVQLQDNGYNGLLIAINPQVPENQNLISNIKEMITEASFYLFNATKRRVFFRNIKILIPATWKANNNSKIKQESYEKANVIVTDWYGAHGDDPYTLQYRGCGKEGKYIHFTPNFLLNDNLTAGYGSRGRVFVHEWAHLRWGVFDEYNNDKPFYINGQNQIKVTRCSSDITGIFVCEKGPCPQENCIISKLFKEGCTFIYNSTQNATASIMFMQSLSSVVEFCNASTHNQEAPNLQNQMCSLRSAWDVITDSADFHHSFPMNGTELPPPPTFSLVQAGDKVVCLVLDVSSKMAEADRLLQLQQAAEFYLMQIVEIHTFVGIASFDSKGEIRAQLHQINSNDDRKLLVSYLPTTVSAKTDISICSGLKKGFEVVEKLNGKAYGSVMILVTSGDDKLLGNCLPTVLSSGSTIHSIALGSSAAPNLEELSRLTGGLKFFVPDISNSNSMIDAFSRISSGTGDIFQQHIQLESTGENVKPHHQLKNTVTVDNTVGNDTMFLVTWQASGPPEIILFDPDGRKYYTNNFITNLTFRTASLWIPGTAKPGHWTYTLNNTHHSLQALKVTVTSRASNSAVPPATVEAFVERDSLHFPHPVMIYANVKQGFYPILNATVTATVEPETGDPVTLRLLDDGAGADVIKNDGIYSRYFFSFAANGRYSLKVHVNHSPSISTPAHSIPGSHAMYVPGYTANGNIQMNAPRKSVGRNEEERKWGFSRVSSGGSFSVLGVPAGPHPDVFPPCKIIDLEAVKVEEELTLSWTAPGEDFDQGQATSYEIRMSKSLQNIQDDFNNAILVNTSKRNPQQAGIREIFTFSPQISTNGPEHQPNGETHESHRIYVAIRAMDRNSLQSAVSNIAQAPLFIPPNSDPVPARDYLILKGVLTAMGLIGIICLIIVVTHHTLSRKKRADKKENGTKLL

SEQ ID NO: 961 - protein, 919 aa, unidentified
MGLFRGFVFLLVLCLLHQSNTSFIKLNNNGFEDIVIVIDPSVPEDEKIIEQIEDMVTTASTYLFEATEKRFFFKNVSILIPENWKENPQYKRPKHENHKHADVIVAPPTLPGRDEPYTKQFTECGEKGEYIHFTPDLLLGKKQNEYGPPGKLFVHEWAHLRWGVFDEYNEDQPFYRAKSKKIEATRCSAGISGRNRVYKCQGGSCLSRACRIDSTTKLYGKDCQFFPDKVQTEKASIMFMQSIDSVVEFCNEKTHNQEAPSLQNIKCNFRSTWEVISNSEDFKNTIPMVTPPPPPVFSLLKISQRIVCLVLDKSGSMGGKDRLNRMNQAAKHFLLQTVENGSWVGMVHFDSTATIVNKLIQIKSSDERNTLMAGLPTYPLGGTSICSGIKYAFQVIGELHSQLDGSEVLLLTDGEDNTASSCIDEVKQSGAIVHFIALGRAADEAVIEMSKITGGSHFYVSDEAQNNGLIDAFGALTSGNTDLSQKSLQLESKGLTLNSNAWMNDTVIIDSTVGKDTFFLITWNSLPPSISLWDPSGTIMENFTVDATSKMAYLSIPGTAKVGTWAYNLQAKANPETLTITVTSRAANSSVPPITVNAKMNKDVNSFPSPMIVYAEILQGYVPVLGANVTAFIESQNGHTEVLELLDNGAGADSFKNDGVYSRYFTAYTENGRYSLKVRAHGGANTARLKLRPPLNRAAYIPGWVVNGEIEANPPRPEIDEDTQTTLEDFSRTASGGAFVVSQVPSLPLPDQYPPSQITDLDATVHEDKIILTWTAPGDNFDVGKVQRYIIRISASILDLRDSFDDALQVNTTDLSPKEANSKESFAFKPENISEENATHIFIAIKSIDKSNLTSKVSNIAQVTLFIPQANPDDIDPTPTPTPTPTPDKSHNSGVNISTLVLSVIGSVVIVNFILSTTI

SEQ ID NO: 962 - protein, 551 aa, unidentified
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLPDENKGDMHYDAEIILKRETLLEIQKFLNGEDWKPGALDDALSDILINFKFHDFETWKWRFEDSFGVDPYNVLMVLLCLLCIVVLVATELWTYVRWYTQLRRVLIISFLFSLGWNWMYLYKLAFAQHQAEVAKMEPLNNVCAKKMDWTGSIWEWFRSSWTYKDDPCQKYYELLLVNPIWLVPPTKALAVTFTTFVTEPLKHIGKGTGEFIKALMKEIPALLHLPVLIIMALAILSFCYGAGKSVHVLRHIGGPESEPPQALRPRDRRRQEEIDYRPDGGAGDADFHYRGQMGPTEQGPYAKTYEGRREILRERDVDLRFQTGNKSPEVLRAFDVPDAEAREHPTVVPSHKSPVLDTKPKETGGILGEGTPKESSTESSQSAKPVSGQDTSGNTEGSPAAEKAQLKSEAAGSPDQGSTYSPARGVAGPRGQDPVSSPCG

SEQ ID NO: 963 - protein, 988 aa, unidentified
MEQSRSQQRGGEQSWWGSDPQYQYMPFEHCTSYGLPSENGGLQHRLRKDAGPRHNVHPTQIYGHHKEQFSDREQDIGMPKKTGSSSTVDSKDEDHYSKCQDCIHRLGQVVRRKLGEDGIFLVLLGLLMALVSWSMDYVSAKSLQAYKWSYAQMQPSLPLQFLVWVTFPLVLILFSALFCHLISPQAVGSGIPEMKTILRGVVLKEYLTMKAFVAKVVALTAGLGSGIPVGKEGPFVHIASICAAVLSKFMSVFCGVYEQPYYYSDILTVGCAVGVGCCFGTPLGGVLFSIEVTSTYFAVRNYWRGFFAATFSAFVFRVLAVWNKDAVTITALFRTNFRMDFPFDLKELPAFAAIGICCGLLGAVFVYLHRQVMLGVRKHKALSQFLAKHRLLYPGIVTFVIASFTFPPGMGQFMAGELMPREAISTLFDNNTWVKHAGDPESLGQSAVWIHPRVNVVIIIFLFFVMKFWMSIVATTMPIPCGGFMPVFVLGAAFGRLVGEIMAMLFPDGILFDDIIYKILPGGYAVIGAAALTGAVSHTVSTAVICFELTGQIAHILPMMVAVILANMVAQSLQPSLYDSIIQVKKLPYLPDLGWNQLSKYTIFVEDIMVRDVKFVSASYTYGELRTLLQTTTVKTLPLVDSKDSMILLGSVERSELQALLQRHLCPERRLRAAQEMARKLSELPYDGKARLAGEGLPGAPPGRPESFAFVDEDEDEDLSGKSELPPSLALHPSTTAPLSPEEPNGPLPGHKQQPEAPEPAGQRPSIFQSLLHCLLGRARPTKKKTTQDSTDLVDNMSPEEIEAWEQEQLSQPVCFDSCCIDQSPFQLVEQTTLHKTHTLFSLLGLHLAYVTSMGKLRGVLALEELQKAIEGHTKSGVQLRPPLASFRNTTSTRKSTGAPPSSAENWNLPEDRPGATGTGDVIAASPETPVPSPSPEPPLSLAPGKVEGELEELELVESPGLEEELADILQGPSLRSTDEEDEDELIL

SEQ ID NO: 964 - protein, 898 aa, unidentified
MAAAAAEEGMEPRALQYEQTLMYGRYTQDLGAFAKEEAARIRLGGPEPWKGPPSSRAAPELLEYGRSRCARCRVCSVRCHKFLVSRVGEDWIFLVLLGLLMALVSWVMDYAIAACLQAQQWMSRGLNTSILLQYLAWVTYPVVLITFSAGFTQILAPQAVGSGIPEMKTILRGVVLKEYLTLKTFIAKVIGLTCALGSGMPLGKEGPFVHIASMCAALLSKFLSLFGGIYENESRNTEMLAAACAVGVGCCFAAPIGGVLFSIEVTSTFFAVRNYWRGFFAATFSAFIFRVLAVWNRDEETITALFKTRFRLDFPFDLQELPAFAVIGIASGFGGALFVYLNRKIVQVMRKQKTINRFLMRKRLLFPALVTLLISTLTFPPGFGQFMAGQLSQKETLVTLFDNRTWVRQGLVEELEPPSTSQAWNPPRANVFLTLVIFILMKFWMSALATTIPVPCGAFMPVFVIGAAFGRLVGESMAAWFPDGIHTDSSTYRIVPGGYAVVGAAALAGAVTHTVSTAVIVFELTGQIAHILPVMIAVILANAVAQSLQPSLYDSIIRIKKLPYLPELGWGRHQQYRVRVEDIMVRDVPHVALSCTFRDLRLALHRTKGRMLALVESPESMILLGSIERSQVVALLGAQLSPARRRQHMQERRATQTSPLSDQEGPPTPEASVCFQVNTEDSAFPAARGETHKPLKPALKRGPSVTRNLGESPTGSAESAGIALRSLFCGSPPPEAASEKLESCEKRKLKRVRISLASDADLEGEMSPEEILEWEEQQLDEPVNFSDCKIDPAPFQLVERTSLHKTHTIFSLLGVDHAYVTSIGRLIGIVTLKELRKAIEGSVTAQGVKVRPPLASFRDSATSSSDTETTEVHALWGPHSRHGLPREGSPSDSDDKCQ

SEQ ID NO: 965 - protein, 818 aa, unidentified
MESEQLFHRGYYRNSYNSITSASSDEELLDGAGVIMDFQTSEDDNLLDGDTAVGTHYTMTNGGSINSSTHLLDLLDEPIPGVGTYDDFHTIDWVREKCKDRERHRRINSKKKESAWEMTKSLYDAWSGWLVVTLTGLASGALAGLIDIAADWMTDLKEGICLSALWYNHEQCCWGSNETTFEERDKCPQWKTWAELIIGQAEGPGSYIMNYIMYIFWALSFAFLAVSLVKVFAPYACGSGIPEIKTILSGFIIRGYLGKWTLMIKTITLVLAVASGLSLGKEGPLVHVACCCGNIFSYLFPKYSTNEAKKREVLSAASAAGVSVAFGAPIGGVLFSLEEVSYYFPLKTLWRSFFAALVAAFVLRSINPFGNSRLVLFYVEYHTPWYLFELFPFILLGVFGGLWGAFFIRANIAWCRRRKSTKFGKYPVLEVIIVAAITAVIAFPNPYTRLNTSELIKELFTDCGPLESSSLCDYRNDMNASKIVDDIPDRPAGIGVYSAIWQLCLALIFKIIMTVFTFGIKVPSGLFIPSMAIGAIAGRIVGIAVEQLAYYHHDWFIFKEWCEVGADCITPGLYAMVGAAACLGGVTRMTVSLVVIVFELTGGLEYIVPLMAAVMTSKWVGDAFGREGIYEAHIRLNGYPFLDAKEEFTHTTLAADVMRPRRNDPPLAVLTQDNMTVDDIENMINETSYNGFPVIMSKESQRLVGFALRRDLTIAIESARKKQEGIVGSSRVCFAQHTPSLPAESPRPLKLRSILDMSPFTVTDHTPMEIVVDIFRKLGLRQCLVTHNGRLLGIITKKDILRHMAQTANQDPASIMFN

SEQ ID NO: 966 - protein, 760 aa, unidentified
MVNAGAMSGSGNLMDFLDEPFPDVGTYEDFHTIDWLREKSRDTDRHRKITSKSKESIWEFIKSLLDAWSGWVVMLLIGLLAGTLAGVIDLAVDWMTDLKEGVCLSAFWYSHEQCCWTSNETTFEDRDKCPLWQKWSELLVNQSEGASAYILNYLMYILWALLFAFLAVSLVRVFAPYACGSGIPEIKTILSGFIIRGYLGKWTLLIKTVTLVLVVSSGLSLGKEGPLVHVACCCGNFFSSLFSKYSKNEGKRREVLSAAAAAGVSVAFGAPIGGVLFSLEEVSYYFPLKTLWRSFFAALVAAFTLRSINPFGNSRLVLFYVEYHTPWYMAELFPFILLGVFGGLWGTLFIRCNIAWCRRRKTTRLGKYPVLEVIVVTAITAIIAYPNPYTRQSTSELISELFNDCGALESSQLCDYINDPNMTRPVDDIPDRPAGVGVYTAMWQLALALIFKIVVTIFTFGMKIPSGLFIPSMAVGAIAGRMVGIGVEQLAYHHHDWIIFRNWCRPGADCVTPGLYAMVGAAACLGGVTRMTVSLVVIMFELTGGLEYIVPLMAAAVTSKWVADAFGKEGIYEAHIHLNGYPFLDVKDEFTHRTLATDVMRPRRGEPPLSVLTQDSMTVEDVETLIKETDYNGFPVVVSRDSERLIGFAQRRELILAIKNARQRQEGIVSNSIMYFTEEPPELPANSPHPLKLRRILNLSPFTVTDHTPMETVVDIFRKLGLRQCLVTRSGRLLGIITKKDVLRHMAQMANQDPESIMFN

SEQ ID NO: 967 - protein, 746 aa, unidentified
MDFLEEPIPGVGTYDDFNTIDWVREKSRDRDRHREITNKSKESTWALIHSVSDAFSGWLLMLLIGLLSGSLAGLIDISAHWMTDLKEGICTGGFWFNHEHCCWNSEHVTFEERDKCPEWNSWSQLIISTDEGAFAYIVNYFMYVLWALLFAFLAVSLVKVFAPYACGSGIPEIKTILSGFIIRGYLGKWTLVIKTITLVLAVSSGLSLGKEGPLVHVACCCGNILCHCFNKYRKNEAKRREVLSAAAAAGVSVAFGAPIGGVLFSLEEVSYYFPLKTLWRSFFAALVAAFTLRSINPFGNSRLVLFYVEFHTPWHLFELVPFILLGIFGGLWGALFIRTNIAWCRKRKTTQLGKYPVIEVLVVTAITAILAFPNEYTRMSTSELISELFNDCGLLDSSKLCDYENRFNTSKGGELPDRPAGVGVYSAMWQLALTLILKIVITIFTFGMKIPSGLFIPSMAVGAIAGRLLGVGMEQLAYYHQEWTVFNSWCSQGADCITPGLYAMVGAAACLGGVTRMTVSLVVIMFELTGGLEYIVPLMAAAMTSKWVADALGREGIYDAHIRLNGYPFLEAKEEFAHKTLAMDVMKPRRNDPLLTVLTQDSMTVEDVETIISETTYSGFPVVVSRESQRLVGFVLRRDLIISIENARKKQDGVVSTSIIYFTEHSPPLPPYTPPTLKLRNILDLSPFTVTDLTPMEIVVDIFRKLGLRQCLVTHNGRLLGIITKKDVLKHIAQMANQDPDSILFN

SEQ ID NO: 968 - protein, 869 aa, unidentified
MAGCRGSLCCCCRWCCCCGERETRTPEELTILGETQEEEDEILPRKDYESLDYDRCINDPYLEVLETMDNKKGRRYEAVKWMVVFAIGVCTGLVGLFVDFFVRLFTQLKFGVVQTSVEECSQKGCLALSLLELLGFNLTFVFLASLLVLIEPVAAGSGIPEVKCYLNGVKVPGIVRLRTLLCKVLGVLFSVAGGLFVEKEGPMIHSGSVVGAGLPQFQSISLRKIQFNFPYFRSDRDKRDFVSAGAAAGVAAAFGAPIGGTLFSLEEGSSFWNQGLTWKVLFCSMSATFTLNFFRSGIQFGSWGSFQLPGLLNFGEFKCSDSDKKCHLWTAMDLGFFVVMGVIGGLLGATFNCLNKRLAKYRMRNVHPKPKLVRVLESLLVSLVTTVVVFVASMVLGECRQMSSSSQIGNDSFQLQVTEDVNSSIKTFFCPNDTYNDMATLFFNPQESAILQLFHQDGTFSPVTLALFFVLYFLLACWTYGISVPSGLFVPSLLCGAAFGRLVANVLKSYIGLGHIYSGTFALIGAAAFLGGVVRMTISLTVILIESTNEITYGLPIMVTLMVAKWTGDFFNKGIYDIHVGLRGVPLLEWETEVEMDKLRASDIMEPNLTYVYPHTRIQSLVSILRTTVHHAFPVVTENRGNEKEFMKGNQLISNNIKFKKSSILTRAGEQRKRSQSMKSYPSSELRNMCDEHIASEEPAEKEDLLQQMLERRYTPYPNLYPDQSPSEDWTMEERFRPLTFHGLILRSQLVTLLVRGVCYSESQSSASQPRLSYAEMAEDYPRYPDIHDLDLTLLNPRMIVDVTPYMNPSPFTVSPNTHVSQVFNLFRTMGLRHLPVVNAVGEIVGIITRHNLTYEFLQARLRQHYQTI

SEQ ID NO: 969 - protein, 805 aa, unidentified
MANVSKKVSWSGRDRDDEEAAPLLRRTARPGGGTPLLNGAGPGAARQSPRSALFRVGHMSSVELDDELLDPDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYFRRDTEKRDFVSAGAAAGVSAAFGAPVGGVLFSLEEGASFWNQFLTWRIFFASMISTFTLNFVLSIYHGNMWDLSSPGLINFGRFDSEKMAYTIHEIPVFIAMGVVGGVLGAVFNALNYWLTMFRIRYIHRPCLQVIEAVLVAAVTATVAFVLIYSSRDCQPLQGGSMSYPLQLFCADGEYNSMAAAFFNTPEKSVVSLFHDPPGSYNPLTLGLFTLVYFFLACWTYGLTVSAGVFIPSLLIGAAWGRLFGISLSYLTGAAIWADPGKYALMGAAAQLGGIVRMTLSLTVIMMEATSNVTYGFPIMLVLMTAKIVGDVFIEGLYDMHIQLQSVPFLHWEAPVTSHSLTAREVMSTPVTCLRRREKVGVIVDVLSDTASNHNGFPVVEHADDTQPARLQGLILRSQLIVLLKHKVFVERSNLGLVQRRLRLKDFRDAYPRFPPIQSIHVSQDERECTMDLSEFMNPSPYTVPQEASLPRVFKLFRALGLRHLVVVDNRNQVVGLVTRKDLARYRLGKRGLEELSLAQT

SEQ ID NO: 970 - protein, 687 aa, unidentified
MEELVGLREGFSGDPVTLQELWGPCPHIRRAIQGGLEWLKQKVFRLGEDWYFLMTLGVLMALVSYAMNFAIGCVVRAHQWLYREIGDSHLLRYLSWTVYPVALVSFSSGFSQSITPSSGGSGIPELKTMLAGVILEDYLDIKNFGAKVVGLSCTLATGSTLFLGKVGPFVHLSVMIAAYLGRVRTTTIGEPENKSKQNEMLVAAAAVGVATVFAAPFSGVLFSIEVMSSHFSVRDYWRGFFAATCGAFIFRLLAVFNSEQETITSLYKTSFRVDVPFDLPEIFFFVALGGICGVLSCAYLFCQRTFLSFIKTNRYSSKLLATSKPVYSALATLLLASITYPPGVGHFLASRLSMKQHLDSLFDNHSWALMTQNSSPPWPEELDPQHLWWEWYHPRFTIFGTLAFFLVMKFWMLILATTIPMPAGYFMPIFILGAAIGRLLGEALAVAFPEGIVTGGVTNPIMPGGYALAGAAAFSGAVTHTISTALLAFELTGQIVHALPVLMAVLAANAIAQSCQPSFYDGTIIVKKLPYLPRILGRNIGSHHVRVEHFMNHSITTLAKDTPLEEVVKVVTSTDVTEYPLVESTESQILVGIVQRAQLVQALQAEPPSRAPGHQQCLQDILARGCPTEPVTLTLFSETTLHQAQNLFKLLNLQSLFVTSRGRAVGCVSWVEMKKAISNLTNPPAPK

SEQ ID NO: 971 - protein, 687 aa, unidentified
MEEFVGLREGSSGNPVTLQELWGPCPRIRRGIRGGLEWLKQKLFRLGEDWYFLMTLGVLMALVSCAMDLAVESVVRAHQWLYREIGDSHLLRYLSWTVYPVALVSFSSGFSQSITPSSGGSGIPEVKTMLAGVVLEDYLDIKNFGAKVVGLSCTLACGSTLFLGKVGPFVHLSVMMAAYLGRVRTTTIGEPENKSKQNEMLVAAAAVGVATVFAAPFSGVLFSIEVMSSHFSVWDYWRGFFAATCGAFMFRLLAVFNSEQETITSLYKTSFRVDVPFDLPEIFFFVALGGLCGILGSAYLFCQRIFFGFIRNNRFSSKLLATSKPVYSALATLVLASITYPPSAGRFLASRLSMKQHLDSLFDNHSWALMTQNSSPPWPEELDPQHLWWEWYHPRFTIFGTLAFFLVMKFWMLILATTIPMPAGYFMPIFVYGAAIGRLFGETLSFIFPEGIVAGGITNPIMPGGYALAGAAAFSGAVTHTISTALLAFEVTGQIVHALPVLMAVLAANAIAQSCQPSFYDGTVIVKKLPYLPRILGRNIGSHRVRVEHFMNHSITTLAKDMPLEEVVKVVTSTDVAKYPLVESTESQILVGIVRRAQLVQALKAEPPSWAPGHQQCLQDILAAGCPTEPVTLKLSPETSLHEAHNLFELLNLHSLFVTSRGRAVGCVSWVEMKKAISNLTNPPAPK

SEQ ID NO: 972 - protein, 211 aa, unidentified
MANAGLQLLGFILAFLGWIGAIVSTALPQWRIYSYAGDNIVTAQAMYEGLWMSCVSQSTGQIQCKVFDSLLNLSSTLQATRALMVVGILLGVIAIFVATVGMKCMKCLEDDEVQKMRMAVIGGAIFLLAGLAILVATAWYGNRIVQEFYDPMTPVNARYEFGQALFTGWAAASLCLLGGALLCCSCPRKTTSYPTPRPYPKPAPSSGKDYV

SEQ ID NO: 973 - protein, 228 aa, unidentified
MASTASEIIAFMVSISGWVLVSSTLPTDYWKVSTIDGTVITTATYWANLWKACVTDSTGVSNCKDFPSMLALDGYIQACRGLMIAAVSLGFFGSIFALFGMKCTKVGGSDKAKAKIACLAGIVFILSGLCSMTGCSLYANKITTEFFDPLFVEQKYELGAALFIGWAGASLCIIGGVIFCFSISDNNKTPRYTYNGATSVMSSRTKYHGGEDFKTTNPSKQFDKNAYV

SEQ ID NO: 974 - protein, 207 aa, unidentified
MVATCLQVVGFVTSFVGWIGVIVTTSTNDWVVTCGYTIPTCRKLDELGSKGLWADCVMATGLYHCKPLVDILILPGYVQACRALMIAASVLGLPAILLLLTVLPCIRMGQEPGVAKYRRAQLAGVLLILLALCALVATIWFPVCAHRETTIVSFGYSLYAGWIGAVLCLVGGCVILCCAGDAQAFGENRFYYTAGSSSPTHAKSAHV

SEQ ID NO: 975 - protein, 244 aa, unidentified
MGCRDVHAATVLSFLCGIASVAGLFAGTLLPNWRKLRLITFNRNEKNLTVYTGLWVKCARYDGSSDCLMYDTTWYSSVDQLDLRVLQFALPLSMLIAMGALLLCLIGMCNTAFRSSVPNIKLAKCLVNSAGCHLVAGLLFFLAGTVSLSPSIWVIFYNIHLNKKFEPVFSFDYAVYVTIASAGGLFMTSLILFIWYCTCKSLPSPFWQPLYSHPPSMHTYSQPYSARSRLSAIEIDIPVVSHTT

SEQ ID NO: 976 - protein, 239 aa, unidentified
MASTAVQLLGFLLSFLGMVGTLITTILPHWRRTAHVGTNILTAVSYLKGLWMECVWHSTGIYQCQIYRSLLALPQDLQAARALMVISCLLSGIACACAVIGMKCTRCAKGTPAKTTFAILGGTLFILAGLLCMVAVSWTTNDVVQNFYNPLLPSGMKFEIGQALYLGFISSSLSLIGGTLLCLSCQDEAPYRPYQAPPRATTTTANTAPAYQPPAAYKDNRAPSVTSATHSGYRLNDYV

SEQ ID NO: 977 - protein, 228 aa, unidentified
MSMAVETFGFFMATVGLLMLGVTLPNSYWRVSTVHGNVITTNTIFENLWFSCATDSLGVYNCWEFPSMLALSGYIQACRALMITAILLGFLGLLLGIAGLRCTNIGGLELSRKAKLAATAGALHILAGICGMVAISWYAFNITRDFFDPLYPGTKYELGPALYLGWSASLISILGGLCLCSACCCGSDEDPAASARRPYQAPVSVMPVATSDQEGDSSFGKYGRNAYV

SEQ ID NO: 978 - protein, 305 aa, unidentified
MTSRTPLLVTACLYYSYCNSRHLQQGVRKSKRPVFSHCQVPETQKTDTRHLSGARAGVCPCCHPDGLLATMRDLLQYIACFFAFFSAGFLIVATWTDCWMVNADDSLEVSTKCRGLWWECVTNAFDGIRTCDEYDSILAEHPLKLVVTRALMITADILAGFGFLTLLLGLDCVKFLPDEPYIKVRICFVAGATLLIAGTPGIIGSVWYAVDVYVERSTLVLHNIFLGIQYKFGWSCWLGMAGSLGCFLAGAVLTCCLYLFKDVGPERNYPYSLRKAYSAAGVSMAKSYSAPRTETAKMYAVDTRV

SEQ ID NO: 979 - protein, 224 aa, unidentified
MAFYPLQIAGLVLGFLGMVGTLATTLLPQWRVSAFVGSNIIVFERLWEGLWMNCIRQARVRLQCKFYSSLLALPPALETARALMCVAVALSLIALLIGICGMKQVQCTGSNERAKAYLLGTSGVLFILTGIFVLIPVSWTANIIIRDFYNPAIHIGQKRELGAALFLGWASAAVLFIGGGLLCGFCCCNRKKQGYRYPVPGYRVPHTDKRRNTTMLSKTSTSYV

SEQ ID NO: 980 - protein, 261 aa, unidentified
MSTTTCQVVAFLLSILGLAGCIAATGMDMWSTQDLYDNPVTSVFQYEGLWRSCVRQSSGFTECRPYFTILGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYPSKHDYV

SEQ ID NO: 981 - protein, 224 aa, unidentified
MANSGLQLLGYFLALGGWVGIIASTALPQWKQSSYAGDAIITAVGLYEGLWMSCASQSTGQVQCKLYDSLLALDGHIQSARALMVVAVLLGFVAMVLSVVGMKCTRVGDSNPIAKGRVAIAGGALFILAGLCTLTAVSWYATLVTQEFFNPSTPVNARYEFGPALFVGWASAGLAVLGGSFLCCTCPEPERPNSSPQPYRPGPSAAAREPVVKLPASAKGPLGV

SEQ ID NO: 982 - protein, 230 aa, unidentified
MASLGLQLVGYILGLLGLLGTLVAMLLPSWKTSSYVGASIVTAVGFSKGLWMECATHSTGITQCDIYSTLLGLPADIQAAQAMMVTSSAISSLACIISVVGMRCTVFCQESRAKDRVAVAGGVFFILGGLLGFIPVAWNLHGILRDFYSPLVPDSMKFEIGEALYLGIISSLFSLIAGIILCFSCSSQRNRSNYYDAYQAQPLATRSSPRPGQPPKVKSEFNSYSLTGYV

SEQ ID NO: 983 - protein, 219 aa, unidentified
MASAGLQLLAFILALSGVSGVLTATLLPNWKVNVDVDSNIITAIVQLHGLWMDCTWYSTGMFSCALKHSILSLPIHVQAARATMVLACVLSALGICTSTVGMKCTRLGGDRETKSHASFAGGVCFMSAGISSLISTVWYTKEIIANFLDLTVPESNKHEPGGAIYIGFISAMLLFISGMIFCTSCIKRNPEARLDPPTQQPISNTQLENNSTHNLKDYV

SEQ ID NO: 984 - protein, 220 aa, unidentified
MALVFRTVAQLAGVSLSLLGWVLSCLTNYLPHWKNLNLDLNEMENWTMGLWQTCVIQEEVGMQCKDFDSFLALPAELRVSRILMFLSNGLGFLGLLVSGFGLDCLRIGESQRDLKRRLLILGGILSWASGVTALVPVSWVAHKTVQEFWDENVPDFVPRWEFGEALFLGWFAGLSLLLGGCLLHCAACSSHAPLASGHYAVAQTQDHHQELETRNTNLKH

SEQ ID NO: 985 - protein, 292 aa, unidentified
MRTPVVMTLGMVLAPCGLLLNLTGTLAPGWRLVKGFLNQPVDVELYQGLWDMCREQSSRERECGQTDQWGYFEAQPVLVARALMVTSLAATVLGLLLASLGVRCWQDEPNFVLAGLSGVVLFVAGLLGLIPVSWYNHFLGDRDVLPAPASPVTVQVSYSLVLGYLGSCLLLLGGFSLALSFAPWCDERCRRRRKGPSAGPRRSSVSTIQVEWPEPDLAPAIKYYSDGQHRPPPAQHRKPKPKPKVGFPMPRPRPKAYTNSVDVLDGEGWESQDAPSCSTHPCDSSLPCDSDL

SEQ ID NO: 986 - protein, 220 aa, unidentified
MALIFRTAMQSVGLLLSLLGWILSIITTYLPHWKNLNLDLNEMENWTMGLWQTCVIQEEVGMQCKDFDSFLALPAELRVSRILMFLSNGLGFLGLLVSGFGLDCLRIGESQRDLKRRLLILGGILSWASGITALVPVSWVAHKTVQEFWDENVPDFVPRWEFGEALFLGWFAGLSLLLGGCLLNCAACSSHAPLALGHYAVAQMQTQCPYLEDGTADPQV

SEQ ID NO: 987 - protein, 229 aa, unidentified
MAWSFRAKVQLGGLLLSLLGWVCSCVTTILPQWKTLNLELNEMETWIMGIWEVCVDREEVATVCKAFESFLSLPQELQVARILMVASHGLGLLGLLLCSFGSECFQFHRIRWVFKRRLGLLGRTLEASASATTLLPVSWVAHATIQDFWDDSIPDIIPRWEFGGALYLGWAAGIFLALGGLLLIFSACLGKEDVPFPLMAGPTVPLSCAPVEESDGSFHLMLRPRNLVI

SEQ ID NO: 988 - protein, 220 aa, unidentified
MSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 989 - protein, 209 aa, unidentified
MASMGLQVMGIALAVLGWLAVMLCCALPMWRVTAFIGSNIVTSQTIWEGLWMNCVVQSTGQMQCKVYDSLLALPQDLQAARALVIISIIVAALGVLLSVVGGKCTNCLEDESAKAKTMIVAGVVFLLAGLMVIVPVSWTAHNIIQDFYNPLVASGQKREMGASLYVGWAASGLLLLGGGLLCCNCPPRTDKPYSAKYSAARSAAASNYV

SEQ ID NO: 990 - protein, 218 aa, unidentified
MGSAALEILGLVLCLVGWGGLILACGLPMWQVTAFLDHNIVTAQTTWKGLWMSCVVQSTGHMQCKVYDSVLALSTEVQAARALTVSAVLLAFVALFVTLAGAQCTTCVAPGPAKARVALTGGVLYLFCGLLALVPLCWFANIVVREFYDPSVPVSQKYELGAALYIGWAATALLMVGGCLLCCGAWVCTGRPDLSFPVKYSAPRRPTATGDYDKKNYV

SEQ ID NO: 991 - protein, 220 aa, unidentified
MASAGMQILGVVLTLLGWVNGLVSCALPMWKVTAFIGNSIVVAQVVWEGLWMSCVVQSTGQMQCKVYDSLLALPQDLQAARALCVIALLVALFGLLVYLAGAKCTTCVEEKDSKARLVLTSGIVFVISGVLTLIPVCWTAHAIIRDFYNPLVAEAQKRELGASLYLGWAASGLLLLGGGLLCCTCPSGGSQGPSHYMARYSTSAPAISRGPSEYPTKNYV

SEQ ID NO: 992 - protein, 211 aa, unidentified
MANSGLQLLGFSMALLGWVGLVACTAIPQWQMSSYAGDNIITAQAMYKGLWMDCVTQSTGMMSCKMYDSVLALSAALQATRALMVVSLVLGFLAMFVATMGMKCTRCGGDDKVKKARIAMGGGIIFIVAGLAALVACSWYGHQIVTDFYNPLIPTNIKYEFGPAIFIGWAGSALVILGGALLSCSCPGNESKAGYRVPRSYPKSNSSKEYV

SEQ ID NO: 993 - protein, 225 aa, unidentified
MATHALEIAGLFLGGVGMVGTVAVTVMPQWRVSAFIENNIVVFENFWEGLWMNCVRQANIRMQCKIYDSLLALSPDLQAARGLMCAASVMSFLAFMMAILGMKCTRCTGDNEKVKAHILLTAGIIFIITGMVVLIPVSWVANAIIRDFYNSIVNVAQKRELGEALYLGWTTALVLIVGGALFCCVFCCNEKSSSYRYSIPSHRTTQKSYHTGKKSPSVYSRSQYV

SEQ ID NO: 994 - protein, 217 aa, unidentified
MASTGLELLGMTLAVLGWLGTLVSCALPLWKVTAFIGNSIVVAQVVWEGLWMSCVVQSTGQMQCKVYDSLLALPQDLQAARALCVIALLLALLGLLVAITGAQCTTCVEDEGAKARIVLTAGVILLLAGILVLIPVCWTAHAIIQDFYNPLVAEALKRELGASLYLGWAAAALLMLGGGLLCCTCPPPQVERPRGPRLGYSIPSRSGASGLDKRDYV

SEQ ID NO: 995 - protein, 253 aa, unidentified
MDNRFATAFVIACVLSLISTIYMAASIGTDFWYEYRSPVQENSSDLNKSIWDEFISDEADEKTYNDALFRYNGTVGLWRRCITIPKNMHWYSPPERTESFDVVTKCVSFTLTEQFMEKFVDPGNHNSGIDLLRTYLWRCQFLLPFVSLGLMCFGALIGLCACICRSLYPTIATGILHLLAGLCTLGSVSCYVAGIELLHQKLELPDNVSGEFGWSFCLACVSAPLQFMASALFIWAAHTNRKEYTLMKAYRVA

SEQ ID NO: 996 - protein, 167 aa, unidentified
MGVKRSLQSGGILLSLVANVLMVLSTATNYWTRQQEGHSGLWQECNHGICSSIPCQTTLAVTVACMVLAVGVGVVGMVMGLRIRCDEGESLRGQTTSAFLFLGGLLLLTALIGYTVKNAWKNNVFFSWSYFSGWLALPFSILAGFCFLLADMIMQSTDAISGFPVCL

SEQ ID NO: 997 - protein, 316 aa, unidentified
MTRTYENFQYLENKVKVQGFKNGPLPLQSLLQRLCSGPCHLLLSLGLGLLLLVIICVVGFQNSKFQRDLVTLRTDFSNFTSNTVAEIQALTSQGSSLEETIASLKAEVEGFKQERQAGVSELQEHTTQKAHLGHCPHCPSVCVPVHSEMLLRVQQLVQDLKKLTCQVATLNNNASTEGTCCPVNWVEHQDSCYWFSHSGMSWAEAEKYCQLKNAHLVVINSREEQNFVQKYLGSAYTWMGLSDPEGAWKWVDGTDYATGFQNWKPGQPDDWQGHGLGGGEDCAHFHPDGRWNDDVCQRPYHWVCEAGLGQTSQESH

SEQ ID NO: 998 - protein, 265 aa, unidentified
MSEEVTYADLQFQNSSEMEKIPEIGKFGEKAPPAPSHVWRPAALFLTLLCLLLLIGLGVLASMFHVTLKIEMKKMNKLQNISEELQRNISLQLMSNMNISNKIRNLSTTLQTIATKLCRELYSKEQEHKCKPCPRRWIWHKDSCYFLSDDVQTWQESKMACAAQNASLLKINNKNALEFIKSQSRSYDYWLGLSPEEDSTRGMRVDNIINSSAWVIRNAPDLNNMYCGYINRLYVQYYHCTYKKRMICEKMANPVQLGSTYFREA

SEQ ID NO: 999 - protein, 276 aa, unidentified
MSEEVTYATLTFQDSAGARNNRDGNNLRKRGHPAPSPIWRHAALGLVTLCLMLLIGLVTLGMMFLQISNDINSDSEKLSQLQKTIQQQQDNLSQQLGNSNNLSMEEEFLKSQISSVLKRQEQMAIKLCQELIIHTSDHRCNPCPKMWQWYQNSCYYFTTNEEKTWANSRKDCIDKNSTLVKIDSLEEKDFLMSQPLLMFSFFWLGLSWDSSGRSWFWEDGSVPSPSLFSTKELDQINGSKGCAYFQKGNIYISRCSAEIFWICEKTAAPVKTEDLD

SEQ ID NO: 1000 - protein, 490 aa, unidentified
MRPAFALCLLWQALWPGPGGGEHPTADRAGCSASGACYSLHHATMKRQAAEEACILRGGALSTVRAGAELRAVLALLRAGPGPGGGSKDLLFWVALERRRSHCTLENEPLRGFSWLSSDPGGLESDTLQWVEEPQRSCTARRCAVLQATGGVEPAGWKEMRCHLRANGYLCKYQFEVLCPAPRPGAASNLSYRAPFQLHSAALDFSPPGTEVSALCRGQLPISVTCIADEIGARWDKLSGDVLCPCPGRYLRAGKCAELPNCLDDLGGFACECATGFELGKDGRSCVTSGEGQPTLGGTGVPTRRPPATATSPVPQRTWPIRVDEKLGETPLVPEQDNSVTSIPEIPRWGSQSTMSTLQMSLQAESKATITPSGSVISKFNSTTSSATPQAFDSSSAVVFIFVSTAVVVLVILTMTVLGLVKLCFHESPSSQPRKESMGPPGLESDPEPAALGSSSAHCTNNGVKVGDCDLRDRAEGALLAESPLGSSDA

SEQ ID NO: 1001 - protein, 378 aa, unidentified
MHNLYSITGYPDPPGTMEEEEEDDDYENSTPPYKDLPPKPGTMEEEEEDDDYENSTPPYKDLPPKPGTMEEEEEDDDYENSTPPYKDLPPKPGSSAPPRPPRAAKETEKPPLPCKPRNMTGLDLAAVTCPPPQLAVNLEPSPLQPSLAATPVPWLNQRSGGPGCCQKRWMVYLCLLVVTSLFLGCLGLTVTLIKYQELMEELRMLSFQQMTWRTNMTGMAGLAGLKHDIARVRADTNQSLVELWGLLDCRRITCPEGWLPFEGKCYYFSPSTKSWDEARMFCQENYSHLVIINSFAEHNFVAKAHGSPRVYWLGLNDRAQEGDWRWLDGSPVTLSFWEPEEPNNIHDEDCATMNKGGTWNDLSCYKTTYWICERKCSC

SEQ ID NO: 1002 - protein, 280 aa, unidentified
MQAKYSSTRDMLDDDGDTTMSLHSQGSATTRHPEPRRTEHRAPSSTWRPVALTLLTLCLVLLIGLAALGLLFFQYYQLSNTGQDTISQMEERLGNTSQELQSLQVQNIKLAGSLQHVAEKLCRELYNKAGAHRCSPCTEQWKWHGDNCYQFYKDSKSWEDCKYFCLSENSTMLKINKQEDLEFAASQSYSEFFYSYWTGLLRPDSGKAWLWMDGTPFTSELFHIIIDVTSPRSRDCVAILNGMIFSKDCKELKRCVCERRAGMVKPESLHVPPETLGEGD

SEQ ID NO: 1003 - protein, 229 aa, unidentified
MQDEDGYITLNIKTRKPALISVGSASSSWWRVMALILLILCVGMVVGLVALGIWSVMQRNYLQGENENRTGTLQQLAKRFCQYVVKQSELKGTFKGHKCSPCDTNWRYYGDSCYGFFRHNLTWEESKQYCTDMNATLLKIDNRNIVEYIKARTHLIRWVGLSRQKSNEVWKWEDGSVISENMFEFLEDGKGNMNCAYFHNGKMHPTFCENKHYLMCERKAGMTKVDQLP

SEQ ID NO: 1004 - protein, 174 aa, unidentified
MINPELRDGRADGFIHRIVPKLIQNWKIGLMCFLSIIITTVCIIMIATWSKHAKPVACSGDWLGVRDKCFYFSDDTRNWTASKIFCSLQKAELAQIDTQEDMEFLKRYAGTDMHWIGLSRKQGDSWKWTNGTTFNGWFEIIGNGSFAFLSADGVHSSRGFIDIKWICSKPKYFL

SEQ ID NO: 1005 - protein, 191 aa, unidentified
MHDSNNVEKDITPSELPANPGCLHSKEHSIKATLIWRLFFLIMFLTIIVCGMVAALSAIRANCHQEPSVCLQAACPESWIGFQRKCFYFSDDTKNWTSSQRFCDSQDADLAQVESFQELNFLLRYKGPSDHWIGLSREQGQPWKWINGTEWTRQFPILGAGECAYLNDKGASSARHYTERKWICSKSDIHV

SEQ ID NO: 1006 - protein, 214 aa, unidentified
MEPAREPPSRARPPPPLAARPAPAPAAPRPRSPAEAEARGPEGLLRRSGSGYEGSTSWKAALEDTTTRLLLGAIAVLLFAILVVMSILASKGCIKCEAPCPEDWLLYGRKCYFFSEEPRDWNTGRQYCHTHEAVLAVIQSQKELEFMFKFTRREPWIGLRRVGDEFHWVNGDPFDPDTFTIAGPGECVFVEPTRLVSTECLMTRPWVCSKMAYT

SEQ ID NO: 1007 - protein, 237 aa, unidentified
MTSEITYAEVRFKNEFKSSGINTASSAASKERTAPHKSNTGFPKLLCASLLIFFLLLAISFFIAFVIFFQKYSQLLEKKTTKELVHTTLECVKKNMPVEETAWSCCPKNWKSFSSNCYFISTESASWQDSEKDCARMEAHLLVINTQEEQDFIFQNLQEESAYFVGLSDPEGQRHWQWVDQTPYNESSTFWHPREPSDPNERCVVLNFRKSPKRWGWNDVNCLGPQRSVCEMMKIHL

SEQ ID NO: 1008 - protein, 213 aa, unidentified
MVPEEEPQDREKGLWWFQLKVWSMAVVSILLLSVCFTVSSVVPHNFMYSKTVKRLSKLREYQQYHPSLTCVMEGKDIEDWSCCPTPWTSFQSSCYFISTGMQSWTKSQKNCSVMGADLVVINTREEQDFIIQNLKRNSSYFLGLSDPGGRRHWQWVDQTPYNENVTFWHSGEPNNLDERCAIINFRSSEEWGWNDIHCHVPQKSICKMKKIYI

SEQ ID NO: 1009 - protein, 219 aa, unidentified
MNSSKSSETQCTERGCFSSQMFLWTVAGIPILFLSACFITRCVVTFRIFQTCDEKKFQLPENFTELSCYNYGSGSVKNCCPLNWEYFQSSCYFFSTDTISWALSLKNCSAMGAHLVVINSQEEQEFLSYKKPKMREFFIGLSDQVVEGQWQWVDGTPLTKSLSFWDVGEPNNIATLEDCATMRDSSNPRQNWNDVTCFLNYFRICEMVGINPLNKGKSL

SEQ ID NO: 1010 - protein, 589 aa, unidentified
MDGEAVRFCTDNQCVSLHPQEVDSVAMAPAAPKIPRLVQATPAFMAVTLVFSLVTLFVVVQQQTRPVPKPVQAVILGDNITGHLPFEPNNHHHFGREAEMRELIQTFKGHMENSSAWVVEIQMLKCRVDNVNSQLQVLGDHLGNTNADIQMVKGVLKDATTLSLQTQMLRSSLEGTNAEIQRLKEDLEKADALTFQTLNFLKSSLENTSIELHVLSRGLENANSEIQMLNASLETANTQAQLANSSLKNANAEIYVLRGHLDSVNDLRTQNQVLRNSLEGANAEIQGLKENLQNTNALNSQTQAFIKSSFDNTSAEIQFLRGHLERAGDEIHVLKRDLKMVTAQTQKANGRLDQTDTQIQVFKSEMENVNTLNAQIQVLNGHMKNASREIQTLKQGMKNASALTSQTQMLDSNLQKASAEIQRLRGDLENTKALTMEIQQEQSRLKTLHVVITSQEQLQRTQSQLLQMVLQGWKFNGGSLYYFSSVKKSWHEAEQFCVSQGAHLASVASKEEQAFLVEFTSKVYYWIGLTDRGTEGSWRWTDGTPFNAAQNKAPGSKGSCPLRKYIIVNSGMGACSFIDTPPCPWILSN

SEQ ID NO: 1011 - protein, 293 aa, unidentified
MDTTRYSKWGGSSEEVPGGPWGRWVHWSRRPLFLALAVLVTTVLWAVILSILLSKASTERAALLDGHDLLRTNASKQTAALGALKEEVGDCHSCCSGTQAQLQTTRAELGEAQAKLMEQESALRELRERVTQGLAEAGRGREDVRTELFRALEAVRLQNNSCEPCPTSWLSFEGSCYFFSVPKTTWAAAQDHCADASAHLVIVGGLDEQGFLTRNTRGRGYWLGLRAVRHLGKVQGYQWVDGVSLSFSHWNQGEPNDAWGRENCVMMLHTGLWNDAPCDSEKDGWICEKRHNC

SEQ ID NO: 1012 - protein, 399 aa, unidentified
MSDSKEPRVQQLGLLEEDPTTSGIRLFPRDFQFQQIHGHKSSTGCLGHGALVLQLLSFMLLAGVLVAILVQVSKVPSSLSQEQSEQDAIYQNLTQLKAAVGELSEKSKLQEIYQELTQLKAAVGELPEKSKLQEIYQELTRLKAAVGELPEKSKLQEIYQELTRLKAAVGELPEKSKLQEIYQELTRLKAAVGELPEKSKLQEIYQELTELKAAVGELPEKSKLQEIYQELTQLKAAVGELPDQSKQQQIYQELTDLKTAFERLCRHCPKDWTFFQGNCYFMSNSQRNWHDSVTACQEVRAQLVVIKTAEEQNFLQLQTSRSNRFSWMGLSDLNQEGTWQWVDGSPLSPSFQRYWNSGEPNNSGNEDCAEFSGSGWNDNRCDVDNYWICKKPAACFRDE

SEQ ID NO: 1013 - protein, 188 aa, unidentified
MNWHMIISGLIVVVLKVVGMTLFLLYFPQIFNKSNDGFTTTRSYGTVSQIFGSSSPSPNGFITTRSYGTVCPKDWEFYQARCFFLSTSESSWNESRDFCKGKGSTLAIVNTPEKLKFLQDITDAEKYFIGLIYHREEKRWRWINNSVFNGNVTNQNQNFNCATIGLTKTFDAASCDISYRRICEKNAK

SEQ ID NO: 1014 - protein, 209 aa, unidentified
MMQEQQPQSTEKRGWLSLRLWSVAGISIALLSACFIVSCVVTYHFTYGETGKRLSELHSYHSSLTCFSEGTKVPAWGCCPASWKSFGSSCYFISSEEKVWSKSEQNCVEMGAHLVVFNTEAEQNFIVQQLNESFSYFLGLSDPQGNNNWQWIDKTPYEKNVRFWHLGEPNHSAEQCASIVFWKPTGWGWNDVICETRRNSICEMNKIYL

SEQ ID NO: 1015 - protein, 247 aa, unidentified
MEYHPDLENLDEDGYTQLHFDSQSNTRIAVVSEKGSCAASPPWRLIAVILGILCLVILVIAVVLGTMAIWRSNSGSNTLENGYFLSRNKENHSQPTQSSLEDSVTPTKAVKTTGVLSSPCPPNWIIYEKSCYLFSMSLNSWDGSKRQCWQLGSNLLKIDSSNELGFIVKQVSSQPDNSFWIGLSRPQTEVPWLWEDGSTFSSNLFQIRTTATQENPSPNCVWIHVSVIYDQLCSVPSYSICEKKFSM

SEQ ID NO: 1016 - protein, 241 aa, unidentified
MHEEEIYTSLQWDSPAPDTYQKCLSSNKCSGACCLVMVISCVFCMGLLTASIFLGVKLLQVSTIAMQQQEKLIQQERALLNFTEWKRSCALQMKYCQAFMQNSLSSAHNSSPCPNNWIQNRESCYYVSEIWSIWHTSQENCLKEGSTLLQIESKEEMDFITGSLRKIKGSYDYWVGLSQDGHSGRWLWQDGSSPSPGLLPAERSQSANQVCGYVKSNSLLSSNCSTWKYFICEKYALRSSV

SEQ ID NO: 1017 - protein, 167 aa, unidentified
MVSNFFHVIQVFEKSATLISKTEHIGFVIYSWRKSTTHLGSRRKFAISIYLSEVSLQKYDCPFSGTSFVVFSLFLICAMAGDVVYADIKTVRTSPLELAFPLQRSVSFNFSTVHKSCPAKDWKVHKGKCYWIAETKKSWNKSQNDCAINNSYLMVIQDITAMVRFNI

SEQ ID NO: 1018 - protein, 610 aa, unidentified
MHFQAFWLCLGLLFISINAEFMDDDVETEDFEENSEEIDVNESELSSEIKYKTPQPIGEVYFAETFDSGRLAGWVLSKAKKDDMDEEISIYDGRWEIEELKENQVPGDRGLVLKSRAKHHAISAVLAKPFIFADKPLIVQYEVNFQDGIDCGGAYIKLLADTDDLILENFYDKTSYIIMFGPDKCGEDYKLHFIFRHKHPKTGVFEEKHAKPPDVDLKKFFTDRKTHLYTLVMNPDDTFEVLVDQTVVNKGSLLEDVVPPIKPPKEIEDPNDKKPEEWDERAKIPDPSAVKPEDWDESEPAQIEDSSVVKPAGWLDDEPKFIPDPNAEKPDDWNEDTDGEWEAPQILNPACRIGCGEWKPPMIDNPKYKGVWRPPLVDNPNYQGIWSPRKIPNPDYFEDDHPFLLTSFSALGLELWSMTSDIYFDNFIICSEKEVADHWAADGWRWKIMIANANKPGVLKQLMAAAEGHPWLWLIYLVTAGVPIALITSFCWPRKVKKKHKDTEYKKTDICIPQTKGVLEQEEKEEKAALEKPMDLEEEKKQNDGEMLEKEEESEPEEKSEEEIEIIEGQEESNQSNKSGSEDEMKEADESTGSGDGPIKSVRKRRVRKD

SEQ ID NO: 1019 - protein, 484 aa, unidentified
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRRCKPLKEFMLSQDVEHERLFDLIQKMLEYDPAKRITLREALKHPFFDLLKKSI

SEQ ID NO: 1020 - protein, 481 aa, unidentified
MRHSKRTHCPDWDSRESWGHESYRGSHKRKRRSHSSTQENRHCKPHHQFKESDCHYLEARSLNERDYRDRRYVDEYRNDYCEGYVPRHYHRDIESGYRIHCSKSSVRSRRSSPKRKRNRHCSSHQSRSKSHRRKRSRSIEDDEEGHLICQSGDVLRARYEIVDTLGEGAFGKVVECIDHGMDGMHVAVKIVKNVGRYREAARSEIQVLEHLNSTDPNSVFRCVQMLEWFDHHGHVCIVFELLGLSTYDFIKENSFLPFQIDHIRQMAYQICQSINFLHHNKLTHTDLKPENILFVKSDYVVKYNSKMKRDERTLKNTDIKVVDFGSATYDDEHHSTLVSTRHYRAPEVILALGWSQPCDVWSIGCILIEYYLGFTVFQTHDSKEHLAMMERILGPIPQHMIQKTRKRKYFHHNQLDWDEHSSAGRYVRRRCKPLKEFMLCHDEEHEKLFDLVRRMLEYDPTQRITLDEALQHPFFDLLKKK

SEQ ID NO: 1021 - protein, 1002 aa, unidentified
MAAHEWDWFQREELIGQISDIRVQNLQVERENVQKRTFTRWINLHLEKCNPPLEVKDLFVDIQDGKILMALLEVLSGRNLLHEYKSSSHRIFRLNNIAKALKFLEDSNVKLVSIDAAEIADGNPSLVLGLIWNIILFFQIKELTGNLSRNSPSSSLSPGSGGTDSDSSFPPTPTAERSVAISVKDQRKAIKALLAWVQRKTRKYGVAVQDFAGSWRSGLAFLAVIKAIDPSLVDMKQALENSTRENLEKAFSIAQDALHIPRLLEPEDIMVDTPDEQSIMTYVAQFLERFPELEAEDIFDSDKEVPIESTFVRIKETPSEQESKVFVLTENGERTYTVNHETSHPPPSKVFVCDKPESMKEFRLDGVSSHALSDSSTEFMHQIIDQVLQGGPGKTSDISEPSPESSILSSRKENGRSNSLPIKKTVHFEADTYKDPFCSKNLSLCFEGSPRVAKESLRQDGHVLAVEVAEEKEQKQESSKIPESSSDKVAGDIFLVEGTNNNSQSSSCNGALESTARHDEESHSLSPPGENTVMADSFQIKVNLMTVEALEEGDYFEAIPLKASKFNSDLIDFASTSQAFNKVPSPHETKPDEDAEAFENHAEKLGKRSIKSAHKKKDSPEPQVKMDKHEPHQDSGEEAEGCPSAPEETPVDKKPEVHEKAKRKSTRPHYEEEGEDDDLQGVGEELSSSPPSSCVSLETLGSHSEEGLDFKPSPPLSKVSVIPHDLFYFPHYEVPLAAVLEAYVEDPEDLKNEEMDLEEPEGYMPDLDSREEEADGSQSSSSSSVPGESLPSASDQVLYLSRGGVGTTPASEPAPLAPHEDHQQRETKENDPMDSHQSQESPNLENIANPLEENVTKESISSKKKEKRKHVDHVESSLFVAPGSVQSSDDLEEDSSDYSIPSRTSHSDSSIYLRRHTHRSSESDHFSYVQLRNAADLDDRRNRILTRKANSSGEAMSLGSHSPQSDSLTQLVQQPDMMYFILFLWLLVYCLLLFPQLDVSRL

SEQ ID NO: 1022 - protein, 373 aa, unidentified
MSLLLLLLLVSYYVGTLGTHTEIKRVAEEKVTLPCHHQLGLPEKDTLDIEWLLTDNEGNQKVVITYSSRHVYNNLTEEQKGRVAFASNFLAGDASLQIEPLKPSDEGRYTCKVKNSGRYVWSHVILKVLVRPSKPKCELEGELTEGSDLTLQCESSSGTEPIVYYWQRIREKEGEDERLPPKSRIDYNHPGRVLLQNLTMSYSGLYQCTAGNEAGKESCVVRVTVQYVQSIGMVAGAVTGIVAGALLIFLLVWLLIRRKDKERYEEEERPNEIREDAEAPKARLVKPSSSSSGSRSSRSGSSSTRSTANSASRSQRTLSTDAAPQPGLATQAYSLVGPEVRGSEPKKVHHANLTKAETTPSMIPSQSRAFQTV

SEQ ID NO: 1023 - protein, 438 aa, unidentified
MGGCAGSRRRFSDSEGEETVPEPRLPLLDHQGAHWKNAVGFWLLGLCNNFSYVVMLSAAHDILSHKRTSGNQSHVDPGPTPIPHNSSSRFDCNSVSTAAVLLADILPTLVIKLLAPLGLHLLPYSPRVLVSGICAAGSFVLVAFSHSVGTSLCGVVFASISSGLGEVTFLSLTAFYPRAVISWWSSGTGGAGLLGALSYLGLTQAGLSPQQTLLSMLGIPALLLASYFLLLTSPEAQDPGGEEEAESAARQPLIRTEAPESKPGSSSSLSLRERWTVFKGLLWYIVPLVVVYFAEYFINQGLFELLFFWNTSLSHAQQYRWYQMLYQAGVFASRSSLRCCRIRFTWALALLQCLNLVFLLADVWFGFLPSIYLVFLIILYEGLLGGAAYVNTFHNIALETSDEHREFAMAATCISDTLGISLSGLLALPLHDFLCQLS

SEQ ID NO: 1024 - protein, 358 aa, unidentified
MAQEVDTAQGAEMRRGAGAARGRASWCWALALLWLAVVPGWSRVSGIPSRRHWPVPYKRFDFRPKPDPYCQAKYTFCPTGSPIPVMEGDDDIEVFRLQAPVWEFKYGDLLGHLKIMHDAIGFRSTLTGKNYTMEWYELFQLGNCTFPHLRPEMDAPFWCNQGAACFFEGIDDVHWKENGTLVQVATISGNMFNQMAKWVKQDNETGIYYETWNVKASPEKGAETWFDSYDCSKFVLRTFNKLAEFGAEFKNIETNYTRIFLYSGEPTYLGNETSVFGPTGNKTLGLAIKRFYYPFKPHLPTKEFLLSLLQIFDAVIVHKQFYLFYNFEYWFLPMKFPFIKITYEEIPLPIRNKTLSGL

SEQ ID NO: 1025 - protein, 248 aa, unidentified
MEATRRRQHLGATGGPGAQLGASFLQARHGSVSADEAARTAPFHLDLWFYFTLQNWVLDFGRPIAMLVFPLEWFPLNKPSVGDYFHMAYNVITPFLLLKIDSFELLYYYDEYLGHCMWYIPFFLILFMYFSGCFTASKAESLIPGPALLLVAPSGLYYWYLVTEGQIFILFIFTFFAMLALVLHQKRKRLFLDSNGLFLFSSFALTLLLVALWVAWLWNDPVLRKKYPGVIYVPEPWAFYTLHVSSRH

SEQ ID NO: 1026 - protein, 286 aa, unidentified
MNPASDGGTSESIFDLDYASWGIRSTLMVAGFVFYLGVFVVCHQLSSSLNATYRSLVAREKVFWDLAATRAVFGVQSTAAGLWALLGDPVLHADKARGQQNWCWFHITTATGFFCFENVAVHLSNLIFRTFDLFLVIHHLFAFLGFLGCLVNLQAGHYLAMTTLLLEMSTPFTCVSWMLLKAGWSESLFWKLNQWLMIHMFHCRMVLTYHMWWVCFWHWDGLVSSLYLPHLTLFLVGLALLTLIINPYWTHKKTQQLLNPVDWNFAQPEAKSRPEGNGQLLRKKRP

SEQ ID NO: 1027 - protein, 538 aa, unidentified
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHMQDAVYSLQQFGFSEKDADEVKGIFVDTNLYFLALTFFVAAFHLLFDFLAFKNDISFWKKKKSMIGMSTKAVLWRCFSTVVIFLFLLDEQTSLLVLVPAGVGAAIELWKVKKALKMTIFWRGLMPEFQFGTYSESERKTEEYDTQAMKYLSYLLYPLCVGGAVYSLLNIKYKSWYSWLINSFVNGVYAFGFLFMLPQLFVNYKLKSVAHLPWKAFTYKAFNTFIDDVFAFIITMPTSHRLACFRDDVVFLVYLYQRWLYPVDKRRVNEFGESYEEKATRAPHTD

SEQ ID NO: 1028 - protein, 232 aa, unidentified
MPSQQKKIIFCMAGVFSFACALGVVTALGTPLWIKATVLCKTGALLVNASGQELDKFMGEMQYGLFHGEGVRQCGLGARPFRFSFFPDLLKAIPVSIHVNVILFSAILIVLTMVGTAFFMYNAFGKPFETLHGPLGLYLLSFISGSCGCLVMILFASEVKIHHLSEKIANYKEGTYVYKTQSEKYTTSFWVIFFCFFVHFLNGLLIRLAGFQFPFAKSKDAETTNVAADLMY

SEQ ID NO: 1029 - protein, 232 aa, unidentified
MPGWFKKAWYGLASLLSFSSFILIIVALVVPHWLSGKILCQTGVDLVNATDRELVKFIGDIYYGLFRGCKVRQCGLGGRQSQFTIFPHLVKELNAGLHVMILLLLFLALALALVSMGFAILNMIQVPYRAVSGPGGICLWNVLAGGVVALAIASFVAAVKFHDLTERIANFQEKLFQFVVVEEQYEESFWICVASASAHAANLVVVAISQIPLPEIKTKIEEATVTAEDILY

SEQ ID NO: 1030 - protein, 226 aa, unidentified
MPTTKKTLMFLSSFFTSLGSFIVICSILGTQAWITSTIAVRDSASNGSIFITYGLFRGESSEELSHGLAEPKKKFAVLEILNNSSQKTLHSVTILFLVLSLITSLLSSGFTFYNSISNPYQTFLGPTGVYTWNGLGASFVFVTMILFVANTQSNQLSEELFQMLYPATTSKGTTHSYGYSFWLILLVILLNIVTVTIIIFYQKARYQRKQEQRKPMEYAPRDGILF

SEQ ID NO: 1031 - protein, 981 aa, unidentified
MLRRPAPALAPAARLLLAGLLCGGGVWAARVNKHKPWLEPTYHGIVTENDNTVLLDPPLIALDKDAPLRFAESFEVTVTKEGEICGFKIHGQNVPFDAVVVDKSTGEGVIRSKEKLDCELQKDYSFTIQAYDCGKGPDGTNVKKSHKATVHIQVNDVNEYAPVFKEKSYKATVIEGKQYDSILRVEAVDADCSPQFSQICSYEIITPDVPFTVDKDGYIKNTEKLNYGKEHQYKLTVTAYDCGKKRATEDVLVKISIKPTCTPGWQGWNNRIEYEPGTGALAVFPNIHLETCDEPVASVQATVELETSHIGKGCDRDTYSEKSLHRLCGAAAGTAELLPSPSGSLNWTMGLPTDNGHDSDQVFEFNGTQAVRIPDGVVSVSPKEPFTISVWMRHGPFGRKKETILCSSDKTDMNRHHYSLYVHGCRLIFLFRQDPSEEKKYRPAEFHWKLNQVCDEEWHHYVLNVEFPSVTLYVDGTSHEPFSVTEDYPLHPSKIETQLVVGACWQEFSGVENDNETEPVTVASAGGDLHMTQFFRGNLAGLTLRSGKLADKKVIDCLYTCKEGLDLQVLEDSGRGVQIQAHPSQLVLTLEGEDLGELDKAMQHISYLNSRQFPTPGIRRLKITSTIKCFNEATCISVPPVDGYVMVLQPEEPKISLSGVHHFARAASEFESSEGVFLFPELRIISTITREVEPEGDGAEDPTVQESLVSEEIVHDLDTCEVTVEGEELNHEQESLEVDMARLQQKGIEVSSSELGMTFTGVDTMASYEEVLHLLRYRNWHARSLLDRKFKLICSELNGRYISNEFKVEVNVIHTANPMEHANHMAAQPQFVHPEHRSFVDLSGHNLANPHPFAVVPSTATVVIVVCVSFLVFMIILGVFRIRAAHRRTMRDQDTGKENEMDWDDSALTITVNPMETYEDQHSSEEEEEEEEEEESEDGEEEDDITSAESESSEEEEGEQGDPQNATRQQQLEWDDSTLSY

SEQ ID NO: 1032 - protein, 955 aa, unidentified
MLPGRLCWVPLLLALGVGSGSGGGGDSRQRRLLAAKVNKHKPWIETSYHGVITENNDTVILDPPLVALDKDAPVPFAGEICAFKIHGQELPFEAVVLNKTSGEGRLRAKSPIDCELQKEYTFIIQAYDCGAGPHETAWKKSHKAVVHIQVKDVNEFAPTFKEPAYKAVVTEGKIYDSILQVEAIDEDCSPQYSQICNYEIVTTDVPFAIDRNGNIRNTEKLSYDKQHQYEILVTAYDCGQKPAAQDTLVQVDVKPVCKPGWQDWTKRIEYQPGSGSMPLFPSIHLETCDGAVSSLQIVTELQTNYIGKGCDRETYSEKSLQKLCGASSGIIDLLPSPSAATNWTAGLLVDSSEMIFKFDGRQGAKVPDGIVPKNLTDQFTITMWMKHGPSPGVRAEKETILCNSDKTEMNRHHYALYVHNCRLVFLLRKDFDQADTFRPAEFHWKLDQICDKEWHYYVINVEFPVVTLYMDGATYEPYLVTNDWPIHPSHIAMQLTVGACWQGGEVTKPQFAQFFHGSLASLTIRPGKMESQKVISCLQACKEGLDINSLESLGQGIKYHFNPSQSILVMEGDDIGNINRALQKVSYINSRQFPTAGVRRLKVSSKVQCFGEDVCISIPEVDAYVMVLQAIEPRITLRGTDHFWRPAAQFESARGVTLFPDIKIVSTFAKTEAPGDVKTTDPKSEVLEEMLHNLDFCDILVIGGDLDPRQECLELNHSELHQRHLDATNSTAGYSIYGVGSMSRYEQVLHHIRYRNWRPASLEARRFRIKCSELNGRYTSNEFNLEVSILHEDQVSDKEHVNHLIVQPPFLQSVHHPESRSSIQHSSVVPSIATVVIIISVCMLVFVVAMGVYRVRIAHQHFIQETEAAKESEMDWDDSALTITVNPMEKHEGPGHGEDETEGEEEEEAEEEMSSSSGSDDSEEEEEEEGMGRGRHGQNGARQAQLEWDDSTLPY

SEQ ID NO: 1033 - protein, 956 aa, unidentified
MTLLLLPLLLASLLASCSCNKANKHKPWIEAEYQGIVMENDNTVLLNPPLFALDKDAPLRYAGEICGFRLHGSGVPFEAVILDKATGEGLIRAKEPVDCEAQKEHTFTIQAYDCGEGPDGANTKKSHKATVHVRVNDVNEFAPVFVERLYRAAVTEGKLYDRILRVEAIDGDCSPQYSQICYYEILTPNTPFLIDNDGNIENTEKLQYSGERLYKFTVTAYDCGKKRAADDAEVEIQVKPTCKPSWQGWNKRIEYAPGAGSLALFPGIRLETCDEPLWNIQATIELQTSHVAKGCDRDNYSERALRKLCGAATGEVDLLPMPGPNANWTAGLSVHYSQDSSLIYWFNGTQAVQVPLGGPSGLGSGPQDSLSDHFTLSFWMKHGVTPNKGKKEEETIVCNTVQNEDGFSHYSLTVHGCRIAFLYWPLLESARPVKFLWKLEQVCDDEWHHYALNLEFPTVTLYTDGISFDPALIHDNGLIHPPRREPALMIGACWTEEKNKEKEKGDNSTDTTQGDPLSIHHYFHGYLAGFSVRSGRLESREVIECLYACREGLDYRDFESLGKGMKVHVNPSQSLLTLEGDDVETFNHALQHVAYMNTLRFATPGVRPLRLTTAVKCFSEESCVSIPEVEGYVVVLQPDAPQILLSGTAHFARPAVDFEGTNGVPLFPDLQITCSISHQVEAKKDESWQGTVTDTRMSDEIVHNLDGCEISLVGDDLDPERESLLLDTTSLQQRGLELTNTSAYLTIAGVESITVYEEILRQARYRLRHGAALYTRKFRLSCSEMNGRYSSNEFIVEVNVLHSMNRVAHPSHVLSSQQFLHRGHQPPPEMAGHSLASSHRNSMIPSAATLIIVVCVGFLVLMVVLGLVRIHSLHRRVSGAGGPPGASSDPKDPDLFWDDSALTIIVNPMESYQNRQSCVTGAVGGQQEDEDSSDSEVADSPSSDERRIIETPPHRY

SEQ ID NO: 1034 - protein, 340 aa, unidentified
MALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGATSSKETLDILYARQKIVVIAKAFGLQAIDLVYIDFRDGAGLLRQSREGAAMGFTGKQVIHPNQIAVVQEQFSPSPEKIKWAEELIAAFKEHQQLGKGAFTFQGSMIDMPLLKQAQNTVTLATSIKEK

SEQ ID NO: 1035 - protein, 373 aa, unidentified
MRMEDEDYNTSISYGDEYPDYLDSIVVLEDLSPLEARVTRIFLVVVYSIVCFLGILGNGLVIIIATFKMKKTVNMVWFLNLAVADFLFNVFLPIHITYAAMDYHWVFGTAMCKISNFLLIHNMFTSVFLLTIISSDRCISVLLPVWSQNHRSVRLAYMACMVIWVLAFFLSSPSLVFRDTANLHGKISCFNNFSLSTPGSSSWPTHSQMDPVGYSRHMVVTVTRFLCGFLVPVLIITACYLTIVCKLQRNRLAKTKKPFKIIVTIIITFFLCWCPYHTLNLLELHHTAMPGSVFSLGLPLATALAIANSCMNPILYVFMGQDFKKFKVALFSRLVNALSEDTGHSSYPSHRSFTKMSSMNERTSMNERETGML

SEQ ID NO: 1036 - protein, 169 aa, unidentified
MDPEHAKPESSEAPSGNLKQPETAAALSLILGALACFIITQANESFITITSLEICIVVFFILIYVLTLHHLLTYLHWPLLDLTNSIITAVFLSVVAILAMQEKKRRHLLYVGGSLCLTAVIVCCIDAFVVTTKMRTNLKRFLGVEVERKLSPAKDAYPETGPDAPQRPA

SEQ ID NO: 1037 - protein, 248 aa, unidentified
MAPKAAKGAKPEPAPAPPPPGAKPEEDKKDGKEPSDKPQKAVQDHKEPSDKPQKAVQPKHEVGTRRGCRRYRWELKDSNKEFWLLGHAEIKIRSLGCLIAAMILLSSLTVHPILRLIITMEISFFSFFILLYSFAIHRYIPFILWPISDLFNDLIACAFLVGAVVFAVRSRRSMNLHYLLAVILIGAAGVFAFIDVCLQRNHFRGKKAKKHMLVPPPGKEKGPQQGKGPEPAKPPEPGKPPGPAKGKK

SEQ ID NO: 1038 - protein, 182 aa, unidentified
MWPPDPDPDPDPEPAGGSRPGPAVPGLRALLPARAFLCSLKGRLLLAESGLSFITFICYVASSASAFLTAPLLEFLLALYFLFADAMQLNDKWQGLCWPMMDFLRCVTAALIYFAISITAIAKYSDGASKAAGVFGFFATIVFATDFYLIFNDVAKFLKQGDSADETTAHKTEEENSDSDSD

SEQ ID NO: 1039 - protein, 234 aa, unidentified
MRSGEELDGFEGEASSTSMISGASSPYQPTTEPVSQRRGLAGLRCDPDYLRGALGRLKVAQVILALIAFICIETIMACSPCEGLYFFEFVSCSAFVVTGVLLIMFSLNLHMRIPQINWNLTDLVNTGLSAFLFFIASIVLAALNHRAGAEIAAVIFGFLATAAYAVNTFLAVQKWRVSVRQQSTNDYIRARTESRDVDSRPEIQRLDTFSYSTNVTVRKKSPTNLLSLNHWQLA

SEQ ID NO: 1040 - protein, 223 aa, unidentified
MLSARDRRDRHPEEGVVAELQGFAVDKAFLTSHKGILLETELALTLIIFICFTASISAYMAAALLEFFITLAFLFLYATQYYQRFDRINWPCLLQGHGQSGGPHPLDLLSHSAKVQPQPWPGLTPPGWHTPAAVPWVPAPAPGFWSWLLWFICFHSLGSSDFLRCVSAIIIFLVVSFAAVTSRDGAAIAAFVFGIILVSIFAYDAFKIYRTEMAPGASQGDQQ

SEQ ID NO: 1041 - protein, 183 aa, unidentified
MENGAVYSPTTEEDPGPARGPRSGLAAYFFMGRLPLLRRVLKGLQLLLSLLAFICEEVVSQCTLCGGLYFFEFVSCSAFLLSLLILIVYCTPFYERVDTTKVKSSDFYITLGTGCVFLLASIIFVSTHDRTSAEIAAIVFGFIASFMFLLDFITMLYEKRQESQLRKPENTTRAEALTEPLNA

SEQ ID NO: 1042 - protein, 175 aa, unidentified
MSHGAGLVRTTCSSGSALGPGAGAAQPSASPLEGLLDLSYPRTHAALLKVAQMVTLLIAFICVRSSLWTNYSAYSYFEVVTICDLIMILAFYLVHLFRFYRVLTCISWPLSELLHYLIGTLLLLIASIVAASKSYNQSGLVAGAIFGFMATFLCMASIWLSYKISCVTQSTDAAV

SEQ ID NO: 1043 - protein, 173 aa, unidentified
MEEPQRARSHTVTTTASSFAENFSTSSSSFAYDREFLRTLPGFLIVAEIVLGLLVWTLIAGTEYFRVPAFGWVMFVAVFYWVLTVFFLIIYITMTYTRIPQVPWTTVGLCFNGSAFVLYLSAAVVDASSVSPERDSHNFNSWAASSFFAFLVTICYAGNTYFSFIAWRSRTIQ

SEQ ID NO: 1044 - protein, 770 aa, unidentified
MSKCRKTPVQQLASPASFSPDILADIFELFAKNFSYGKPLNNEWQLPDPSEIFTCDHTELNAFLDLKNSLNEVKNLLSDKKLDEWHEHTAFTNKAGKIISHVRKSVNAELCTQAWCKFHEILCSFPLIPQEAFQNGKLNSLHLCEAPGAFIASLNHYLKSHRFPCHWSWVANTLNPYHEANDDLMMIMDDRLIANTLHWWYFGPDNTGDIMTLKFLTGLQNFISSMATVHLVTADGSFDCQGNPGEQEALVSSLHYCEVVTALTTLGNGGSFVLKMFTMFEHCSINLMYLLNCCFDQVHVFKPATSKAGNSEVYVVCLHYKGREAIHPLLSKMTLNFGTEMKRKALFPHHVIPDSFLKRHEECCVFFHKYQLETISENIRLFECMGKAEQEKLNNLRDCAIQYFMQKFQLKHLSRNNWLVKKSSIGCSTNTKWFGQRNKYFKTYNERKMLEALSWKDKVAKGYFNSWAEEHGVYHPGQSSILEGTASNLECHLWHILEGKKLPKVKCSPFCNGEILKTLNEAIEKSLGGAFNLDSKFRPKQQYSCSCHVFSEELIFSELCSLTECLQDEQVVVPSNQIKCLLVGFSTLRNIKMHIPLEVRLLESAELTTFSCSLLHDGDPTYQRLFLDCLLHSLRELHTGDVMILPVLSCFTRFMAGLIFVLHSCFRFITFVCPTSSDPLRTCAVLLCVGYQDLPNPVFRYLQSVNELLSTLLNSDSPQQVLQFVPMEVLLKGALLDFLWDLNAAIAKRHLHFIIQREREEIINSLQLQN

SEQ ID NO: 1045 - protein, 125 aa, unidentified
MNSLEQAEDLKAFERRLTEYIHCLQPATGRWRMLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 1046 - protein, 690 aa, unidentified
MKLSMKNNIINTQQSFVTMPNVIVPDIEKEIRRMENGACSSFSEDDDSASTSEESENENPHARGSFSYKSLRKGGPSQREQYLPGAIALFNVNNSSNKDQEPEEKKKKKKEKKSKSDDKNENKNDPEKKKKKKDKEKKKKEEKSKDKKEEEKKEVVVIDPSGNTYYNWLFCITLPVMYNWTMVIARACFDELQSDYLEYWLILDYVSDIVYLIDMFVRTRTGYLEQGLLVKEELKLINKYKSNLQFKLDVLSLIPTDLLYFKLGWNYPEIRLNRLLRFSRMFEFFQRTETRTNYPNIFRISNLVMYIVIIIHWNACVFYSISKAIGFGNDTWVYPDINDPEFGRLARKYVYSLYWSTLTLTTIGETPPPVRDSEYVFVVVDFLIGVLIFATIVGNIGSMISNMNAARAEFQARIDAIKQYMHFRNVSKDMEKRVIKWFDYLWTNKKTVDEKEVLKYLPDKLRAEIAINVHLDTLKKVRIFADCEAGLLVELVLKLQPQVYSPGDYICKKGDIGREMYIIKEGKLAVVADDGVTQFVVLSDGSYFGEISILNIKGSKAGNRRTANIKSIGYSDLFCLSKDDLMEALTEYPDAKTMLEEKGKQILMKDGLLDLNIANAGSDPKDLEEKVTRMEGSVDLLQTRFARILAEYESMQQKLKQRLTKVEKFLKPLIDTEFSSIEGPGAESGPIDST

SEQ ID NO: 1047 - protein, 664 aa, unidentified
MTEKTNGVKSSPANNHNHHAPPAIKANGKDDHRTSSRPHSAADDDTSSELQRLADVDAPQQGRSGFRRIVRLVGIIREWANKNFREEEPRPDSFLERFRGPELQTVTTQEGDGKGDKDGEDKGTKKKFELFVLDPAGDWYYCWLFVIAMPVLYNWCLLVARACFSDLQKGYYLVWLVLDYVSDVVYIADLFIRLRTGFLEQGLLVKDTKKLRDNYIHTLQFKLDVASIIPTDLIYFAVDIHSPEVRFNRLLHFARMFEFFDRTETRTNYPNIFRISNLVLYILVIIHWNACIYYAISKSIGFGVDTWVYPNITDPEYGYLAREYIYCLYWSTLTLTTIGETPPPVKDEEYLFVIFDFLIGVLIFATIVGNVGSMISNMNATRAEFQAKIDAVKHYMQFRKVSKGMEAKVIRWFDYLWTNKKTVDEREILKNLPAKLRAEIAINVHLSTLKKVRIFHDCEAGLLVELVLKLRPQVFSPGDYICRKGDIGKEMYIIKEGKLAVVADDGVTQYALLSAGSCFGEISILNIKGSKMGNRRTANIRSLGYSDLFCLSKDDLMEAVTEYPDAKKVLEERGREILMKEGLLDENEVATSMEVDVQEKLGQLETNMETLYTRFGRLLAEYTGAQQKLKQRITVLETKMKQNNEDDYLSDGMNSPELAAADEP

SEQ ID NO: 1048 - protein, 694 aa, unidentified
MAKINTQYSHPSRTHLKVKTSDRDLNRAENGLSRAHSSSEETSSVLQPGIAMETRGLADSGQGSFTGQGIARLSRLIFLLRRWAARHVHHQDQGPDSFPDRFRGAELKEVSSQESNAQANVGSQEPADRGRSAWPLAKCNTNTSNNTEEEKKTKKKDAIVVDPSSNLYYRWLTAIALPVFYNWYLLICRACFDELQSEYLMLWLVLDYSADVLYVLDVLVRARTGFLEQGLMVSDTNRLWQHYKTTTQFKLDVLSLVPTDLAYLKVGTNYPEVRFNRLLKFSRLFEFFDRTETRTNYPNMFRIGNLVLYILIIIHWNACIYFAISKFIGFGTDSWVYPNISIPEHGRLSRKYIYSLYWSTLTLTTIGETPPPVKDEEYLFVVVDFLVGVLIFATIVGNVGSMISNMNASRAEFQAKIDSIKQYMQFRKVTKDLETRVIRWFDYLWANKKTVDEKEVLKSLPDKLKAEIAINVHLDTLKKVRIFQDCEAGLLVELVLKLRPTVFSPGDYICKKGDIGKEMYIINEGKLAVVADDGVTQFVVLSDGSYFGEISILNIKGSKSGNRRTANIRSIGYSDLFCLSKDDLMEALTEYPEAKKALEEKGRQILMKDNLIDEELARAGADPKDLEEKVEQLGSSLDTLQTRFARLLAEYNATQMKMKQRLSQLESQVKGGGDKPLADGEVPGDATKTEDKQQ

SEQ ID NO: 1049 - protein, 575 aa, unidentified
MSQDTKVKTTESSPPAPSKARKLLPVLDPSGDYYYWWLNTMVFPVMYNLIILVCRACFPDLQHGYLVAWLVLDYTSDLLYLLDMVVRFHTGFLEQGILVVDKGRISSRYVRTWSFFLDLASLMPTDVVYVRLGPHTPTLRLNRFLRAPRLFEAFDRTETRTAYPNAFRIAKLMLYIFVVIHWNSCLYFALSRYLGFGRDAWVYPDPAQPGFERLRRQYLYSFYFSTLILTTVGDTPPPAREEEYLFMVGDFLLAVMGFATIMGSMSSVIYNMNTADAAFYPDHALVKKYMKLQHVNRKLERRVIDWYQHLQINKKMTNEVAILQHLPERLRAEVAVSVHLSTLSRVQIFQNCEASLLEELVLKLQPQTYSPGEYVCRKGDIGQEMYIIREGQLAVVADDGITQYAVLGAGLYFGEISIINIKGNMSGNRRTANIKSLGYSDLFCLSKEDLREVLSEYPQAQTIMEEKGREILLKMNKLDVNAEAAEIALQEATESRLRGLDQQLDDLQTKFARLLAELESSALKIAYRIERLEWQTREWPMPEDLAEADDEGEPEEGTSKDEEGRASQEGPPGPE

SEQ ID NO: 1050 - protein, 1251 aa, unidentified
MLGWVQRVLPQPPGTPRKTKMQEEEEVEPEPEMEAEVEPEPNPEEAETESESMPPEESFKEEEVAVADPSPQETKEAALTSTISLRAQGAEISEMNSPSRRVLTWLMKGVEKVIPQPVHSITEDPAQILGHGSTGDTGCTDEPNEALEAQDTRPGLRLLLWLEQNLERVLPQPPKSSEVWRDEPAVATGAASDPAPPGRPQEMGPKLQARETPSLPTPIPLQPKEEPKEAPAPEPQPGSQAQTSSLPPTRDPARLVAWVLHRLEMALPQPVLHGKIGEQEPDSPGICDVQTISILPGGQVEPDLVLEEVEPPWEDAHQDVSTSPQGTEVVPAYEEENKAVEKMPRELSRIEEEKEDEEEEEEEEEEEEEEEVTEVLLDSCVVSQVGVGQSEEDGTRPQSTSDQKLWEEVGEEAKKEAEEKAKEEAEEVAEEEAEKEPQDWAETKEEPEAEAEAASSGVPATKQHPEVQVEDTDADSCPLMAEENPPSTVLPPPSPAKSDTLIVPSSASGTHRKKLPSEDDEAEELKALSPAESPVVAWSDPTTPKDTDGQDRAASTASTNSAIINDRLQELVKLFKERTEKVKEKLIDPDVTSDEESPKPSPAKKAPEPAPDTKPAEAEPVEEEHYCDMLCCKFKHRPWKKYQFPQSIDPLTNLMYVLWLFFVVMAWNWNCWLIPVRWAFPYQTPDNIHHWLLMDYLCDLIYFLDITVFQTRLQFVRGGDIITDKKDMRNNYLKSRRFKMDLLSLLPLDFLYLKVGVNPLLRLPRCLKYMAFFEFNSRLESILSKAYVYRVIRTTAYLLYSLHLNSCLYYWASAYQGLGSTHWVYDGVGNSYIRCYYFAVKTLITIGGLPDPKTLFEIVFQLLNYFTGVFAFSVMIGQMRDVVGAATAGQTYYRSCMDSTVKYMNFYKIPKSVQNRVKTWYEYTWHSQGMLDESELMVQLPDKMRLDLAIDVNYNIVSKVALFQGCDRQMIFDMLKRLRSVVYLPNDYVCKKGEIGREMYIIQAGQVQVLGGPDGKSVLVTLKAGSVFGEISLLAVGGGNRRTANVVAHGFTNLFILDKKDLNEILVHYPESQKLLRKKARRMLRSNNKPKEEKSVLILPPRAGTPKLFNAALAMTGKMGGKGAKGGKLAHLRARLKELAALEAAAKQQELVEQAKSSQDVKGEEGSAAPDQHTHPKEAATDPPAPRTPPEPPGSPPSSPPPASLGRPEGEEEGPAEPEEHSVRICMSPGPEPGEQILSVKMPEEREEKAE

SEQ ID NO: 1051 - protein, 809 aa, unidentified
MFKSLTKVNKVKPIGENNENEQSSRRNEEGSHPSNQSQQTTAQEENKGEEKSLKTKSTPVTSEEPHTNIQDKLSKKNSSGDLTTNPDPQNAAEPTGTVPEQKEMDPGKEGPNSPQNKPPAAPVINEYADAQLHNLVKRMRQRTALYKKKLVEGDLSSPEASPQTAKPTAVPPVKESDDKPTEHYYRLLWFKVKKMPLTEYLKRIKLPNSIDSYTDRLYLLWLLLVTLAYNWNCCFIPLRLVFPYQTADNIHYWLIADIICDIIYLYDMLFIQPRLQFVRGGDIIVDSNELRKHYRTSTKFQLDVASIIPFDICYLFFGFNPMFRANRMLKYTSFFEFNHHLESIMDKAYIYRVIRTTGYLLFILHINACVYYWASNYEGIGTTRWVYDGEGNEYLRCYYWAVRTLITIGGLPEPQTLFEIVFQLLNFFSGVFVFSSLIGQMRDVIGAATANQNYFRACMDDTIAYMNNYSIPKLVQKRVRTWYEYTWDSQRMLDESDLLKTLPTTVQLALAIDVNFSIISKVDLFKGCDTQMIYDMLLRLKSVLYLPGDFVCKKGEIGKEMYIIKHGEVQVLGGPDGTKVLVTLKAGSVFGEISLLAAGGGNRRTANVVAHGFANLLTLDKKTLQEILVHYPDSERILMKKARVLLKQKAKTAEATPPRKDLALLFPPKEETPKLFKTLLGGTGKASLARLLKLKREQAAQKKENSEGGEEEGKENEDKQKENEDKQKENEDKGKENEDKDKGREPEEKPLDRPECTASPIAVEEEPHSVRRTVLPRGTSRQSLIISMAPSAEGGEEVLTIEVKEKAKQ

SEQ ID NO: 1052 - protein, 144 aa, unidentified
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 1053 - protein, 160 aa, unidentified
MAFTFAAFCYMLTLVLCASLIFFVIWHIIAFDELRTDFKNPIDQGNPARARERLKNIERICCLLRKLVVPEYSIHGLFCLMFLCAAEWVTLGLNIPLLFYHLWRYFHRPADGSEVMYDAVSIMNADILNYCQKESWCKLAFYLLSFFYYLYSMVYTLVSF

SEQ ID NO: 1054 - protein, 160 aa, unidentified
MAFTFAAFCYMLSLVLCAALIFFAIWHIIAFDELRTDFKSPIDQCNPVHARERLRNIERICFLLRKLVLPEYSIHSLFCIMFLCAQEWLTLGLNVPLLFYHFWRYFHCPADSSELAYDPPVVMNADTLSYCQKEAWCKLAFYLLSFFYYLYCMIYTLVSS

SEQ ID NO: 1055 - protein, 139 aa, unidentified
MEAVVFVFSLLDCCALIFLSVYFIITLSDLECDYINARSCCSKLNKWVIPELIGHTIVTVLLLMSLHWFIFLLNLPVATWNIYRYIMVPSGNMGVFDPTEIHNRGQLKSHMKEAMIKLGFHLLCFFMYLYSMILALIND

SEQ ID NO: 1056 - protein, 334 aa, unidentified
MTENSDKVPIALVGPDDVEFCSPPAYATLTVKPSSPARLLKVGAVVLISGAVLLLFGAIGAFYFWKGSDSHIYNVHYTMSINGKLQDGSMEIDAGNNLETFKMGSGAEEAIAVNDFQNGITGIRFAGGEKCYIKAQVKARIPEVGAVTKQSISSKLEGKIMPVKYEENSLIWVAVDQPVKDNSFLSSKVLELCGDLPIFWLKPTYPKEIQRERREVVRKIVPTTTKRPHSGPRSNPGAGRLNNETRPSVQEDSQAFNPDNPYHQQEGESMTFDPRLDHEGICCIECRRSYTHCQKICEPLGGYYPWPYNYQGCRSACRVIMPCSWWVARILGMV

SEQ ID NO: 1057 - protein, 951 aa, unidentified
MAAAAAAAAAVGVRLRDCCSRGAVLLLFFSLSPRPPAAAAWLLGLRPEDTAGGRVSLEGGTLRAAEGTSFLLRVYFQPGPPATAAPVPSPTLNSGENGTGDWAPRLVFIEEPPGGGGVAPSAVPTRPPGPQRCREQSDWASDVEVLGPLRPGGVAGSALVQVRVRELRKGEAERGGAGGGGKLFSLCAWDGRAWHHHGAAGGFLLRVRPRLYGPGGDLLPPAWLRALGALLLLALSALFSGLRLSLLSLDPVELRVLRNSGSAAEQEQARRVQAVRGRGTHLLCTLLLGQAGANAALAGWLYTSLPPGFGGTGEDYSEEGIHFPWLPALVCTGAVFLGAEICPYSVCSRHGLAIASHSVCLTRLLMAAAFPVCYPLGRLLDWALRQEISTFYTREKLLETLRAADPYSDLVKEELNIIQGALELRTKVVEEVLTPLGDCFMLRSDAVLDFATVSEILRSGYTRIPVYEGDQRHNIVDILFVKDLAFVDPDDCTPLLTVTRFYNRPLHCVFNDTRLDTVLEEFKKGKSHLAIVQRVNNEGEGDPFYEVMGIVTLEDIIEEIIKSEILDETDLYTDNRKKQRVPQRERKRHDFSLFKLSDTEMRVKISPQLLLATHRFMATEVEPFKSLYLSEKILLRLLKHPNVIQELKFDEKNKKAPEHYLYQRNRPVDYFVLLLQGKVEVEVGKEGLRFENGAFTYYGVPAIMTTACSDNDVRKVGSLAGSSVFLNRSPSRCSGLNRSESPNRERSDFGGSNTQLYSSSNNLYMPDYSVHILSDVQFVKITRQQYQNALTACHMDSSPQSPDMEAFTDGDSTKAPTTRGTPQTPKDDPAITLLNNRNSLPCSRSDGLRSPSEVVYLRMEELAFTQEEMTDFEEHSTQQLTLSPAAVPTRAASDSECCNINLDTETSPCSSDFEENVGKKLLRTLSGQKRKRSPEGERTSEDNSNLTPLIT

SEQ ID NO: 1058 - protein, 875 aa, unidentified
MIGCGACEPKVKMAGGQAAAALPTWKMAARRSLSARGRGILQAAAGRLLPLLLLSCCCGAGGCAAVGENEETVIIGLRLEDTNDVSFMEGGALRVSERTRVKLRVYGQNINNETWSRIAFTEHERRRHSPGERGLGGPAPPEPDSGPQRCGIRTSDIIILPHIILNRRTSGIIEIEIKPLRKMEKSKSYYLCTSLSTPALGAGGSGSTGGAVGGKGGSGVAGLPPPPWAETTWIYHDGEDTKMIVGEEKKFLLPFWLQVIFISLLLCLSGMFSGLNLGLMALDPMELRIVQNCGTEKEKNYAKRIEPVRRQGNYLLCSLLLGNVLVNTTLTILLDDIAGSGLVAVVVSTIGIVIFGEIVPQAICSRHGLAVGANTIFLTKFFMMMTFPASYPVSKLLDCVLGQEIGTVYNREKLLEMLRVTDPYNDLVKEELNIIQGALELRTKTVEDVMTPLRDCFMITGEAILDFNTMSEIMESGYTRIPVFEGERSNIVDLLFVKDLAFVDPDDCTPLKTITKFYNHPLHFVFNDTKLDAMLEEFKKGKSHLAIVQRVNNEGEGDPFYEVLGIVTLEDVIEEIIKSEILDETDLYTDNRTKKKVAHRERKQDFSAFKQTDSEMKVKISPQLLLAMHRFLATEVEAFSPSQMSEKILLRLLKHPNVIQELKYDEKNKKAPEYYLYQRNKPVDYFVLILQGKVEVEAGKEGMKFEASAFSYYGVMALTASPVPLSLSRTFVVSRTELLAAGSPGENKSPPRPCGLNHSDSLSRSDRIDAVTPTLGSSNNQLNSSLLQVYIPDYSVRALSDLQFVKISRQQYQNALMASRMDKTPQSSDSENTKIELTLTELHDGLPDETANLLNEQNCVTHSKANHSLHNEGAI

SEQ ID NO: 1059 - protein, 707 aa, unidentified
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRALGLSRLAVLLTLPVALPVGQLLELAARPGRLRERVLELARGGGDPYSDLSKGVLRCRTVEDVLTPLEDCFMLDASTVLDFGVLASIMQSGHTRIPVYEEERSNIVDMLYLKDLAFVDPEDCTPLSTITRFYNHPLHFVFNDTKLDAVLEEFKRGKSHLAIVQKVNNEGEGDPFYEVLGLVTLEDVIEEIIRSEILDESEDYRDTVVKRKPASLMAPLKRKEEFSLFKVSDDEYKVTISPQLLLATQRFLSREVDVFSPLRISEKVLLHLLKHPSVNQEVRFDESNRLATHHYLYQRSQPVDYFILILQGRVEVEIGKEGLKFENGAFTYYGVSALTVPSSVHQSPVSSLQPIRHDLQPDPGDGTHSSAYCPDYTVRALSDLQLIKVTRLQYLNALLATRAQNLPQSPENTDLQVIPGSQTRLLGEKTTTAAGSSHSRPGVPVEGSPGRNPGV

SEQ ID NO: 1060 - protein, 775 aa, unidentified
MAPVGGGGRPVGGPARGRLLLAAPVLLVLLWALGARGQGSPQQGTIVGMRLASCNKSCGTNPDGIIFVSEGSTVNLRLYGYSLGNISSNLISFTEVDDAETLHKSTSCLELTKDLVVQQLVNVSRGNTSGVLVVLTKFLRRSESMKLYALCTRAQPDGPWLKWTDKDSLLFMVEEPGRFLPLWLHILLITVLLVLSGIFSGLNLGLMALDPMELRIVQNCGTEKERRYARKIEPIRRKGNYLLCSLLLGNVLVNTSLTILLDNLIGSGLMAVASSTIGIVIFGEILPQALCSRHGLAVGANTILLTKFFMLLTFPLSFPISKLLDFFLGQEIRTVYNREKLMEMLKVTEPYNDLVKEELNMIQGALELRTKTVEDIMTQLQDCFMIRSDAILDFNTMSEIMESGYTRIPVFEDEQSNIVDILYVKDLAFVDPDDCTPLKTITRFYNHPVHFVFHDTKLDAMLEEFKKGKSHLAIVQKVNNEGEGDPFYEVLGLVTLEDVIEEIIKSEILDESDMYTDNRSRKRVSEKNKRDFSAFKDADNELKVKISPQLLLAAHRFLATEVSQFSPSLISEKILLRLLKYPDVIQELKFDEHNKYYARHYLYTRNKPADYFILILQGKVEVEAGKENMKFETGAFSYYGTMALTSVPSDRSPAHPTPLSRSASLSYPDRTDVSTAATLAGSSNQFGSSVLGQYISDFSVRALVDLQYIKITRQQYQNGLLASRMENSPQFPIDGCTTHMENLAEKSELPVVDETTTLLNERNSLLHKASHENAI

SEQ ID NO: 1061 - protein, 2376 aa, unidentified
MNLDSLSLALSQISYLVDNLTKKNYRASQQEIQHIVNRHGPEADRHLLRCLFSHVDFSGDGKSSGKDFHQTQFLIQECALLITKPNFISTLSYAIDNPLHYQKSLKPAPHLFAQLSKVLKLSKVQEVIFGLALLNSSSSDLRGFAAQFIKQKLPDLLRSYIDADVSGNQEGGFQDIAIEVLHLLLSHLLFGQKGAFGVGQEQIDAFLKTLRRDFPQERCPVVLAPLLYPEKRDILMDRILPDSGGVAKTMMESSLADFMQEVGYGFCASIEECRNIIVQFGVREVTAAQVARVLGMMARTHSGLTDGIPLQSISAPGSGIWSDGKDKSDGAQAHTWNVEVLIDVLKELNPSLNFKEVTYELDHPGFQIRDSKGLHNVVYGIQRGLGMEVFPVDLIYRPWKHAEGQLSFIQHSLINPEIFCFADYPCHTVATDILKAPPEDDNREIATWKSLDLIESLLRLAEVGQYEQVKQLFSFPIKHCPDMLVLALLQINTSWHTLRHELISTLMPIFLGNHPNSAIILHYAWHGQGQSPSIRQLIMHAMAEWYMRGEQYDQAKLSRILDVAQDLKALSMLLNGTPFAFVIDLAALASRREYLKLDKWLTDKIREHGEPFIQACMTFLKRRCPSILGGLAPEKDQPKSAQLPPETLATMLACLQACAGSVSQELSETILTMVANCSNVMNKARQPPPGVMPKGRPPSASSLDAISPVQIDPLAGMTSLSIGGSAAPHTQSMQGFPPNLGSAFSTPQSPAKAFPPLSTPNQTTAFSGIGGLSSQLPVGGLGTGSLTGIGTGALGLPAVNNDPFVQRKLGTSGLNQPTFQQSKMKPSDLSQVWPEANQHFSKEIDDEANSYFQRIYNHPPHPTMSVDEVLEMLQRFKDSTIKREREVFNCMLRNLFEEYRFFPQYPDKELHITACLFGGIIEKGLVTYMALGLALRYVLEALRKPFGSKMYYFGIAALDRFKNRLKDYPQYCQHLASISHFMQFPHHLQEYIEYGQQSRDPPVKMQGSITTPGSIALAQAQAQAQVPAKAPLAGQVSTMVTTSTTTTVAKTVTVTRPTGVSFKKDVPPSINTTNIDTLLVATDQTERIVEPPENIQEKIAFIFNNLSQSNMTQKVEELKETVKEEFMPWVSQYLVMKRVSIEPNFHSLYSNFLDTLKNPEFNKMVLNETYRNIKVLLTSDKAAANFSDRSLLKNLGHWLGMITLAKNKPILHTDLDVKSLLLEAYVKGQQELLYVVPFVAKVLESSIRSVVFRPPNPWTMAIMNVLAELHQEHDLKLNLKFEIEVLCKNLALDINELKPGNLLKDKDRLKNLDEQLSAPKKDVKQPEELPPITTTTTSTTPATNTTCTATVPPQPQYSYHDINVYSLAGLAPHITLNPTIPLFQAHPQLKQCVRQAIERAVQELVHPVVDRSIKIAMTTCEQIVRKDFALDSEESRMRIAAHHMMRNLTAGMAMITCREPLLMSISTNLKNSFASALRTASPQQREMMDQAAAQLAQDNCELACCFIQKTAVEKAGPEMDKRLATEFELRKHARQEGRRYCDPVVLTYQAERMPEQIRLKVGGVDPKQLAVYEEFARNVPGFLPTNDLSQPTGFLAQPMKQAWATDDVAQIYDKCITELEQHLHAIPPTLAMNPQAQALRSLLEVVVLSRNSRDAIAALGLLQKAVEGLLDATSGADADLLLRYRECHLLVLKALQDGRAYGSPWCNKQITRCLIECRDEYKYNVEAVELLIRNHLVNMQQYDLHLAQSMENGLNYMAVAFAMQLVKILLVDERSVAHVTEADLFHTIETLMRINAHSRGNAPEGLPQLMEVVRSNYEAMIDRAHGGPNFMMHSGISQASEYDDPPGLREKAEYLLREWVNLYHSAAAGRDSTKAFSAFVGQMHQQGILKTDDLITRFFRLCTEMCVEISYRAQAEQQHNPAANPTMIRAKCYHNLDAFVRLIALLVKHSGEATNTVTKINLLNKVLGIVVGVLLQDHDVRQSEFQQLPYHRIFIMLLLELNAPEHVLETINFQTLTAFCNTFHILRPTKAPGFVYAWLELISHRIFIARMLAHTPQQKGWPMYAQLLIDLFKYLAPFLRNVELTKPMQILYKGTLRVLLVLLHDFPEFLCDYHYGFCDVIPPNCIQLRNLILSAFPRNMRLPDPFTPNLKVDMLSEINIAPRILTNFTGVMPPQFKKDLDSYLKTRSPVTFLSDLRSNLQVSNEPGNRYNLQLINALVLYVGTQAIAHIHNKGSTPSMSTITHSAHMDIFQNLAVDLDTEGRYLFLNAIANQLRYPNSHTHYFSCTMLYLFAEANTEAIQEQITRVLLERLIVNRPHPWGLLITFIELIKNPAFKFWNHEFVHCAPEIEKLFQSVAQCCMGQKQAQQVMEGTGAS

SEQ ID NO: 1062 - protein, 410 aa, unidentified
MDLTGLLLDEEGTFSLAGFQDFTFLPGHQKLSARIRRRLYYGWDWEADCSLEELSSPVADIAVELLQKAAPSPIRRLQKKYVAHVSREACISPCAMMLALVYIERLRHRNPDYLQHVSSSDLFLISMMVASKYLYDEGEEEEVFNDEWGAAGGVAVPTLNALERGFLSAMDWHLYTDPREIFEVLSWLESCVAEQQGRWRGWYTYTDLCVLLEQPTWQLALGSLCQRLVKLSCLLAVAYVSSVALAVASVAVIHQSLGLSCIPTPGPPDLGLTSRCLLEPCIPSVPQCLPSLANVSSCLEGSMGLRSLWGSLLASLTPPPLPPPDPPAPPTLLHNCHLCQKLQRDSPTCHACLHPNRTVPTALSSPWYHTYGLAPPWPWSPVLLSLPQPQQCSLFSVMELARLKSFVFPG

SEQ ID NO: 1063 - protein, 472 aa, unidentified
MKSILDGLADTTFRTITTDLLYVGSNDIQYEDIKGDMASKLGYFPQKFPLTSFRGSPFQEKMTAGDNPQLVPADQVNITEFYNKSLSSFKENEENIQCGENFMDIECFMVLNPSQQLAIAVLSLTLGTFTVLENLLVLCVILHSRSLRCRPSYHFIGSLAVADLLGSVIFVYSFIDFHVFHRKDSRNVFLFKLGGVTASFTASVGSLFLTAIDRYISIHRPLAYKRIVTRPKAVVAFCLMWTIAIVIAVLPLLGWNCEKLQSVCSDIFPHIDETYLMFWIGVTSVLLLFIVYAYMYILWKAHSHAVRMIQRGTQKSIIIHTSEDGKVQVTRPDQARMDIRLAKTLVLILVVLIICWGPLLAIMVYDVFGKMNKLIKTVFAFCSMLCLLNSTVNPIIYALRSKDLRHAFRSMFPSCEGTAQPLDNSMGDSDCLHKHANNAASVHRAAESCIKSTVKIAKVTMSVSTDTSAEAL

SEQ ID NO: 1064 - protein, 360 aa, unidentified
MEECWVTEIANGSKDGLDSNPMKDYMILSGPQKTAVAVLCTLLGLLSALENVAVLYLILSSHQLRRKPSYLFIGSLAGADFLASVVFACSFVNFHVFHGVDSKAVFLLKIGSVTMTFTASVGSLLLTAIDRYLCLRYPPSYKALLTRGRALVTLGIMWVLSALVSYLPLMGWTCCPRPCSELFPLIPNDYLLSWLLFIAFLFSGIIYTYGHVLWKAHQHVASLSGHQDRQVPGMARMRLDVRLAKTLGLVLAVLLICWFPVLALMAHSLATTLSDQVKKAFAFCSMLCLINSMVNPVIYALRSGEIRSSAHHCLAHWKKCVRGLGSEAKEEAPRSSVTETEADGKITPWPDSRDLDLSDC

SEQ ID NO: 1065 - protein, 725 aa, unidentified
MDDSDTPTYYLQIEPQDGCHPGDSVERSVTCLPSASDENENQLDGDGHEHLTSSDSAMGKPQVSEQDSLNNNESCTLSCEVAAGENLQNTLCEASRDEQAFLGKDKKIPGKRSPRSKKGTAKKIPPGLFSGDIAPLMQEKVLSAVTYAVDDEEAAEVNANEQPEAPKLVLQSLFSLIRGEVEQLDSRALPLCLHQIAESYFQEEDYEKAMKFIQLERLYHEQLLANLSAIQEQWETKWKTVQPHTVTALRNSEKGFNGEDFERLTKICATHQDPLLSKHKIAAVEKSQERKCSTQLLVSEDPKEGGATTKESESKTCLGTESSKESQHTVEPLGSSPCCHQMDVQTDSPSLSVTAGKDHMEELLCSAEATLALHTQSSETAGSPSGPDSSEDACEDDSRLQLAQTEACQDVARIEGIAEDPKVFLSSKSKTEPLISPGCDRIPPALISEGKYSQAQRKELRLPLRDASEALPTDQLENNELNELQQPDLTDSDGKSPQAQADSDGSENVLCGNNQISDLGILLPEVCMAPEEKGDKDDQLNKETEDYLNSLLEGCLKDTEDSLSYEDNQDDDSDLLQDLSPEEASYSLQENLPSDESCLSLDDLAKRIEIAEVVPTEGLVSILKKRNDTVGDHPAQMQHKPSKRRVRFQEIDDSLDQDEVGGGSCILLVLLCIATVFLSVGGTALYCTFGDMESPVCTDFADNMDFYYTKLLQGVAELKHWIYLS

SEQ ID NO: 1066 - protein, 330 aa, unidentified
MDGPMRPRSASLVDFQFGVVATETIEDALLHLAQQNEQAVREASGRLGRFREPQIVEFVFLLSEQWCLEKSVSYQAVEILERFMVKQAENICRQATIQPRDNKRESQNWRALKQQLVNKFTLRLVSCVQLASKLSFRNKIISNITVLNFLQALGYLHTKEELLESELDVLKSLNFRINLPTPLAYVETLLEVLGYNGCLVPAMRLHATCLTLLDLVYLLHEPIYESLLRASIENSTPSQLQGEKFTSVKEDFMLLAVGIIAASAFIQNHECWSQVVGHLQSITGIALASIAEFSYAILTHGVGANTPGRQQSIPPHLAARALKTVASSNT

SEQ ID NO: 1067 - protein, 372 aa, unidentified
MAAPVPWACCAVLAAAAAVVYAQRHSPQEAPHVQYERLGSDVTLPCGTANWDAAVTWRVNGTDLAPDLLNGSQLVLHGLELGHSGLYACFHRDSWHLRHQVLLHVGLPPREPVLSCRSNTYPKGFYCSWHLPTPTYIPNTFNVTVLHGSKIMVCEKDPALKNRCHIRYMHLFSTIKYKVSISVSNALGHNATAITFDEFTIVKPDPPENVVARPVPSNPRRLEVTWQTPSTWPDPESFPLKFFLRYRPLILDQWQHVELSDGTAHTITDAYAGKEYIIQVAAKDNEIGTWSDWSVAAHATPWTEEPRHLTTEAQAAETTTSTTSSLAPPPTTKICDPGELGSGGGPSAPFLVSVPITLALAAAAATASSLLI

SEQ ID NO: 1068 - protein, 1028 aa, unidentified
MRLLWKLVILLPLINSSAGDGLLSRPIFTQEPHDVIFPLDLSKSEVILNCAANGYPSPHYRWKQNGTDIDFTMSYHYRLDGGSLAINSPHTDQDIGMYQCLATNLLGTILSRKAKLQFAYIEDFETKTRSTVSVREGQGVVLLCGPPPHFGDLSYAWTFNDNPLYVQEDNRRFVSQETGNLYIAKVEPSDVGNYTCFITNKEAQRSVQGPPTPLVQRTDGVMGEYEPKIEVRFPETIQAAKDSSVKLECFALGNPVPDISWRRLDGSPLPGKVKYSKSQAILEIPNFQQEDEGFYECIASNLRGRNLAKGQLIFYAPPEWEQKIQNTHLSIYDNLLWECKASGKPNPWYTWLKNGERLNPEERIQIENGTLIITMLNVSDSGVYQCAAENKYQIIYANAELRVLASAPDFSKSPVKKKSFVQVGGDIVIGCKPNAFPRAAISWKRGTETLRQSKRIFLLEDGSLKIYNITRSDAGSYTCIATNQFGTAKNTGSLIVKERTVITVPPSKMDVTVGESIVLPCQVSHDPSIEVVFVWFFNGDVIDLKKGVAHFERIGGESVGDLMIRNIQLHHSGKYLCTVQTTLESLSAVADIIVRGPPGPPEDVQVEDISSTTSQLSWRAGPDNNSPIQIFTIQTRTPFSVGWQAVATVPEILNGKTYNATVVGLSPWVEYEFRVVAGNSIGIGEPSEPSELLRTKASVPVVAPVNIHGGGGSRSELVITWESIPEELQNGEGFGYIIMFRPVGSTTWSKEKVSSVESSRFVYRNESIIPLSPFEVKVGVYNNEGEGSLSTVTIVYSGEDEPQLAPRGTSLQSFSASEMEVSWNAIAWNRNTGRVLGYEVLYWTDDSKESMIGKIRVSGNVTTKNITGLKANTIYFASVRAYNTAGTGPSSPPVNVTTKKSPPSQPPANIAWKLTNSKLCLNWEHVKTMENESEVLGYKILYRQNRQSKTHILETNNTSAELLVPFEEDYLIEIRTVSDGGDGSSSEEIRIPKMSSLSSRGIQFLEPSTHFLSIVIVIFHCFAIQPLI

SEQ ID NO: 1069 - protein, 1384 aa, unidentified
MMHLRLFCILLAAVSGAEGWGYYGCDEELVGPLYARSLGASSYYSLLTAPRFARLHGISGWSPRIGDPNPWLQIDLMKKHRIRAVATQGSFNSWDWVTRYMLLYGDRVDSWTPFYQRGHNSTFFGNVNESAVVRHDLHFHFTARYIRIVPLAWNPRGKIGLRLGLYGCPYKADILYFDGDDAISYRFPRGVSRSLWDVFAFSFKTEEKDGLLLHAEGAQGDYVTLELEGAHLLLHMSLGSSPIQPRPGHTTVSAGGVLNDQHWHYVRVDRFGRDVNFTLDGYVQRFILNGDFERLNLDTEMFIGGLVGAARKNLAYRHNFRGCIENVIFNRVNIADLAVRRHSRITFEGKVAFRCLDPVPHPINFGGPHNFVQVPGFPRRGRLAVSFRFRTWDLTGLLLFSRLGDGLGHVELTLSEGQVNVSIAQSGRKKLQFAAGYRLNDGFWHEVNFVAQENHAVISIDDVEGAEVRVSYPLLIRTGTSYFFGGCPKPASRWDCHSNQTAFHGCMELLKVDGQLVNLTLVEGRRLGFYAEVLFDTCGITDRCSPNMCEHDGRCYQSWDDFICYCELTGYKGETCHTPLYKESCEAYRLSGKTSGNFTIDPDGSGPLKPFVVYCDIRENRAWTVVRHDRLWTTRVTGSSMERPFLGAIQYWNASWEEVSALANASQHCEQWIEFSCYNSRLLNTAGGYPYSFWIGRNEEQHFYWGGSQPGIQRCACGLDRSCVDPALYCNCDADQPQWRTDKGLLTFVDHLPVTQVVIGDTNRSTSEAQFFLRPLRCYGDRNSWNTISFHTGAALRFPPIRANHSLDVSFYFRTSAPSGVFLENMGGPYCQWRRPYVRVELNTSRDVVFAFDVGNGDENLTVHSDDFEFNDDEWHLVRAEINVKQARLRVDHRPWVLRPMPLQTYIWMEYDQPLYVGSAELKRRPFVGCLRAMRLNGVTLNLEGRANASEGTSPNCTGHCAHPRLPCFHGGRCVERYSYYTCDCDLTAFDGPYCNHDIGGFFEPGTWMRYNLQSALRSAAREFSHMLSRPVPGYEPGYIPGYDTPGYVPGYHGPGYRLPDYPRPGRPVPGYRGPVYNVTGEEVSFSFSTSSAPAVLLYVSSFVRDYMAVLIKDDGTLQLRYQLGTSPYVYQLTTRPVTDGQPHSINITRVYRNLFIQVDYFPLTEQKFSLLVDSQLDSPKALYLGRVMETGVIDPEIQRYNTPGFSGCLSGVRFNNVAPLKTHFRTPRPMTAELAEALRVQGELSESNCGAMPRLVSEVPPELDPWYLPPDFPYYHDEGWVAILLGFLVAFLLLGLVGMLVLFYLQNHRYKGSYHTNEPKAAHEYHPGSKPPLPTSGPAQVPTPTAAPNQAPASAPAPAPTPAPAPGPRDQNLPQILEESRSE

SEQ ID NO: 1070 - protein, 1331 aa, unidentified
MQAAPRAGCGAALLLWIVSSCLCRAWTAPSTSQKCDEPLVSGLPHVAFSSSSSISGSYSPGYAKINKRGGAGGWSPSDSDHYQWLQVDFGNRKQISAIATQGRYSSSDWVTQYRMLYSDTGRNWKPYHQDGNIWAFPGNINSDGVVRHELQHPIIARYVRIVPLDWNGEGRIGLRIEVYGCSYWADVINFDGHVVLPYRFRNKKMKTLKDVIALNFKTSESEGVILHGEGQQGDYITLELKKAKLVLSLNLGSNQLGPIYGHTSVMTGSLLDDHHWHSVVIERQGRSINLTLDRSMQHFRTNGEFDYLDLDYEITFGGIPFSGKPSSSSRKNFKGCMESINYNGVNITDLARRKKLEPSNVGNLSFSCVEPYTVPVFFNATSYLEVPGRLNQDLFSVSFQFRTWNPNGLLVFSHFADNLGNVEIDLTESKVGVHINITQTKMSQIDISSGSGLNDGQWHEVRFLAKENFAILTIDGDEASAVRTNSPLQVKTGEKYFFGGFLNQMNNSSHSVLQPSFQGCMQLIQVDDQLVNLYEVAQRKPGSFANVSIDMCAIIDRCVPNHCEHGGKCSQTWDSFKCTCDETGYSGATCHNSIYEPSCEAYKHLGQTSNYYWIDPDGSGPLGPLKVYCNMTEDKVWTIVSHDLQMQTPVVGYNPEKYSVTQLVYSASMDQISAITDSAEYCEQYVSYFCKMSRLLNTPDGSPYTWWVGKANEKHYYWGGSGPGIQKCACGIERNCTDPKYYCNCDADYKQWRKDAGFLSYKDHLPVSQVVVGDTDRQGSEAKLSVGPLRCQGDRNYWNAASFPNPSSYLHFSTFQGETSADISFYFKTLTPWGVFLENMGKEDFIKLELKSATEVSFSFDVGNGPVEIVVRSPTPLNDDQWHRVTAERNVKQASLQVDRLPQQIRKAPTEGHTRLELYSQLFVGGAGGQQGFLGCIRSLRMNGVTLDLEERAKVTSGFISGCSGHCTSYGTNCENGGKCLERYHGYSCDCSNTAYDGTFCNKDVGAFFEEGMWLRYNFQAPATNARDSSSRVDNAPDQQNSHPDLAQEEIRFSFSTTKAPCILLYISSFTTDFLAVLVKPTGSLQIRYNLGGTREPYNIDVDHRNMANGQPHSVNITRHEKTIFLKLDHYPSVSYHLPSSSDTLFNSPKSLFLGKVIETGKIDQEIHKYNTPGFTGCLSRVQFNQIAPLKAALRQTNASAHVHIQGELVESNCGASPLTLSPMSSATDPWHLDHLDSASADFPYNPGQGQAIRNGVNRNSAIIGGVIAVVIFTILCTLVFLIRYMFRHKGTYHTNEAKGAESAESADAAIMNNDPNFTETIDESKKEWLI

SEQ ID NO: 1071 - protein, 1288 aa, unidentified
MASVAWAVLKVLLLLPTQTWSPVGAGNPPDCDAPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYRLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSYLDLNFEISFGGIPTPGRSRAFRRKSFHGCLENLYYNGVDVTELAKKHKPQILMMGNVSFSCPQPQTVPVTFLSSRSYLALPGNSGEDKVSVTFQFRTWNRAGHLLFGELRRGSGSFVLFLKDGKLKLSLFQPGQSPRNVTAGAGLNDGQWHSVSFSAKWSHMNVVVDDDTAVQPLVAVLIDSGDTYYFGGCLDNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADAAWTVVQHGGPDAVTLRGAPSGHPRSAVSFAYAAGAGQLRSAVNLAERCEQRLALRCGTARRPDSRDGTPLSWWVGRTNETHTSWGGSLPDAQKCTCGLEGNCIDSQYYCNCDAGRNEWTSDTIVLSQKEHLPVTQIVMTDAGRPHSEAAYTLGPLLCRGDQSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSTKKQVILSSGTEFNAVKSLILGKVLEAAGADPDTRRAATSGFTGCLSAVRFGRAAPLKAALRPSGPSRVTVRGHVAPMARCAAGAASGSPARELAPRLAGGAGRSGPADEGEPLVNADRRDSAVIGGVIAVVIFILLCITAIAIRIYQQRKLRKENESKVSKKEEC

SEQ ID NO: 1072 - protein, 1288 aa, unidentified
MASVAWAVLKVLLLLPTQTWSPVGAGNPPDCDSPLASALPRSSFSSSSELSSSHGPGFSRLNRRDGAGGWTPLVSNKYQWLQIDLGERMEVTAVATQGGYGSSDWVTSYLLMFSDGGRNWKQYRREESIWGFPGNTNADSVVHYRLQPPFEARFLRFLPLAWNPRGRIGMRIEVYGCAYKSEVVYFDGQSALLYTLDKKPLKPIRDVISLKFKAMQSNGILLHREGQHGNHITLELIKGKLVFFLNSGNAKLPSTIAPVTLTLGSLLDDQHWHSVLIELLDTQVNFTVDKHTHHFQAKGDSSNLDLNFEISFGGILSPGRSRAFTRKSFHGCLENLYYNGVDVTELAKKHKPQILMMGNVSFSCPQPQTVPVTFLSSRSYLALPGNSGEDKVSVTFQFRTWNRAGHLLFGELQRGSGSFVLFLKDGKLKLSLFQAGQSPRNVTAGAGLNDGQWHSVSFSAKWSHMNVVVDDDTAVQPLVAVLIDSGDTYYFGGCLGNSSGSGCKSPLGGFQGCLRLITIGDKAVDPILVQQGALGSFRDLQIDSCGITDRCLPSYCEHGGECSQSWDTFSCDCLGTGYTGETCHSSLYEQSCEAHKHRGNPSGLYYIDADGSGPLGPFLVYCNMTADSAWTVVRHGGPDAVTLRGAPSGHPLSAVSFAYAAGAGQLRAAVNLAERCEQRLALRCGTARRPDSRDGTPLSWWVGRTNETHTSWGGSLPDAQKCTCGLEGNCIDSQYYCNCDAGQNEWTSDTIVLSQKEHLPVTQIVMTDTGQPHSEADYTLGPLLCRGDKSFWNSASFNTETSYLHFPAFHGELTADVCFFFKTTVSSGVFMENLGITDFIRIELRAPTEVTFSFDVGNGPCEVTVQSPTPFNDNQWHHVRAERNVKGASLQVDQLPQKMQPAPADGHVRLQLNSQLFIGGTATRQRGFLGCIRSLQLNGVALDLEERATVTPGVEPGCAGHCSTYGHLCRNGGRCREKRRGVTCDCAFSAYDGPFCSNEISAYFATGSSMTYHFQEHYTLSENSSSLVSSLHRDVTLTREMITLSFRTTRTPSLLLYVSSFYEEYLSVILANNGSLQIRYKLDRHQNPDAFTFDFKNMADGQLHQVKINREEAVVMVEVNQSAKKQVILSSGTEFNAVKSLILGKVLEAAGADPDTRRAATSGFTGCLSAVRFGCAAPLKAALRPSGPSRVTVRGHVAPMARCAAGAASGSPARELAPRLAGGAGRSGPVDEGEPLVNADRRDSAVIGGVIAVEIFILLCITAIAIRIYQQRKLRKENESKVSKKEEC

SEQ ID NO: 1073 - protein, 1308 aa, unidentified
MGSVTGAVLKTLLLLSTQNWNRVEAGNSYDCDDPLVSALPQASFSSSSELSSSHGPGFARLNRRDGAGGWSPLVSNKYQWLQIDLGERMEVTAVATQGGYGSSNWVTSYLLMFSDSGWNWKQYRQEDSIWGFSGNANADSVVYYRLQPSIKARFLRFIPLEWNPKGRIGMRIEVFGCAYRSEVVDLDGKSSLLYRFDQKSLSPIKDIISLKFKTMQSDGILLHREGPNGDHITLQLRRARLFLLINSGEAKLPSTSTLVNLTLGSLLDDQHWHSVLIQRLGKQVNFTVDEHRHHFHARGEFNLMNLDYEISFGGIPAPGKSVSFPHRNFHGCLENLYYNGVDIIDLAKQQKPQIIAMGNVSFSCSQPQSMPVTFLSSRSYLALPDFSGEEEVSATFQFRTWNKAGLLLFSELQLISGGILLFLSDGKLKSNLYQPGKLPSDITAGVELNDGQWHSVSLSAKKNHLSVAVDGQMASAAPLLGPEQIYSGGTYYFGGCPDKSFGSKCKSPLGGFQGCMRLISISGKVVDLISVQQGSLGNFSDLQIDSCGISDRCLPNYCEHGGECSQSWSTFHCNCTNTGYRGATCHNSIYEQSCEAYKHRGNTSGFYYIDSDGSGPLEPFLLYCNMTETAWTIIQHNGSDLTRVRNTNPENPYAGFFEYVASMEQLQATINRAEHCEQEFTYYCKKSRLVNKQDGTPLSWWVGRTNETQTYWGGSSPDLQKCTCGLEGNCIDSQYYCNCDADRNEWTNDTGLLAYKEHLPVTKIVITDTGRLHSEAAYKLGPLLCQGDRSFWNSASFDTEASYLHFPTFHGELSADVSFFFKTTASSGVFLENLGIADFIRIELRSPTVVTFSFDVGNGPFEISVQSPTHFNDNQWHHVRVERNMKEASLQVDQLTPKTQPAPADGHVLLQLNSQLFVGGTATRQRGFLGCIRSLQLNGMTLDLEERAQVTPEVQPGCRGHCSSYGKLCRNGGKCRERPIGFFCDCTFSAYTGPFCSNEISAYFGSGSSVIYNFQENYLLSKNSSSHAASFHGDMKLSREMIKFSFRTTRTPSLLLFVSSFYKEYLSVIIAKNGSLQIRYKLNKYQEPDVVNFDFKNMADGQLHHIMINREEGVVFIEIDDNRRRQVHLSSGTEFSAVKSLVLGRILEHSDVDQDTALAGAQGFTGCLSAVQLSHVAPLKAALHPSHPDPVTVTGHVTESSCMAQPGTDATSRERTHSFADHSGTIDDREPLANAIKSDSAVIGGLIAVVIFILLCITAIAVRIYQQKRLYKRSEAKRSENVDSAEAVLKSELNIQNAVNENQKEYFF

SEQ ID NO: 1074 - protein, 1306 aa, unidentified
MDSLPRLTSVLTLLFSGLWHLGLTATNYNCDDPLASLLSPMAFSSSSDLTGTHSPAQLNWRVGTGGWSPADSNAQQWLQMDLGNRVEITAVATQGRYGSSDWVTSYSLMFSDTGRNWKQYKQEDSIWTFAGNMNADSVVHHKLLHSVRARFVRFVPLEWNPSGKIGMRVEVYGCSYKSDVADFDGRSSLLYRFNQKLMSTLKDVISLKFKSMQGDGVLFHGEGQRGDHITLELQKGRLALHLNLGDSKARLSSSLPSATLGSLLDDQHWHSVLIERVGKQVNFTVDKHTQHFRTKGETDALDIDYELSFGGIPVPGKPGTFLKKNFHGCIENLYYNGVNIIDLAKRRKHQIYTGNVTFSCSEPQIVPITFVNSSGSYLLLPGTPQIDGLSVSFQFRTWNKDGLLLSTELSEGSGTLLLSLEGGILRLVIQKMTERVAEILTGSNLNDGLWHSVSINARRNRITLTLDDEAAPPAPDSTWVQIYSGNSYYFGGCPDNLTDSQCLNPIKAFQGCMRLIFIDNQPKDLISVQQGSLGNFSDLHIDLCSIKDRCLPNYCEHGGSCSQSWTTFYCNCSDTSYTGATCHNSIYEQSCEVYRHQGNTAGFFYIDSDGSGPLGPLQVYCNITEDKIWTSVQHNNTELTRVRGANPEKPYAMALDYGGSMEQLEAVIDGSEHCEQEVAYHCRRSRLLNTPDGTPFTWWIGRSNERHPYWGGSPPGVQQCECGLDESCLDIQHFCNCDADKDEWTNDTGFLSFKDHLPVTQIVITDTDRSNSEAAWRIGPLRCYGDRRFWNAVSFYTEASYLHFPTFHAEFSADISFFFKTTALSGVFLENLGIKDFIRLEISSPSEITFAIDVGNGPVELVVQSPSLLNDNQWHYVRAERNLKETSLQVDNLPRSTRETSEEGHFRLQLNSQLFVGGTSSRQKGFLGCIRSLHLNGQKMDLEERAKVTSGVRPGCPGHCSSYGSICHNGGKCVEKHNGYLCDCTNSPYEGPFCKKEVSAVFEAGTSVTYMFQEPYPVTKNISLSSSAIYTDSAPSKENIALSFVTTQAPSLLLFINSSSQDFVVVLLCKNGSLQVRYHLNKEETHVFTIDADNFANRRMHHLKINREGRELTIQMDQQLRLSYNFSPEVEFRVIRSLTLGKVTENLGLDSEVAKANAMGFAGCMSSVQYNHIAPLKAALRHATVAPVTVHGTLTESSCGFMVDSDVNAVTTVHSSSDPFGKTDEREPLTNAVRSDSAVIGGVIAVVIFIIFCIIGIMTRFLYQHKQSHRTSQMKEKEYPENLDSSFRNEIDLQNTVSECKREYFI

SEQ ID NO: 1075 - protein, 146 aa, unidentified
MMWQKYAGSRRSMPLGARILFHGVFYAGGFAIVYYLIQKFHSRALYYKLAVEQLQSHPEAQEALGPPLNIHYLKLIDRENFVDIVDAKLKIPVSGSKSEGLLYVHSSRGGPFQRWHLDEVFLELKDGQQIPVFKLSGENGDEVKKE

SEQ ID NO: 1076 - protein, 106 aa, unidentified
MASSGAGDPLDSKRGEAPFAQRIDPTREKLTPEQLHSMRQAELAQWQKVLPRRRTRNIVTGLGIGALVLAIYGYTFYSISQERFLDELEDEAKAARARALARASGS

SEQ ID NO: 1077 - protein, 717 aa, unidentified
MVAERTHKAAATGARGPGELGAPGTVALVAARAERGARLPSPGSCGLLTLALCSLALSLLAHFRTAELQARVLRLEAERGEQQMETAILGRVNQLLDEKWKLHSRRRREAPKTSPGCNCPPGPPGPTGRPGLPGDKGAIGMPGRVGSPGDAGLSIIGPRGPPGQPGTRGFPGFPGPIGLDGKPGHPGPKGDMGLTGPPGQPGPQGQKGEKGQCGEYPHRECLSSMPAALRSSQIIALKLLPLLNSVRLAPPPVIKRRTFQGEQSQASIQGPPGPPGPPGPSGPLGHPGLPGPMGPPGLPGPPGPKGDPGIQGYHGRKGERGMPGMPGKHGAKGAPGIAVAGMKGEPGIPGTKGEKGAEGSPGLPGLLGQKGEKGDAGNSIGGGRGEPGPPGLPGPPGPKGEAGVDGQVGPPGQPGDKGERGAAGEQGPDGPKGSKGEPGKGEMVDYNGNINEALQEIRTLALMGPPGLPGQIGPPGAPGIPGQKGEIGLPGPPGHDGEKGPRGKPGDMGPPGPQGPPGKDGPPGVKGENGHPGSPGEKGEKGETGQAGSPGEKGEAGEKGNPGAEVPGLPGPEGPPGPPGLQGVPGPKGEAGLDGAKGEKGFQGEKGDRGPLGLPGASGLDGRPGPPGTPGPIGVPGPAGPKGERGSKGDPGMTGPTGAAGLPGLHGPPGDKGNRGERGKKGSRGPKGDKGDQGAPGLDAPCPLGEDGLPVQGCWNK

SEQ ID NO: 1078 - protein, 1497 aa, unidentified
MDVTKKNKRDGTEVTERIVTETVTTRLTSLPPKGGTSNGYAKTASLGGGSRLEKQSLTHGSSGYINSTGSTRGHASTSSYRRAHSPASTLPNSPGSTFERKTHVTRHAYEGSSSGNSSPEYPRKEFASSSTRGRSQTRESEIRVRLQSASPSTRWTELDDVKRLLKGSRSASVSPTRNSSNTLPIPKKGTVETKIVTASSQSVSGTYDATILDANLPSHVWSSTLPAGSSMGTYHNNMTTQSSSLLNTNAYSAGSVFGVPNNMASCSPTLHPGLSTSSSVFGMQNNLAPSLTTLSHGTTTTSTAYGVKKNMPQSPAAVNTGVSTSAACTTSVQSDDLLHKDCKFLILEKDNTPAKKEMELLIMTKDSGKVFTASPASIAATSFSEDTLKKEKQAAYNADSGLKAEANGDLKTVSTKGKTTTADIHSYGSSGGGGSGGGGGVGGAGGGPWGPAPAWCPCGSCCSWWKWLLGLLLTWLLLLGLLFGLIALAEEVRKLKARVDELERIRRSILPYGDSMDRIEKDRLQGMAPAAGADLDKIGLHSDSQEELWMFVRKKLMMEQENGNLRGSPGPKGDMGSPGPKGDRGFPGTPGIPGPLGHPGPQGPKGQKGSVGDPGMEGPMGQRGREGPMGPRGEAGPPGSGEKGERGAAGEPGPHGPPGVPGSVGPKGSSGSPGPQGPPGPVGLQGLRGEVGLPGVKGDKGPMGPPGPKGDQGEKGPRGLTGEPGMRGLPGAVGEPGAKGAMGPAGPDGHQGPRGEQGLTGMPGIRGPPGPSGDPGKPGLTGPQGPQGLPGTPGRPGIKGEPGAPGKIVTSEGSSMLTVPGPPGPPGAMGPPGPPGAPGPAGPAGLPGHQEVLNLQGPPGPPGPRGPPGPSIPGPPGPRGPPGEGLPGPPGPPGSFLSNSETFLSGPPGPPGPPGPKGDQGPPGPRGHQGEQGLPGFSTSGSSSFGLNLQGPPGPPGPQGPKGDKGDPGVPGALGIPSGPSEGGSSSTMYVSGPPGPPGPPGPPGSISSSGQEIQQYISEYMQSDSIRSYLSGVQGPPGPPGPPGPVTTITGETFDYSELASHVVSYLRTSGYGVSLFSSSISSEDILAVLQRDDVRQYLRQYLMGPRGPPGPPGASGDGSLLSLDYAELSSRILSYMSSSGISIGLPGPPGPPGLPGTSYEELLSLLRGSEFRGIVGPPGPPGPPGIPGNVWSSISVEDLSSYLHTAGLSFIPGPPGPPGPPGPRGPPGVSGALATYAAENSDSFRSELISYLTSPDVRSFIVGPPGPPGPQGPPGDSRLLSTDASHSRGSSSSSHSSSVRRGSSYSSSMSTGGGGAGSLGAGGAFGEAAGDRGPYGTDIGPGGGYGAAAEGGMYAGNGGLLGADFAGDLDYNELAVRVSESMQRQGLLQGMAYTVQGPPGQPGPQGPPGISKVFSAYSNVTADLMDFFQTYGAIQGPPGQKGEMGTPGPKGDRGPAGPPGHPGPPGPRGHKGEKGDKGDQVYAGRRRRRSIAVKP

SEQ ID NO: 1079 - protein, 654 aa, unidentified
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPGMNGQKGEPGLPGAVGQNGIPGPKGEPGEQGEKGDAGENGPKGDTGEKGDPGSSAAGIKGEPGESGRPGQKGEPGLPGLPGLPGIKGEPGFIGPQGEPGLPGLPGTKGERGEAGPPGRGERGEPGAPGPKGKQGESGTRGPKGSKGDRGEKGDSGAQGPRGPPGQKGDQGATEIIDYNGNLHEALQRITTLTVTGPPGPPGPQGLQGPKGEQGSPGIPGMDGEQGLKGSKGDMGDPGMTGEKGGIGLPGLPGANGMKGEKGDSGMPGPQGPSIIGPPGPPGPHGPPGPMGPHGLPGPKGTDGPMGPHGPAGPKGERGEKGAMGEPGPRGPYGLPGKDGEPGLDGFPGPRGEKGDLGEKGEKGFRGVKGEKGEPGQPGLDGLDAPCQLGPDGLPMPGCWQK

SEQ ID NO: 1080 - protein, 742 aa, unidentified
MKDDFAEEEEVQSFGYKRFGIQEGTQCTKCKNNWALKFSIILLYILCALLTITVAILGYKVVEKMDNVTGGMETSRQTYDDKLTAVESDLKKLGDQTGKKAISTNSELSTFRSDILDLRQQLREITEKTSKNKDTLEKLQASGDALVDRQSQLKETLENNSFLITTVNKTLQAYNGYVTNLQQDTSVLQGNLQNQMYSHNVVIMNLNNLNLTQVQQRNLITNLQRSVDDTSQAIQRIKNDFQNLQQVFLQAKKDTDWLKEKVQSLQTLAANNSALAKANNDTLEDMNSQLNSFTGQMENITTISQANEQNLKDLQDLHKDAENRTAIKFNQLEERFQLFETDIVNIISNISYTAHHLRTLTSNLNEVRTTCTDTLTKHTDDLTSLNNTLANIRLDSVSLRMQQDLMRSRLDTEVANLSVIMEEMKLVDSKHGQLIKNFTILQGPPGPRGPRGDRGSQGPPGPTGNKGQKGEKGEPGPPGPAGERGPIGPAGPPGERGGKGSKGSQGPKGSRGSPGKPGPQGSSGDPGPPGPPGKEGLPGPQGPPGFQGLQGTVGEPGVPGPRGLPGLPGVPGMPGPKGPPGPPGPSGAVVPLALQNEPTPAPEDNGCPPHWKNFTDKCYYFSVEKEIFEDAKLFCEDKSSHLVFINTREEQQWIKKQMVGRESHWIGLTDSERENEWKWLDGTSPDYKNWKAGQPDNWGHGHGPGEDCAGLIYAGQWNDFQCEDVNNFICEKDRETVLSSAL

SEQ ID NO: 1081 - protein, 271 aa, unidentified
MPEAPPLLLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEECGLLRKGTVLLADNVICPGAPDFLAHVRGSSCFECTHYQSFLEYREVVDGLEKAIYKGPGSEAGP

SEQ ID NO: 1082 - protein, 371 aa, unidentified
MLGSRAAGFARGLRALALAWLPGWRGRSFALARAAGAPHGGDLQPPACPEPRGRQLSLSAAAVVDSAPRPLQPYLRLMRLDKPIGTWLLYLPCTWSIGLAAEPGCFPDWYMLSLFGTGAILMRGAGCTINDMWDQDYDKKVTRTANRPIAAGDISTFQSFVFLGGQLTLALGVLLCLNYYSIALGAGSLLLVITYPLMKRISYWPQLALGLTFNWGALLGWSAIKGSCDPSVCLPLYFSGVMWTLIYDTIYAHQDKRDDVLIGLKSTALRFGENTKPWLSGFSVAMLGALSLVGVNSGQTAPYYAALGAVGAHLTHQIYTLDIHRPEDCWNKFISNRTLGLIVFLGIVLGNLWKEKKTDKTKKGIENKIEN

SEQ ID NO: 1083 - protein, 217 aa, unidentified
MSCAGAAAAPRLWRLRPGARRSLSAYGRRTSVRFRSSGMTLDNISRAAVDRIIRVDHAGEYGANRIYAGQMAVLGRTSVGPVIQKMWDQEKDHLKKFNELMVTFRVRPTVLMPLWNVLGFALGAGTALLGKEGAMACTVAVEESIAHHYNNQIRTLMEEDPEKYEELLQLIKKFRDEELEHHDIGLDHDAELAPAYAVLKSIIQAGCRVAIYLSERL

SEQ ID NO: 1084 - protein, 1042 aa, unidentified
MKQSPALAPEERCRRAGSPKPVLRADDNNMGNGCSQKLATANLLRFLLLVLIPCICALVLLLVILLSYVGTLQKVYFKSNGSEPLVTDGEIQGSDVILTNTIYNQSTVVSTAHPDQHVPAWTTDASLPGDQSHRNTSACMNITHSQCQMLPYHATLTPLLSVVRNMEMEKFLKFFTYLHRLSCYQHIMLFGCTLAFPECIIDGDDSHGLLPCRSFCEAAKEGCESVLGMVNYSWPDFLRCSQFRNQTESSNVSRICFSPQQENGKQLLCGRGENFLCASGICIPGKLQCNGYNDCDDWSDEAHCNCSENLFHCHTGKCLNYSLVCDGYDDCGDLSDEQNCDCNPTTEHRCGDGRCIAMEWVCDGDHDCVDKSDEVNCSCHSQGLVECRNGQCIPSTFQCDGDEDCKDGSDEENCSVIQTSCQEGDQRCLYNPCLDSCGGSSLCDPNNSLNNCSQCEPITLELCMNLPYNSTSYPNYFGHRTQKEASISWESSLFPALVQTNCYKYLMFFSCTILVPKCDVNTGEHIPPCRALCEHSKERCESVLGIVGLQWPEDTDCSQFPEENSDNQTCLMPDEYVEECSPSHFKCRSGQCVLASRRCDGQADCDDDSDEENCGCKERDLWECPSNKQCLKHTVICDGFPDCPDYMDEKNCSFCQDDELECANHACVSRDLWCDGEADCSDSSDEWDCVTLSINVNSSSFLMVHRAATEHHVCADGWQEILSQLACKQMGLGEPSVTKLIQEQEKEPRWLTLHSNWESLNGTTLHELLVNGQSCESRSKISLLCTKQDCGRRPAARMNKRILGGRTSRPGRWPWQCSLQSEPSGHICGCVLIAKKWVLTVAHCFEGRENAAVWKVVLGINNLDHPSVFMQTRFVKTIILHPRYSRAVVDYDISIVELSEDISETGYVRPVCLPNPEQWLEPDTYCYITGWGHMGNKMPFKLQEGEVRIISLEHCQSYFDMKTITTRMICAGYESGTVDSCMGDSGGPLVCEKPGGRWTLFGLTSWGSVCFSKVLGPGVYSNVSYFVEWIKRQIYIQTFLLN

SEQ ID NO: 1085 - protein, 443 aa, unidentified
MAASPHTLSSRLLTGCVGGSVWYLERRTIQDSPHKFLHLLRNVNKQWITFQHFSFLKRMYVTQLNRSHNQQVRPKPEPVASPFLEKTSSGQAKAEIYEMRPLSPPSLSLSRKPNEKELIELEPDSVIEDSIDVGKETKEEKRWKEMKLQVYDLPGILARLSKIKLTALVVSTTAAGFALAPGPFDWPCFLLTSVGTGLASCAANSINQFFEVPFDSNMNRTKNRPLVRGQISPLLAVSFATCCAVPGVAILTLGVNPLTGALGLFNIFLYTCCYTPLKRISIANTWVGAVVGAIPPVMGWTAATGSLDAGAFLLGGILYSWQFPHFNALSWGLREDYSRGGYCMMSVTHPGLCRRVALRHCLALLVLSAAAPVLDITTWTFPIMALPINAYISYLGFRFYVDADRRSSRRLFFCSLWHLPLLLLLMLTCKRPSGGGDAGPPPS

SEQ ID NO: 1086 - protein, 276 aa, unidentified
MGGLWRPGWRCVPFCGWRWIHPGSPTRAAERVEPFLRPEWSGTGGAERGLRWLGTWKRCSLRARHPALQPPRRPKSSNPFTRAQEEERRRQNKTTLTYVAAVAVGMLGASYAAVPLYRLYCQTTGLGGSAVAGHASDKIENMVPVKDRIIKISFNADVHASLQWNFRPQQTEIYVVPGETALAFYRAKNPTDKPVIGISTYNIVPFEAGQYFNKIQCFCFEEQRLNPQEEVDMPVFFYIDPEFAEDPRMIKVDLITLSYTFFEAKEGHKLPVPGYN

SEQ ID NO: 1087 - protein, 57 aa, unidentified
MPTGKQLADIGYKTFSTSMMLLTVYGGYLCSVRVYHYFQWRRAQRQAAEEQKTSGIM

SEQ ID NO: 1088 - protein, 410 aa, unidentified
MQRLLFPPLRALKGRQYLPLLAPRAAPRAQCDCIRRPLRPGQYSTISEVALQSGRGTVSLPSKAAERVVGRWLLVCSGTVAGAVILGGVTRLTESGLSMVDWHLIKEMKPPTSQEEWEAEFQRYQQFPEFKILNHDMTLTEFKFIWYMEYSHRMWGRLVGLVYILPAAYFWRKGWLSRGMKGRVLALCGLVCFQGLLGWYMVKSGLEEKSDSHDIPRVSQYRLAAHLGSALVLYCASLWTSLSLLLPPHKLPETHQLLQLRRFAHGTAGLVFLTALSGAFVAGLDAGLVYNSFPKMGESWIPEDLFTFSPILRNVFENPTMVQFDHRILGITSVTAITVLYFLSRRIPLPRRTKMAAVTLLALAYTQVGLGISTLLMYVPTPLAATHQSGSLALLTGALWLMNELRRVPK

SEQ ID NO: 1089 - protein, 333 aa, unidentified
MLCRLGGRWLRPLPALQLWARDLPLAPVPTSGAKRPTLPVWAVAPVSAVHANGWYEALAASSPVRVAEEVLLGVHAATGLPWWGSILLSTVALRGAVTLPLAAYQHYILAKVENLQPEIKTIARHLNQEVAVRANQLGWSKRDARLTYLKNMRRLISELYVRDNCHPFKATVLVWIQLPMWIFMSFALRNLSTGAAHSEGFSVQEQLATGGILWFPDLTAPDSTWILPISVGVINLLIVEICALQKIGMSRFQTYITYFVRAMSVLMIPIAATVPSSIVLYWLCSSFVGLSQNLLLRSPGFRQLCRIPSTKSDSETPYKDIFAAFNTKFISRK

SEQ ID NO: 1090 - protein, 118 aa, unidentified
MAAPPEPGEPEERKSLKLLGFLDVENTPCARHSILYGSLGSVVAGFGHFLFTSRIRRSCDVGVGGFILVTLGCWFHCRYNYAKQRIQERIAREEIKKKILYEGTHLDPERKHNGSSSN

SEQ ID NO: 1091 - protein, 169 aa, unidentified
MLATRVFSLVGKRAISTSVCVRAHESVVKSEDFSLPAYMDRRDHPLPEVAHVKHLSASQKALKEKEKASWSSLSMDEKVELYRIKFKESFAEMNRGSNEWKTVVGGAMFFIGFTALVIMWQKHYVYGPLPQSFDKEWVAKQTKRMLDMKVNPIQGLASKWDYEKNEWKK

SEQ ID NO: 1092 - protein, 171 aa, unidentified
MLPRAAWSLVLRKGGGGRRGMHSSEGTTRGGGKMSPYTNCYAQRYYPMPEEPFCTELNAEEQALKEKEKGSWTQLTHAEKVALYRLQFNETFAEMNRRSNEWKTVMGCVFFFIGFAALVIWWQRVYVFPPKPITLTDERKAQQLQRMLDMKVNPVQGLASRWDYEKKQWKK

SEQ ID NO: 1093 - protein, 109 aa, unidentified
MAVVGVSSVSRLLGRSRPQLGRPMSSGAHGEEGSARMWKTLTFFVALPGVAVSMLNVYLKSHHGEHERPEFIAYPHLRIRTKPFPWGDGNHTLFHNPHVNPLPTGYEDE

SEQ ID NO: 1094 - protein, 75 aa, unidentified
MAPEVLPKPRMRGLLARRLRNHMAVAFVLSLGVAALYKFRVADQRKKAYADFYRNYDVMKDFEEMRKAGIFQSVK

SEQ ID NO: 1095 - protein, 79 aa, unidentified
MQALRVSQALIRSFSSTARNRFQNRVREKQKLFQEDNDIPLYLKGGIVDNILYRVTMTLCLGGTVYSLYSLGWASFPRN

SEQ ID NO: 1096 - protein, 83 aa, unidentified
MLRNLLALRQIGQRTISTASRRHFKNKVPEKQKLFQEDDEIPLYLKGGVADALLYRATMILTVGGTAYAIYELAVASFPKKQE

SEQ ID NO: 1097 - protein, 114 aa, unidentified
MYYKFSGFTQKLAGAWASEAYSPQGLKPVVSTEAPPIIFATPTKLTSDSTVYDYAGKNKVPELQKFFQKADGVPVYLKRGLPDQMLYRTTMALTVGGTIYCLIALYMASQPKNK

SEQ ID NO: 1098 - protein, 80 aa, unidentified
MFPLVKSALNRLQVRSIQQTMARQSHQKRTPDFHDKYGNAVLASGATFCIVTWTYVATQVGIEWNLSPVGRVTPKEWRNQ

SEQ ID NO: 1099 - protein, 81 aa, unidentified
MMFPLARNALSSLKIQSILQSMARHSHVKHSPDFHDKYGNAVLASGTAFCVATWVFTATQIGIEWNLSPVGRVTPKEWKHQ

SEQ ID NO: 1100 - protein, 63 aa, unidentified
MLGQSIRRFTTSVVRRSHYEEGPGKNLPFSVENKWSLLAKMCLYFGSAFATPFLVVRHQLLKT

SEQ ID NO: 1101 - protein, 69 aa, unidentified
MSVLTPLLLRGLTGSARRLPVPRAKIHSLPPEGKLGIMELAVGLTSCFVTFLLPAGWILSHLETYRRPE

SEQ ID NO: 1102 - protein, 72 aa, unidentified
MPLLRGRCPARRHYRRLALLGLQPAPRFAHSGPPRQRPLSAAEMAVGLVVFFTTFLTPAAYVLGNLKQFRRN

SEQ ID NO: 1103 - protein, 1380 aa, unidentified
MASGRDERPPWRLGRLLLLMCLLLLGSSARAAHIKKAEATTTTTSAGAEAAEGQFDRYYHEEELESALREAAAAGLPGLARLFSIGRSVEGRPLWVLRLTAGLGSLIPEGDAGPDAAGPDAAGPLLPGRPQVKLVGNMHGDETVSRQVLIYLARELAAGYRRGDPRLVRLLNTTDVYLLPSLNPDGFERAREGDCGFGDGGPSGASGRDNSRGRDLNRSFPDQFSTGEPPALDEVPEVRALIEWIRRNKFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFHHHHFPDMEIFLRRFANEYPNITRLYSLGKSVESRELYVMEISDNPGVHEPGEPEFKYIGNMHGNEVVGRELLLNLIEYLCKNFGTDPEVTDLVHNTRIHLMPSMNPDGYEKSQEGDSISVIGRNNSNNFDLNRNFPDQFVQITDPTQPETIAVMSWMKSYPFVLSANLHGGSLVVNYPFDDDEQGLATYSKSPDDAVFQQIALSYSKENSQMFQGRPCKNMYPNEYFPHGITNGASWYNVPGGMQDWNYLQTNCFEVTIELGCVKYPLEKELPNFWEQNRRSLIQFMKQVHQGVRGFVLDATDGRGILNATISVAEINHPVTTYKTGDYWRLLVPGTYKITASARGYNPVTKNVTVKSEGAIQVNFTLVRSSTDSNNESKKGKGASSSTNDASDPTTKEFETLIKDLSAENGLESLMLRSSSNLALALYRYHSYKDLSEFLRGLVMNYPHITNLTNLGQSTEYRHIWSLEISNKPNVSEPEEPKIRFVAGIHGNAPVGTELLLALAEFLCLNYKKNPAVTQLVDRTRIVIVPSLNPDGRERAQEKDCTSKIGQTNARGKDLDTDFTNNASQPETKAIIENLIQKQDFSLSVALDGGSMLVTYPYDKPVQTVENKETLKHLASLYANNHPSMHMGQPSCPNKSDENIPGGVMRGAEWHSHLGSMKDYSVTYGHCPEITVYTSCCYFPSAARLPSLWADNKRSLLSMLVEVHKGVHGFVKDKTGKPISKAVIVLNEGIKVQTKEGGYFHVLLAPGVHNIIAIADGYQQQHSQVFVHHDAASSVVIVFDTDNRIFGLPRELVVTVSGATMSALILTACIIWCICSIKSNRHKDGFHRLRQHHDEYEDEIRMMSTGSKKSLLSHEFQDETDTEEETLYSSKH

SEQ ID NO: 1104 - protein, 443 aa, unidentified
MDFPCLWLGLLLPLVAALDFNYHRQEGMEAFLKTVAQNYSSVTHLHSIGKSVKGRNLWVLVVGRFPKEHRIGIPEFKYVANMHGDETVGRELLLHLIDYLVTSDGKDPEITNLINSTRIHIMPSMNPDGFEAVKKPDCYYSIGRENYNQYDLNRNFPDAFEYNNVSRQPETVAVMKWLKTETFVLSANLHGGALVASYPFDNGVQATGALYSRSLTPDDDVFQYLAHTYASRNPNMKKGDECKNKMNFPNGVTNGYSWYPLQGGMQDYNYIWAQCFEITLELSCCKYPREEKLPSFWNNNKASLIEYIKQVHLGVKGQVFDQNGNPLPNVIVEVQDRKHICPYRTNKYGEYYLLLLPGSYIINVTVPGHDPHITKVIIPEKSQNFSALKKDILLPFQGQLDSIPVSNPSCPMIPLYRNLPDHSAATKPSLFLFLVSLLHIFFK

SEQ ID NO: 1105 - protein, 454 aa, unidentified
MALQLGRLSSGPCWLVARGGCGGPRAWSQCGGGGLRAWSQRSAAGRVCRPPGPAGTEQSRGLGHGSTSRGGPWVGTGLAAALAGLVGLATAAFGHVQRAEMLPKTSGTRATSLGRPEEEEDELAHRCSSFMAPPVTDLGELRRRPGDMKTKMELLILETQAQVCQALAQVDGGANFSVDRWERKEGGGGISCVLQDGCVFEKAGVSISVVHGNLSEEAAKQMRSRGKVLKTKDGKLPFCAMGVSSVIHPKNPHAPTIHFNYRYFEVEEADGNKQWWFGGGCDLTPTYLNQEDAVHFHRTLKEACDQHGPDLYPKFKKWCDDYFFIAHRGERRGIGGIFFDDLDSPSKEEVFRFVQSCARAVVPSYIPLVKKHCDDSFTPQEKLWQQLRRGRYVEFNLLYDRGTKFGLFTPGSRIESILMSLPLTARWEYMHSPSENSKEAEILEVLRHPRDWVR

SEQ ID NO: 1106 - protein, 773 aa, unidentified
MAEAHQAVAFQFTVTPDGIDLRLSHEALRQIYLSGLHSWKKKFIRFKNGIITGVYPASPSSWLIVVVGVMTTMYAKIDPSLGIIAKINRTLETANCMSSQTKNVVSGVLFGTGLWVALIVTMRYSLKVLLSYHGWMFTEHGKMSRATKIWMGMVKIFSGRKPMLYSFQTSLPRLPVPAVKDTVNRYLQSVRPLMKEEDFKRMTALAQDFAVGLGPRLQWYLKLKSWWATNYVSDWWEEYIYLRGRGPLMVNSNYYAMDLLYILPTHIQAARAGNAIHAILLYRRKLDREEIKPIRLLGSTIPLCSAQWERMFNTSRIPGEETDTIQHMRDSKHIVVYHRGRYFKVWLYHDGRLLKPREMEQQMQRILDNTSEPQPGEARLAALTAGDRVPWARCRQAYFGRGKNKQSLDAVEKAAFFVTLDETEEGYRSEDPDTSMDSYAKSLLHGRCYDRWFDKSFTFVVFKNGKMGLNAEHSWADAPIVAHLWEYVMSIDSLQLGYAEDGHCKGDINPNIPYPTRLQWDIPGECQEVIETSLNTANLLANDVDFHSFPFVAFGKGIIKKCRTSPDAFVQLALQLAHYKDMGKFCLTYEASMTRLFREGRTETVRSCTTESCDFVRAMVDPAQTVEQRLKLFKLASEKHQHMYRLAMTGSGIDRHLFCLYVVSKYLAVESPFLKEVLSEPWRLSTSQTPQQQVELFDLENNPEYVSSGGGFGPVADDGYGVSYILVGENLINFHISSKFSCPETDSHRFGRHLKEAMTDIITLFGLSSNSKK

SEQ ID NO: 1107 - protein, 772 aa, unidentified
MAEAHQAVAFQFTVTPDGVDFRLSREALKHVYLSGINSWKKRLIRIKNGILRGVYPGSPTSWLVVIMATVGSSFCNVDISLGLVSCIQRCLPQGCGPYQTPQTRALLSMAIFSTGVWVTGIFFFRQTLKLLLCYHGWMFEMHGKTSNLTRIWAMCIRLLSSRHPMLYSFQTSLPKLPVPRVSATIQRYLESVRPLLDDEEYYRMELLAKEFQDKTAPRLQKYLVLKSWWASNYVSDWWEEYIYLRGRSPLMVNSNYYVMDLVLIKNTDVQAARLGNIIHAMIMYRRKLDREEIKPVMALGIVPMCSYQMERMFNTTRIPGKDTDVLQHLSDSRHVAVYHKGRFFKLWLYEGARLLKPQDLEMQFQRILDDPSPPQPGEEKLAALTAGGRVEWAQARQAFFSSGKNKAALEAIERAAFFVALDEESYSYDPEDEASLSLYGKALLHGNCYNRWFDKSFTLISFKNGQLGLNAEHAWADAPIIGHLWEFVLGTDSFHLGYTETGHCLGKPNPALAPPTRLQWDIPKQCQAVIESSYQVAKALADDVELYCFQFLPFGKGLIKKCRTSPDAFVQIALQLAHFRDRGKFCLTYEASMTRMFREGRTETVRSCTSESTAFVQAMMEGSHTKADLRDLFQKAAKKHQNMYRLAMTGAGIDRHLFCLYLVSKYLGVSSPFLAEVLSEPWRLSTSQIPQSQIRMFDPEQHPNHLGAGGGFGPVADDGYGVSYMIAGENTIFFHISSKFSSSETNAQRFGNHIRKALLDIADLFQVPKAYS

SEQ ID NO: 1108 - protein, 803 aa, unidentified
MAEAHQAVGFRPSLTSDGAEVELSAPVLQEIYLSGLRSWKRHLSRFWNDFLTGVFPASPLSWLFLFSAIQLAWFLQLDPSLGLMEKIKELLPDWGGQHHGLRGVLAAALFASCLWGALIFTLHVALRLLLSYHGWLLEPHGAMSSPTKTWLALVRIFSGRHPMLFSYQRSLPRQPVPSVQDTVRKYLESVRPILSDEDFDWTAVLAQEFLRLQASLLQWYLRLKSWWASNYVSDWWEEFVYLRSRNPLMVNSNYYMMDFLYVTPTPLQAARAGNAVHALLLYRHRLNRQEIPPTLLMGMRPLCSAQYEKIFNTTRIPGVQKDYIRHLHDSQHVAVFHRGRFFRMGTHSRNSLLSPRALEQQFQRILDDPSPACPHEEHLAALTAAPRGTWAQVRTSLKTQAAEALEAVEGAAFFVSLDAEPAGLTREDPAASLDAYAHALLAGRGHDRWFDKSFTLIVFSNGKLGLSVEHSWADCPISGHMWEFTLATECFQLGYSTDGHCKGHPDPTLPQPQRLQWDLPDQIHSSISLALRGAKILSENVDCHVVPFSLFGKSFIRRCHLSSDSFIQIALQLAHFRDRGQFCLTYESAMTRLFLEGRTETVRSCTREACNFVRAMEDKEKTDPQCLALFRVAVDKHQALLKAAMSGQGVDRHLFALYIVSRFLHLQSPFLTQVHSEQWQLSTSQIPVQQMHLFDVHNYPDYVSSGGGFGPADDHGYGVSYIFMGDGMITFHISSKKSSTKTDSHRLGQHIEDALLDVASLFQAGQHFKRRFRGSGKENSRHRCGFLSRQTGASKASMTSTDF

SEQ ID NO: 1109 - protein, 2039 aa, unidentified
MGASSPRSPEPVGPPAPGLPFCCGGSLLAVVVLLALPVAWGQCNAPEWLPFARPTNLTDEFEFPIGTYLNYECRPGYSGRPFSIICLKNSVWTGAKDRCRRKSCRNPPDPVNGMVHVIKGIQFGSQIKYSCTKGYRLIGSSSATCIISGDTVIWDNETPICDRIPCGLPPTITNGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKTVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNAAHWSTKPPICQRIPCGLPPTIANGDFISTNRENFHYGSVVTYRCNPGSGGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPDVLHAERTQRDKDNFSPGQEVFYSCEPGYDLRGAASMRCTPQGDWSPAAPTCEVKSCDDFMGQLLNGRVLFPVNLQLGAKVDFVCDEGFQLKGSSASYCVLAGMESLWNSSVPVCEQIFCPSPPVIPNGRHTGKPLEVFPFGKAVNYTCDPHPDRGTSFDLIGESTIRCTSDPQGNGVWSSPAPRCGILGHCQAPDHFLFAKLKTQTNASDFPIGTSLKYECRPEYYGRPFSITCLDNLVWSSPKDVCKRKSCKTPPDPVNGMVHVITDIQVGSRINYSCTTGHRLIGHSSAECILSGNTAHWSTKPPICQRIPCGLPPTIANGDFISTNRENFHYGSVVTYRCNLGSRGRKVFELVGEPSIYCTSNDDQVGIWSGPAPQCIIPNKCTPPNVENGILVSDNRSLFSLNEVVEFRCQPGFVMKGPRRVKCQALNKWEPELPSCSRVCQPPPEILHGEHTPSHQDNFSPGQEVFYSCEPGYDLRGAASLHCTPQGDWSPEAPRCAVKSCDDFLGQLPHGRVLFPLNLQLGAKVSFVCDEGFRLKGSSVSHCVLVGMRSLWNNSVPVCEHIFCPNPPAILNGRHTGTPSGDIPYGKEISYTCDPHPDRGMTFNLIGESTIRCTSDPHGNGVWSSPAPRCELSVRAGHCKTPEQFPFASPTIPINDFEFPVGTSLNYECRPGYFGKMFSISCLENLVWSSVEDNCRRKSCGPPPEPFNGMVHINTDTQFGSTVNYSCNEGFRLIGSPSTTCLVSGNNVTWDKKAPICEIISCEPPPTISNGDFYSNNRTSFHNGTVVTYQCHTGPDGEQLFELVGERSIYCTSKDDQVGVWSSPPPRCISTNKCTAPEVENAIRVPGNRSFFSLTEIIRFRCQPGFVMVGSHTVQCQTNGRWGPKLPHCSRVCQPPPEILHGEHTLSHQDNFSPGQEVFYSCEPSYDLRGAASLHCTPQGDWSPEAPRCTVKSCDDFLGQLPHGRVLLPLNLQLGAKVSFVCDEGFRLKGRSASHCVLAGMKALWNSSVPVCEQIFCPNPPAILNGRHTGTPFGDIPYGKEISYACDTHPDRGMTFNLIGESSIRCTSDPQGNGVWSSPAPRCELSVPAACPHPPKIQNGHYIGGHVSLYLPGMTISYICDPGYLLVGKGFIFCTDQGIWSQLDHYCKEVNCSFPLFMNGISKELEMKKVYHYGDYVTLKCEDGYTLEGSPWSQCQADDRWDPPLAKCTSRTHDALIVGTLSGTIFFILLIIFLSWIILKHRKGNNAHENPKEVAIHLHSQGGSSVHPRTLQTNEENSRVLP

SEQ ID NO: 1110 - protein, 1033 aa, unidentified
MGAAGLLGVFLALVAPGVLGISCGSPPPILNGRISYYSTPIAVGTVIRYSCSGTFRLIGEKSLLCITKDKVDGTWDKPAPKCEYFNKYSSCPEPIVPGGYKIRGSTPYRHGDSVTFACKTNFSMNGNKSVWCQANNMWGPTRLPTCVSVFPLECPALPMIHNGHHTSENVGSIAPGLSVTYSCESGYLLVGEKIINCLSSGKWSAVPPTCEEARCKSLGRFPNGKVKEPPILRVGVTANFFCDEGYRLQGPPSSRCVIAGQGVAWTKMPVCEEIFCPSPPPILNGRHIGNSLANVSYGSIVTYTCDPDPEEGVNFILIGESTLRCTVDSQKTGTWSGPAPRCELSTSAVQCPHPQILRGRMVSGQKDRYTYNDTVIFACMFGFTLKGSKQIRCNAQGTWEPSAPVCEKECQAPPNILNGQKEDRHMVRFDPGTSIKYSCNPGYVLVGEESIQCTSEGVWTPPVPQCKVAACEATGRQLLTKPQHQFVRPDVNSSCGEGYKLSGSVYQECQGTIPWFMEIRLCKEITCPPPPVIYNGAHTGSSLEDFPYGTTVTYTCNPGPERGVEFSLIGESTIRCTSNDQERGTWSGPAPLCKLSLLAVQCSHVHIANGYKISGKEAPYFYNDTVTFKCYSGFTLKGSSQIRCKADNTWDPEIPVCEKETCQHVRQSLQELPAGSRVELVNTSCQDGYQLTGHAYQMCQDAENGIWFKKIPLCKVIHCHPPPVIVNGKHTGMMAENFLYGNEVSYECDQGFYLLGEKKLQCRSDSKGHGSWSGPSPQCLRSPPVTRCPNPEVKHGYKLNKTHSAYSHNDIVYVDCNPGFIMNGSRVIRCHTDNTWVPGVPTCIKKAFIGCPPPPKTPNGNHTGGNIARFSPGMSILYSCDQGYLLVGEALLLCTHEGTWSQPAPHCKEVNCSSPADMDGIQKGLEPRKMYQYGAVVTLECEDGYMLEGSPQSQCQSDHQWNPPLAVCRSRSLAPVLCGIAAGLILLTFLIVITLYVISKHRARNYYTDTSQKEAFHLEAREVYSVDPYNPAS

SEQ ID NO: 1111 - protein, 1406 aa, unidentified
MALKNINYLLIFYLSFSLLIYIKNSFCNKNNTRCLSNSCQNNSTCKDFSKDNDCSCSDTANNLDKDCDNMKDPCFSNPCQGSATCVNTPGERSFLCKCPPGYSGTICETTIGSCGKNSCQHGGICHQDPIYPVCICPAGYAGRFCEIDHDECASSPCQNGAVCQDGIDGYSCFCVPGYQGRHCDLEVDECASDPCKNEATCLNEIGRYTCICPHNYSGVNCELEIDECWSQPCLNGATCQDALGAYFCDCAPGFLGDHCELNTDECASQPCLHGGLCVDGENRYSCNCTGSGFTGTHCETLMPLCWSKPCHNNATCEDSVDNYTCHCWPGYTGAQCEIDLNECNSNPCQSNGECVELSSEKQYGRITGLPSSFSYHEASGYVCICQPGFTGIHCEEDVNECSSNPCQNGGTCENLPGNYTCHCPFDNLSRTFYGGRDCSDILLGCTHQQCLNNGTCIPHFQDGQHGFSCLCPSGYTGSLCEIATTLSFEGDGFLWVKSGSVTTKGSVCNIALRFQTVQPMALLLFRSNRDVFVKLELLSGYIHLSIQVNNQSKVLLFISHNTSDGEWHFVEVIFAEAVTLTLIDDSCKEKCIAKAPTPLESDQSICAFQNSFLGGLPVGMTSNGVALLNFYNMPSTPSFVGCLQDIKIDWNHITLENISSGSSLNVKAGCVRKDWCESQPCQSRGRCINLWLSYQCDCHRPYEGPNCLREYVAGRFGQDDSTGYVIFTLDESYGDTISLSMFVRTLQPSGLLLALENSTYQYIRVWLERGRLAMLTPNSPKLVVKFVLNDGNVHLISLKIKPYKIELYQSSQNLGFISASTWKIEKGDVIYIGGLPDKQETELNGGFFKGCIQDVRLNNQNLEFFPNPTNNASLNPVLVNVTQGCAGDNSCKSNPCHNGGVCHSRWDDFSCSCPALTSGKACEEVQWCGFSPCPHGAQCQPVLQGFECIANAVFNGQSGQILFRSNGNITRELTNITFGFRTRDANVIILHAEKEPEFLNISIQDSRLFFQLQSGNSFYMLSLTSLQSVNDGTWHEVTLSMTDPLSQTSRWQMEVDNETPFVTSTIATGSLNFLKDNTDIYVGDRAIDNIKGLQGCLSTIEIGGIYLSYFENVHGFINKPQEEQFLKISTNSVVTGCLQLNVCNSNPCLHGGNCEDIYSSYHCSCPLGWSGKHCELNIDECFSNPCIHGNCSDRVAAYHCTCEPGYTGVNCEVDIDNCQSHQCANGATCISHTNGYSCLCFGNFTGKFCRQSRLPSTVCGNEKTNLTCYNGGNCTEFQTELKCMCRPGFTGEWCEKDIDECASDPCVNGGLCQDLLNKFQCLCDVAFAGERCEVDLADDLISDIFTTIGSVTVALLLILLLAIVASVVTSNKRATQGTYSPSRQEKEGSRVEMWNLMPPPAMERLI

SEQ ID NO: 1112 - protein, 1285 aa, unidentified
MALARPGTPDPQALASVLLLLLWAPALSLLAGTVPSEPPSACASDPCAPGTECQATESGGYTCGPMEPRGCATQPCHHGALCVPQGPDPTGFRCYCVPGFQGPRCELDIDECASRPCHHGATCRNLADRYECHCPLGYAGVTCEMEVDECASAPCLHGGSCLDGVGSFRCVCAPGYGGTRCQLDLDECQSQPCAHGGTCHDLVNGFRCDCAGTGYEGTHCEREVLECASAPCEHNASCLEGLGSFRCLCWPGYSGELCEVDEDECASSPCQHGGRCLQRSDPALYGGVQAAFPGAFSFRHAAGFLCHCPPGFEGADCGVEVDECASRPCLNGGHCQDLPNGFQCHCPDGYAGPTCEEDVDECLSDPCLHGGTCSDTVAGYICRCPETWGGRDCSVQLTGCQGHTCPLAATCIPIFESGVHSYVCHCPPGTHGPFCGQNTTFSVMAGSPIQASVPAGGPLGLALRFRTTLPAGTLATRNDTKESLELALVAATLQATLWSYSTTVLVLRLPDLALNDGHWHQVEVVLHLATLELRLWHEGCPARLCVASGPVALASTASATPLPAGISSAQLGDATFAGCLQDVRVDGHLLLPEDLGENVLLGCERREQCRPLPCVHGGSCVDLWTHFRCDCARPHRGPTCADEIPAATFGLGGAPSSASFLLQELPGPNLTVSFLLRTRESAGLLLQFANDSAAGLTVFLSEGRIRAEVPGSPAVVLPGRWDDGLRHLVMLSFGPDQLQDLGQHVHVGGRLLAADSQPWGGPFRGCLQDLRLDGCHLPFFPLPLDNSSQPSELGGRQSWNLTAGCVSEDMCSPDPCFNGGTCLVTWNDFHCTCPANFTGPTCAQQLWCPGQPCLPPATCEEVPDGFVCVAEATFREGPPAAFSGHNASSGRLLGGLSLAFRTRDSEAWLLRAAAGALEGVWLAVRNGSLAGGVRGGHGLPGAVLPIPGPRVADGAWHRVRLAMERPAATTSRWLLWLDGAATPVALRGLASDLGFLQGPGAVRILLAENFTGCLGRVALGGLPLPLARPRPGAAPGAREHFASWPGTPAPILGCRGAPVCAPSPCLHDGACRDLFDAFACACGPGWEGPRCEAHVDPCHSAPCARGRCHTHPDGRFECRCPPGFGGPRCRLPVPSKECSLNVTCLDGSPCEGGSPAANCSCLEGLAGQRCQVPTLPCEANPCLNGGTCRAAGGVSECICNARFSGQFCEVAKGLPLPLPFPLLEVAVPAACACLLLLLLGLLSGILAARKRRQSEGTYSPSQQEVAGARLEMDSVLKVPPEERLI

SEQ ID NO: 1113 - protein, 120 aa, unidentified
MANPGLGLLLALGLPFLLARWGRAWGQIQTTSANENSTVLPSSTSSSSDGNLRPEAITAIIVVFSLLAALLLAVGLALLVRKLREKRQTEGTYRPSSEEQVGARVPPTPNLKLPPEERLI

SEQ ID NO: 1114 - protein, 371 aa, unidentified
MELELDAGDQDLLAFLLEESGDLGTAPDEAVRAPLDWALPLSEVPSDWEVDDLLCSLLSPPASLNILSSSNPCLVHHDHTYSLPRETVSMDLESESCRKEGTQMTPQHMEELAEQEIARLVLTDEEKSLLEKEGLILPETLPLTKTEEQILKRVRRKIRNKRSAQESRRKKKVYVGGLESRVLKYTAQNMELQNKVQLLEEQNLSLLDQLRKLQAMVIEISNKTSSSSTCILVLLVSFCLLLVPAMYSSDTRGSLPAEHGVLSRQLRALPSEDPYQLELPALQSEVPKDSTHQWLDGSDCVLQAPGNTSCLLHYMPQAPSAEPPLEWPFPDLFSEPLCRGPILPLQANLTRKGGWLPTGSPSVILQDRYSG

SEQ ID NO: 1115 - protein, 519 aa, unidentified
MDAVLEPFPADRLFPGSSFLDLGDLNESDFLNNAHFPEHLDHFTENMEDFSNDLFSSFFDDPVLDEKSPLLDMELDSPTPGIQAEHSYSLSGDSAPQSPLVPIKMEDTTQDAEHGAWALGHKLCSIMVKQEQSPELPVDPLAAPSAMAAAAAMATTPLLGLSPLSRLPIPHQAPGEMTQLPVIKAEPLEVNQFLKVTPEDLVQMPPTPPSSHGSDSDGSQSPRSLPPSSPVRPMARSSTAISTSPLLTAPHKLQGTSGPLLLTEEEKRTLIAEGYPIPTKLPLTKAEEKALKRVRRKIKNKISAQESRRKKKEYVECLEKKVETFTSENNELWKKVETLENANRTLLQQLQKLQTLVTNKISRPYKMAATQTGTCLMVAALCFVLVLGSLVPCLPEFSSGSQTVKEDPLAADGVYTASQMPSRSLLFYDDGAGLWEDGRSTLLPMEPPDGWEINPGGPAEQRPRDHLQHDHLDSTHETTKYLSEAWPKDGGNGTSPDFSHSKEWFHDRDLGPNTTIKLS

SEQ ID NO: 1116 - protein, 520 aa, unidentified
MEVLESGEQGVLQWDRKLSELSEPGDGEALMYHTHFSELLDEFSQNVLGQLLNDPFLSEKSVSMEVEPSPTSPAPLIQAEHSYSLCEEPRAQSPFTHITTSDSFNDDEVESEKWYLSTDFPSTSIKTEPVTDEPPPGLVPSVTLTITAISTPLEKEEPPLEMNTGVDSSCQTIIPKIKLEPHEVDQFLNFSPKEAPVDHLHLPPTPPSSHGSDSEGSLSPNPRLHPFSLPQTHSPSRAAPRAPSALSSSPLLTAPHKLQGSGPLVLTEEEKRTLIAEGYPIPTKLPLSKSEEKALKKIRRKIKNKISAQESRRKKKEYMDSLEKKVESCSTENLELRKKVEVLENTNRTLLQQLQKLQTLVMGKVSRTCKLAGTQTGTCLMVVVLCFAVAFGSFFQGYGPYPSATKMALPSQHSLQEPYTASVVRSRNLLIYEEHSPPEESSSPGSAGELGGWDRGSSLLRVSGLESRPDVDLPHFIISNETSLEKSVLLELQQHLVSAKLEGNETLKVVELDRRVNTTF

SEQ ID NO: 1117 - protein, 461 aa, unidentified
MNTDLAAGKMASAACSMDPIDSFELLDLLFDRQDGILRHVELGEGWGHVKDQQVLPNPDSDDFLSSILGSGDSLPSSPLWSPEGSDSGISEDLPSDPQDTPPRSGPATSPAGCHPAQPGKGPCLSYHPGNSCSTTTPGPVIQVPEASVTIDLEMWSPGGRICAEKPADPVDLSPRCNLTVKDLLLSGSSGDLQQHHLGASYLLRPGAGHCQELVLTEDEKKLLAKEGITLPTQLPLTKYEERVLKKIRRKIRNKQSAQESRKKKKEYIDGLETRMSACTAQNQELQRKVLHLEKQNLSLLEQLKKLQAIVVQSTSKSAQTGTCVAVLLLSFALIILPSISPFGPNKTESPGDFAPVRVFSRTLHNDAASRVAADAVPGSEAPGPRPEADTTREESPGSPGADWGFQDTANLTNSTEELDNATLVLRNATEGLGQVALLDWVAPGPSTGSGRAGLEAAGDEL

SEQ ID NO: 1118 - protein, 395 aa, unidentified
MDLGIPDLLDAWLEPPEDIFSTGSVLELGLHCPPPEVPVTRLQEQGLQGWKSGGDRGCGLQESEPEDFLKLFIDPNEVYCSEASPGSDSGISEDPCHPDSPPAPRATSSPMLYEVVYEAGALERMQGETGPNVGLISIQLDQWSPAFMVPDSCMVSELPFDAHAHILPRAGTVAPVPCTTLLPCQTLFLTDEEKRLLGQEGVSLPSHLPLTKAEERVLKKVRRKIRNKQSAQDSRRRKKEYIDGLESRVAACSAQNQELQKKVQELERHNISLVAQLRQLQTLIAQTSNKAAQTSTCVLILLFSLALIILPSFSPFQSRPEAGSEDYQPHGVTSRNILTHKDVTENLETQVVESRLREPPGAKDANGSTRTLLEKMGGKPRPSGRIRSVLHADEM

SEQ ID NO: 1119 - protein, 420 aa, unidentified
MAPWPPKGLVPAMLWGLSLFLNLPGPIWLQPSPPPQSSPPPQPHPCHTCRGLVDSFNKGLERTIRDNFGGGNTAWEEENLSKYKDSETRLVEVLEGVCSKSDFECHRLLELSEELVESWWFHKQQEAPDLFQWLCSDSLKLCCPAGTFGPSCLPCPGGTERPCGGYGQCEGEGTRGGSGHCDCQAGYGGEACGQCGLGYFEAERNASHLVCSACFGPCARCSGPEESNCLQCKKGWALHHLKCVDIDECGTEGANCGADQFCVNTEGSYECRDCAKACLGCMGAGPGRCKKCSPGYQQVGSKCLDVDECETEVCPGENKQCENTEGGYRCICAEGYKQMEGICVKEQIPESAGFFSEMTEDELVVLQQMFFGIIICALATLAAKGDLVFTAIFIGAVAAMTGYWLSERSDRVLEGFIKGR

SEQ ID NO: 1120 - protein, 444 aa, unidentified
MGGHPQLRLVKALLLLGLNPVSASLQDQHCESLSLASNISGLQCNASVDLIGTCWPRSPAGQLVVRPCPAFFYGVRYNTTNNGYRECLANGSWAARVNYSECQEILNEEKKSKVHYHVAVIINYLGHCISLVALLVAFVLFLRLRPGCTHWGDQADGALEVGAPWSGAPFQVRRSIRCLRNIIHWNLISAFILRNATWFVVQLTMSPEVHQSNVGWCRLVTAAYNYFHVTNFFWMFGEGCYLHTAIVLTYSTDRLRKWMFICIGWGVPFPIIVAWAIGKLYYDNEKCWFGKRPGVYTDYIYQGPMILVLLINFIFLFNIVRILMTKLRASTTSETIQYRKAVKATLVLLPLLGITYMLFFVNPGEDEVSRVVFIYFNSFLESFQGFFVSVFYCFLNSEVRSAIRKRWHRWQDKHSIRARVARAMSIPTSPTRVSFHSIKQSTAV

SEQ ID NO: 1121 - protein, 411 aa, unidentified
MDAALLHSLLEANCSLALAEELLLDGWGPPLDPEGPYSYCNTTLDQIGTCWPRSAAGALVERPCPEYFNGVKYNTTRNAYRECLENGTWASKINYSQCEPILDDKQRKYDLHYRIALVVNYLGHCVSVAALVAAFLLFLALRSIRCLRNVIHWNLITTFILRNVMWFLLQLVDHEVHESNEVWCRCITTIFNYFVVTNFFWMFVEGCYLHTAIVMTYSTERLRKCLFLFIGWCIPFPIIVAWAIGKLYYENEQCWFGKEPGDLVDYIYQGPIILVLLINFVFLFNIVRILMTKLRASTTSETIQYRKAVKATLVLLPLLGITYMLFFVNPGEDDLSQIMFIYFNSFLQSFQGFFVSVFYCFFNGEVRSAVRKRWHRWQDHHSLRVPMARAMSIPTSPTRISFHSIKQTAAV

SEQ ID NO: 1122 - protein, 1036 aa, unidentified
MYLVAGDRGLAGCGHLLVSLLGLLLLLARSGTRALVCLPCDESKCEEPRNCPGSIVQGVCGCCYTCASQRNESCGGTFGIYGTCDRGLRCVIRPPLNGDSLTEYEAGVCEDENWTDDQLLGFKPCNENLIAGCNIINGKCECNTIRTCSNPFEFPSQDMCLSALKRIEEEKPDCSKARCEVQFSPRCPEDSVLIEGYAPPGECCPLPSRCVCNPAGCLRKVCQPGNLNILVSKASGKPGECCDLYECKPVFGVDCRTVECPPVQQTACPPDSYETQVRLTADGCCTLPTRCECLSGLCGFPVCEVGSTPRIVSRGDGTPGKCCDVFECVNDTKPACVFNNVEYYDGDMFRMDNCRFCRCQGGVAICFTAQCGEINCERYYVPEGECCPVCEDPVYPFNNPAGCYANGLILAHGDRWREDDCTFCQCVNGERHCVATVCGQTCTNPVKVPGECCPVCEEPTIITVDPPACGELSNCTLTGKDCINGFKRDHNGCRTCQCINTEELCSERKQGCTLNCPFGFLTDAQNCEICECRPRPKKCRPIICDKYCPLGLLKNKHGCDICRCKKCPELSCSKICPLGFQQDSHGCLICKCREASASAGPPILSGTCLTVDGHHHKNEESWHDGCRECYCLNGREMCALITCPVPACGNPTIHPGQCCPSCADDFVVQKPELSTPSICHAPGGEYFVEGETWNIDSCTQCTCHSGRVLCETEVCPPLLCQNPSRTQDSCCPQCTDQPFRPSLSRNNSVPNYCKNDEGDIFLAAESWKPDVCTSCICIDSVISCFSESCPSVSCERPVLRKGQCCPYCIEDTIPKKVVCHFSGKAYADEERWDLDSCTHCYCLQGQTLCSTVSCPPLPCVEPINVEGSCCPMCPEMYVPEPTNIPIEKTNHRGEVDLEVPLWPTPSENDIVHLPRDMGHLQVDYRDNRLHPSEDSSLDSIASVVVPIIICLSIIIAFLFINQKKQWIPLLCWYRTPTKPSSLNNQLVSVDCKKGTRVQVDSSQRMLRIAEPDARFSGFYSMQKQNHLQADNFYQTV

SEQ ID NO: 1123 - protein, 371 aa, unidentified
MGRLVLLWGAAVFLLGGWMALGQGGAAEGVQIQIIYFNLETVQVTWNASKYSRTNLTFHYRFNGDEAYDQCTNYLLQEGHTSGCLLDAEQRDDILYFSIRNGTHPVFTASRWMVYYLKPSSPKHVRFSWHQDAVTVTCSDLSYGDLLYEVQYRSPFDTEWQSKQENTCNVTIEGLDAEKCYSFWVRVKAMEDVYGPDTYPSDWSEVTCWQRGEIRDACAETPTPPKPKLSKFILISSLAILLMVSLLLLSLWKLWRVKKFLIPSVPDPKSIFPGLFEIHQGNFQEWITDTQNVAHLHKMAGAEQESGPEEPLVVQLAKTEAESPRMLDPQTEEKEASGGSLQLPHQPLQGGDVVTIGGFTFVMNDRSYVAL

SEQ ID NO: 1124 - protein, 301 aa, unidentified
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLYENPWTIPNMLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAASLAAPVFNYADSIYLQILWCFTAFTTAASAYSYYHYGRKTVQVIKD

SEQ ID NO: 1125 - protein, 393 aa, unidentified
MWWRVLSLLAWFPLQEASLTNHTETITVEEGQTLTLKCVTSLRKNSSLQWLTPSGFTIFLNEYPALKNSKYQLLHHSANQLSITVPNVTLQDEGVYKCLHYSDSVSTKEVKVIVLATPFKPILEASVIRKQNGEEHVVLMCSTMRSKPPPQITWLLGNSMEVSGGTLHEFETDGKKCNTTSTLIIHTYGKNSTVDCIIRHRGLQGRKLVAPFRFEDLVTDEETASDALERNSLSSQDPQQPTSTVSVTEDSSTSEIDKEEKEQTTQDPDLTTEANPQYLGLARKKSGILLLTLVSFLIFILFIIVQLFIMKLRKAHVIWKKENEVSEHTLESYRSRSNNEETSSEEKNGQSSHPMRCMNYITKLYSEAKTKRKENVQHSKLEEKHIQVPESIV

SEQ ID NO: 1126 - protein, 175 aa, unidentified
MDIAIHHPWIRRPFFPFHSPSRLFDQFFGEHLLESDLFPTSTSLSPFYLRPPSFLRAPSWFDTGLSEMRLEKDRFSVNLDVKHFSPEELKVKVLGDVIEVHGKHEERQDEHGFISREFHRKYRIPADVDPLTITSSLSSDGVLTVNGPRKQVSGPERTIPITREEKPAVTAAPKK

SEQ ID NO: 1127 - protein, 466 aa, unidentified [sequence omitted]

SEQ ID NO: 1128 - protein, 554 aa, unidentified
MTAPGAAGRCPPTTWLGSLLLLVCLLASRSITEEVSEYCSHMIGSGHLQSLQRLIDSQMETSCQITFEFVDQEQLKDPVCYLKKAFLLVQDIMEDTMRFRDNTPNAIAIVQLQELSLRLKSCFTKDYEEHDKACVRTFYETPLQLLEKVKNVFNETKNLLDKDWNIFSKNCNNSFAECSSQDVVTKPDCNCLYPKAIPSSDPASVSPHQPLAPSMAPVAGLTWEDSEGTEGSSLLPGEQPLHTVDPGSAKQRPPRSTCQSFEPPETPVVKDSTIGGSPQPRPSVGAFNPGMEDILDSAMGTNWVPEEASGEASEIPVPQGTELSPSRPGGGSMQTEPARPSNFLSASSPLPASAKGQQPADVTGTALPRVGPVRPTGQDWNHTPQKTDHPSALLRDPPEPGSPRISSLRPQGLSNPSTLSAQPQLSRSHSSGSVLPLGELEGRRSTRDRRSPAEPEGGPASEGAARPLPRFNSVPLTDTGHERQSEGSFSPQLQESVFHLLVPSVILVLLAVGGLLFYRWRRRSHQEPQRADSPLEQPEGSPLTQDDRQVELPV

SEQ ID NO: 1129 - protein, 972 aa, unidentified
MGPGVLLLLLVATAWHGQGIPVIEPSVPELVVKPGATVTLRCVGNGSVEWDGPPSPHWTLYSDGSSSILSTNNATFQNTGTYRCTEPGDPLGGSAAIHLYVKDPARPWNVLAQEVVVFEDQDALLPCLLTDPVLEAGVSLVRVRGRPLMRHTNYSFSPWHGFTIHRAKFIQSQDYQCSALMGGRKVMSISIRLKVQKVIPGPPALTLVPAELVRIRGEAAQIVCSASSVDVNFDVFLQHNNTKLAIPQQSDFHNNRYQKVLTLNLDQVDFQHAGNYSCVASNVQGKHSTSMFFRVVESAYLNLSSEQNLIQEVTVGEGLNLKVMVEAYPGLQGFNWTYLGPFSDHQPEPKLANATTKDTYRHTFTLSLPRLKPSEAGRYSFLARNPGGWRALTFELTLRYPPEVSVIWTFINGSGTLLCAASGYPQPNVTWLQCSGHTDRCDEAQVLQVWDDPYPEVLSQEPFHKVTVQSLLTVETLEHNQTYECRAHNSVGSGSWAFIPISAGAHTHPPDEFLFTPVVVACMSIMALLLLLLLLLLYKYKQKPKYQVRWKIIESYEGNSYTFIDPTQLPYNEKWEFPRNNLQFGKTLGAGAFGKVVEATAFGLGKEDAVLKVAVKMLKSTAHADEKEALMSELKIMSHLGQHENIVNLLGACTHGGPVLVITEYCCYGDLLNFLRRKAEAMLGPSLSPGQDPEGGVDYKNIHLEKKYVRRDSGFSSQGVDTYVEMRPVSTSSNDSFSEQDLDKEDGRPLELRDLLHFSSQVAQGMAFLASKNCIHRDVAARNVLLTNGHVAKIGDFGLARDIMNDSNYIVKGNARLPVKWMAPESIFDCVYTVQSDVWSYGILLWEIFSLGLNPYPGILVNSKFYKLVKDGYQMAQPAFAPKNIYSIMQACWALEPTHRPTFQQICSFLQEQAQEDRRERDYTNLPSSSRSGGSGSSSSELEEESSSEHLTCCEQGDIAQPLLQPNNYQFC

SEQ ID NO: 1130 - protein, 400 aa, unidentified
MLLLVTSLLLCELPHPAFLLIPEKSDLRTVAPASSLNVRFDSRTMNLSWDCQENTTFSKCFLTDKKNRVVEPRLSNNECSCTFREICLHEGVTFEVHVNTSQRGFQQKLLYPNSGREGTAAQNFSCFIYNADLMNCTWARGPTAPRDVQYFLYIRNSKRRREIRCPYYIQDSGTHVGCHLDNLSGLTSRNYFLVNGTSREIGIQFFDSLLDTKKIERFNPPSNVTVRCNTTHCLVRWKQPRTYQKLSYLDFQYQLDVHRKNTQPGTENLLINVSGDLENRYNFPSSEPRAKHSVKIRAADVRILNWSSWSEAIEFGSDDGNLGSVYIYVLLIVGTLVCGIVLGFLFKRFLRIQRLFPPVPQIKDKLNDNHEVEDEIIWEEFTPEEGKGYREEVLTVKEIT

SEQ ID NO: 1131 - protein, 897 aa, unidentified
MVLAQGLLSMALLALCWERSLAGAEETIPLQTLRCYNDYTSHITCRWADTQDAQRLVNVTLIRRVNEDLLEPVSCDLSDDMPWSACPHPRCVPRRCVIPCQSFVVTDVDYFSFQPDRPLGTRLTVTLTQHVQPPEPRDLQISTDQDHFLLTWSVALGSPQSHWLSPGDLEFEVVYKRLQDSWEDAAILLSNTSQATLGPEHLMPSSTYVARVRTRLAPGSRLSGRPSKWSPEVCWDSQPGDEAQPQNLECFFDGAAVLSCSWEVRKEVASSVSFGLFYKPSPDAGEEECSPVLREGLGSLHTRHHCQIPVPDPATHGQYIVSVQPRRAEKHIKSSVNIQMAPPSLNVTKDGDSYSLRWETMKMRYEHIDHTFEIQYRKDTATWKDSKTETLQNAHSMALPALEPSTRYWARVRVRTSRTGYNGIWSEWSEARSWDTESVLPMWVLALIVIFLTIAVLLALRFCGIYGYRLRRKWEEKIPNPSKSHLFQNGSAELWPPGSMSAFTSGSPPHQGPWGSRFPELEGVFPVGFGDSEVSPLTIEDPKHVCDPPSGPDTTPAASDLPTEQPPSPQPGPPAASHTPEKQASSFDFNGPYLGPPHSRSLPDILGQPEPPQEGGSQKSPPPGSLEYLCLPAGGQVQLVPLAQAMGPGQAVEVERRPSQGAAGSPSLESGGGPAPPALGPRVGGQDQKDSPVAIPMSSGDTEDPGVASGYVSSADLVFTPNSGASSVSLVPSLGLPSDQTPSLCPGLASGPPGAPGPVKSGFEGYVELPPIEGRSPRSPRNNPVPPEAKSPVLNPGERPADVSPTSPQPEGLLVLQQVGDYCFLPGLGPGPLSLRSKPSSPGPGPEIKNLDQAFQVKKPPGQAVPQVPVIQLFKALKQQDYLSLPPWEVNKPGEVC

SEQ ID NO: 1132 - protein, 836 aa, unidentified
MARLGNCSLTWAALIILLLPGSLEECGHISVSAPIVHLGDPITASCIIKQNCSHLDPEPQILWRLGAELQPGGRQQRLSDGTQESIITLPHLNHTQAFLSCCLNWGNSLQILDQVELRAGYPPAIPHNLSCLMNLTTSSLICQWEPGPETHLPTSFTLKSFKSRGNCQTQGDSILDCVPKDGQSHCCIPRKHLLLYQNMGIWVQAENALGTSMSPQLCLDPMDVVKLEPPMLRTMDPSPEAAPPQAGCLQLCWEPWQPGLHINQKCELRHKPQRGEASWALVGPLPLEALQYELCGLLPATAYTLQIRCIRWPLPGHWSDWSPSLELRTTERAPTVRLDTWWRQRQLDPRTVQLFWKPVPLEEDSGRIQGYVVSWRPSGQAGAILPLCNTTELSCTFHLPSEAQEVALVAYNSAGTSRPTPVVFSESRGPALTRLHAMARDPHSLWVGWEPPNPWPQGYVIEWGLGPPSASNSNKTWRMEQNGRATGFLLKENIRPFQLYEIIVTPLYQDTMGPSQHVYAYSQEMAPSHAPELHLKHIGKTWAQLEWVPEPPELGKSPLTHYTIFWTNAQNQSFSAILNASSRGFVLHGLEPASLYHIHLMAASQAGATNSTVLTLMTLTPEGSELHIILGLFGLLLLLTCLCGTAWLCCSPNRKNPLWPSVPDPAHSSLGSWVPTIMEEDAFQLPGLGTPPITKLTVLEEDEKKPVPWESHNSSETCGLPTLVQTYVLQGDPRAVSTQPQSQSGTSDQVLYGQLLGSPTSPGPGHYLRCDSTQPLLAGLTPSPKSYENLWFQASPLGTLVTPAPSQEDDCVFGPLLNFPLLQGIRVHGMEALGSF

SEQ ID NO: 1133 - protein, 3426 aa, unidentified
VLPSHTCGNPGEILKGVLHGTRFNIGDKIRYSCLPGYILEGHAILTCIVSPGNGASWDFPAPFCRAEGACGGTLRGTSSSISSPHFPSEYENNADCTWTILAEPGDTIALVFTDFQLEEGYDFLEISGTEAPSIWLTGMNLPSPVISSKNWLRLHFTSDSNHRRKGFNAQFQVKKAIELKSRGVKMLPSKDGSHKNSVLSQGGVALVSDMCPDPGIPENGRRAGSDFRVGANVQFSCEDNYVLQGSKSITCQRVTETLAAWSDHRPICRARTCGSNLRGPSGVITSPNYPVQYEDNAHCVWVITTTDPDKVIKLAFEEFELERGYDTLTVGDAGKVGDTRSVLYVLTGSSVPDLIVSMSNQMWLHLQSDDSIGSPGFKAVYQEIEKGGCGDPGIPAYGKRTGSSFLHGDTLTFECPAAFELVGERVITCQQNNQWSGNKPSCVFSCFFNFTASSGIILSPNYPEEYGNNMNCVWLIISEPGSRIHLIFNDFDVEPQFDFLAVKDDGISDITVLGTFSGNEVPSQLASSGHIVRLEFQSDHSTTGRGFNITYTTFGQNECHDPGIPINGRRFGDRFLLGSSVSFHCDDGFVKTQGSESITCILQDGNVVWSSTVPRCEAPCGGHLTASSGVILPPGWPGYYKDSLHCEWIIEAKPGHSIKITFDRFQTEVNYDTLEVRDGPASSSPLIGEYHGTQAPQFLISTGNFMYLLFTTDNSRSSIGFLIHYESVTLESDSCLDPGIPVNGHRHGGDFGIRSTVTFSCDPGYTLSDDEPLVCERNHQWNHALPSCDALCGGYIQGKSGTVLSPGFPDFYPNSLNCTWTIEVSHGKGVQMIFHTFHLESSHDYLLITEDGSFSEPVARLTGSVLPHTIKAGLFGNFTAQLRFISDFSISYEGFNITFSEYDLEPCDDPGVPAFSRRIGFHFGVGDSLTFSCFLGYRLEGATKLTCLGGGRRVWSAPLPRCVAECGASVKGNEGTLLSPNFPSNYDNNHECIYKIETEAGKGIHLRTRSFQLFEGDTLKVYDGKDSSSRPLGTFTKNELLGLILNSTSNHLWLEFNTNGSDTDQGFQLTYTSFDLVKCEDPGIPNYGYRIRDEGHFTDTVVLYSCNPGYAMHGSNTLTCLSGDRRVWDKPLPSCIAECGGQIHAATSGRILSPGYPAPYDNNLHCTWIIEADPGKTISLHFIVFDTEMAHDILKVWDGPVDSDILLKEWSGSALPEDIHSTFNSLTLQFDSDFFISKSGFSIQFSTSIAATCNDPGMPQNGTRYGDSREAGDTVTFQCDPGYQLQGQAKITCVQLNNRFFWQPDPPTCIAACGGNLTGPAGVILSPNYPQPYPPGKECDWRVKVNPDFVIALIFKSFNMEPSYDFLHIYEGEDSNSPLIGSYQGSQAPERIESSGNSLFLAFRSDASVGLSGFAIEFKEKPREACFDPGNIMNGTRVGTDFKLGSTITYQCDSGYKILDPSSITCVIGADGKPSWDQVLPSCNAPCGGQYTGSEGVVLSPNYPHNYTAGQICLYSITVPKEFVVFGQFAYFQTALNDLAELFDGTHAQARLLSSLSGSHSGETLPLATSNQILLRFSAKSGASARGFHFVYQAVPRTSDTQCSSVPEPRYGRRIGSEFSAGSIVRFECNPGYLLQGSTALHCQSVPNALAQWNDTIPSCVVPCSGNFTQRRGTILSPGYPEPYGNNLNCIWKIIVTEGSGIQIQVISFATEQNWDSLEIHDGGDVTAPRLGSFSGTTVPALLNSTSNQLYLHFQSDISVAAAGFHLEYKTVGLAACQEPALPSNSIKIGDRYMVNDVLSFQCEPGYTLQGRSHISCMPGTVRRWNYPSPLCIATCGGTLSTLGGVILSPGFPGSYPNNLDCTWRISLPIGYGAHIQFLNFSTEANHDFLEIQNGPYHTSPMIGQFSGTDLPAALLSTTHETLIHFYSDHSQNRQGFKLAYQAYELQNCPDPPPFQNGYMINSDYSVGQSVSFECYPGYILIGHPVLTCQHGINRNWNYPFPRCDAPCGYNVTSQNGTIYSPGFPDEYPILKDCIWLITVPPGHGVYINFTLLQTEAVNDYIAVWDGPDQNSPQLGVFSGNTALETAYSSTNQVLLKFHSDFSNGGFFVLNFHAFQLKKCQPPPAVPQAEMLTEDDDFEIGDFVKYQCHPGYTLVGTDILTCKLSSQLQFEGSLPTCEAQCPANEVRTGSSGVILSPGYPGNYFNSQTCSWSIKVEPNYNITIFVDTFQSEKQFDALEVFDGSSGQSPLLVVLSGNHTEQSNFTSRSNQLYLRWSTDHATSKKGFKIRYAAPYCSLTHPLKNGGILNRTAGAVGSKVHYFCKPGYRMVGHSNATCRRNPLGMYQWDSLTPLCQAVSCGIPESPGNGSFTGNEFTLDSKVVYECHEGFKLESSQQATAVCQEDGLWSNKGKPPTCKPVACPSIEAQLSEHVIWRLVSGSLNEYGAQVLLSCSPGYYLEGWRLLRCQANGTWNIGDERPSCRVISCGSLSFPPNGNKIGTLTVYGATAIFTCNTGYTLVGSHVRECLANGLWSGSETRCLAGHCGSPDPIVNGHISGDGFSYRDTVVYQCNPGFRLVGTSVRICLQDHKWSGQTPVCVPITCGHPGNPAHGFTNGSEFNLNDVVNFTCNTGYLLQGVSRAQCRSNGQWSSPLPTCRVVNCSDPGFVENAIRHGQQNFPESFEYGMSILYHCKKGFYLLGSSALTCMANGLWDRSLPKCLAISCGHPGVPANAVLTGELFTYGAVVHYSCRGSESLIGNDTRVCQEDSHWSGALPHCTGNNPGFCGDPGTPAHGSRLGDDFKTKSLLRFSCEMGHQLRGSPERTCLLNGSWSGLQPVCEAVSCGNPGTPTNGMIVSSDGILFSSSVIYACWEGYKTSGLMTRHCTANGTWTGTAPDCTIISCGDPGTLANGIQFGTDFTFNKTVSYQCNPGYVMEAVTSATIRCTKDGRWNPSKPVCKAVLCPQPPPVQNGTVEGSDFRWGSSISYSCMDGYQLSHSAILSCEGRGVWKGEIPQCLPVFCGDPGIPAEGRLSGKSFTYKSEVFFQCKSPFILVGSSRRVCQADGTWSGIQPTCIDPAHNTCPDPGTPHFGIQNSSRGYEVGSTVFFRCRKGYHIQGSTTRTCLANLTWSGIQTECIPHACRQPETPAHADVRAIDLPTFGYTLVYTCHPGFFLAGGSEHRTCKADMKWTGKSPVCKSKGVREVNETVTKTPVPSDVFFVNSLWKGYYEYLGKRQPATLTVDWFNATSSKVNATFSEASPVELKLTGIYKKEEAHLLLKAFQIKGQADIFVSKFENDNWGLDGYVSSGLERGGFTFQGDIHGKDFGKFKLERQDPLNPDQDSSSHYHGTSSGSVAAAILVPFFALILSGFAFYLYKHRTRPKVQYNGYAGHENSNGQASFENPMYDTNLKPTEAKAVRFDTTLNTVCTVV

SEQ ID NO: 1134 - protein, 3487 aa, unidentified
MRLISIAPGPRWQVQSHHPRSAGQNCTFQLHGPNGTVESPGFPYGYPNYANCTWTITAEEQHRIQLVFQSFALEEDFDVLSVFDGPPQPENLRTRLTGFQLPATIVSAATTLSLRLISDYAVSAQGFHATYEVLPSHTCGNPGRLPNGIQQGSTFNLGDKVRYSCNLGFFLEGHAVLTCHAGSENSATWDFPLPSCRADDACGGTLRGQSGIISSPHFPSEYHNNADCTWTILAELGDTIALVFIDFQLEDGYDFLEVTGTEGSSLWFTGASLPAPVISSKNWLRLHFTSDGNHRQRGFSAQYQVKKQIELKSRGVKLMPSKDNSQKTSVLTQVGVSQGHNMCPDPGIPERGKRLGSDFRLGSSVQFTCNEGYDLQGSKRITCMKVSDMFAAWSDHRPVCRARMCDAHLRGPSGIITSPNFPIQYDNNAHCVWIITALNPSKVIKLAFEEFDLERGYDTLTVGDGGQDGDQKTVLYILTGTSVPDLIVSTNHQMWLLFQTDGSGSSLGFKASYEEIEQGSCGDPGIPAYGRREGSRFHHGDTLKFECQPAFELVGQKAITCQKNNQWSAKKPGCVFSCFFNFTSPSGVVLSPNYPEDYGNHLHCVWLILARPESRIHLAFNDIDVEPQFDFLVIKDGATAEAPVLGTFSGNQLPSSITSSGHVARLEFQTDHSTGKRGFNITFTTFRHNECPDPGVPVNGKRFGDSLQLGSSISFLCDEGFLGTQGSETITCVLKEGSVVWNSAVLRCEAPCGGHLTSPSGTILSPGWPGFYKDALSCAWVIEAQPGYPIKITFDRFKTEVNYDTLEVRDGRTYSAPLIGVYHGTQVPQFLISTSNYLYLLFSTDKSHSDIGFQLRYETITLQSDHCLDPGIPVNGQRHGNDFYVGALVTFSCDSGYTLSDGEPLECEPNFQWSRALPSCEALCGGFIQGSSGTILSPGFPDFYPNNLNCTWIIETSHGKGVFFTFHTFHLESGHDYLLITENGSFTQPLRQLTGSRLPAPISAGLYGNFTAQVRFISDFSMSYEGFNITFSEYDLEPCEEPEVPAYSIRKGLQFGVGDTLTFSCFPGYRLEGTARITCLGGRRRLWSSPLPRCVAECGNSVTGTQGTLLSPNFPVNYNNNHECIYSIQTQPGKGIQLKARAFELSEGDVLKVYDGNNNSARLLGVFSHSEMMGVTLNSTSSSLWLDFITDAENTSKGFELHFSSFELIKCEDPGTPKFGYKVHDEGHFAGSSVSFSCDPGYSLRGSEELLCLSGERRTWDRPLPTCVAECGGTVRGEVSGQVLSPGYPAPYEHNLNCIWTIEAEAGCTIGLHFLVFDTEEVHDVLRIWDGPVESGVLLKELSGPALPKDLHSTFNSVVLQFSTDFFTSKQGFAIQFSVSTATSCNDPGIPQNGSRSGDSWEAGDSTVFQCDPGYALQGSAEISCVKIENRFFWQPSPPTCIAPCGGDLTGPSGVILSPNYPEPYPPGKECDWKVTVSPDYVIALVFNIFNLEPGYDFLHIYDGRDSLSPLIGSFYGSQLPGRIESSSNSLFLAFRSDASVSNAGFVIDYTENPRESCFDPGSIKNGTRVGSDLKLGSSVTYYCHGGYEVEGTSTLSCILGPDGKPVWNNPRPVCTAPCGGQYVGSDGVVLSPNYPQNYTSGQICLYFVTVPKDYVVFGQFAFFHTALNDVVEVHDGHSQHSRLLSSLSGSHTGESLPLATSNQVLIKFSAKGLAPARGFHFVYQAVPRTSATQCSSVPEPRYGKRLGSDFSVGAIVRFECNSGYALQGSPEIECLPVPGALAQWNVSAPTCVVPCGGNLTERRGTILSPGFPEPYLNSLNCVWKIVVPEGAGIQIQVVSFVTEQNWDSLEVFDGADNTVTMLGSFSGTTVPALLNSTSNQLYLHFYSDISVSAAGFHLEYKTVGLSSCPEPAVPSNGVKTGERYLVNDVVSFQCEPGYALQGHAHISCMPGTVRRWNYPPPLCIAQCGGTVEEMEGVILSPGFPGNYPSNMDCSWKIALPVGFGAHIQFLNFSTEPNHDYIEIRNGPYETSRMMGRFSGSELPSSLLSTSHETTVYFHSDHSQNRPGFKLEYQDLTYSHQISSFLRGFDLSELERTNSTPPVAASYVWDLDPGCEAYELQECPDPEPFANGIVRGAGYNVGQSVTFECLPGYQLTGHPVLTCQHGTNRNWDHPLPKCEVPCGGNITSSNGTVYSPGFPSPYSSSQDCVWLITVPIGHGVRLNLSLLQTEPSGDFITIWDGPQQTAPRLGVFTRSMAKKTVQSSSNQVLLKFHRDAATGGIFAIAFSAYPLTKCPPPTILPNAEVVTENEEFNIGDIVRYRCLPGFTLVGNEILTCKLGTYLQFEGPPPICEVHCPTNELLTDSTGVILSQSYPGSYPQFQTCSWLVRVEPDYNISLTVEYFLSEKQYDEFEIFDGPSGQSPLLKALSGNYSAPLIVTSSSNSVYLRWSSDHAYNRKGFKIRYSAPYCSLPRAPLHGFILGQTSTQPGGSIHFGCNAGYRLVGHSMAICTRHPQGYHLWSEAIPLCQALSCGLPEAPKNGMVFGKEYTVGTKAMYSCSEGYHLQAGAEATAECLDTGLWSNRNVPPQCVPVTCPDVSSISVEHGRWRLIFETQYQFQAQLMLICDPGYYYTGQRVIRCQANGKWSLGDSTPTCRIISCGELPIPPNGHRIGTLSVYGATAIFSCNSGYTLVGSRVRECMANGLWSGSEVRCLAGHCGTPEPIVNGHINGENYSYRGSVVYQCNAGFRLIGMSVRICQQDHHWSGKTPFCVLVSCGHPGSPPHSQMSGDSYTVGAVVRYSCIGKRTLVGNSTRMCGLDGHWTGSLPHCSGTSVGVCGDPGIPAHGIRLGDSFDPGTVMRFSCEAGHVLRGSSERTCQANGSWSGSQPECGVISCGNPGTPSNARVVFSDGLVFSSSIVYECREGYYATGLLSRHCSVNGTWTGSDPECLVINCGDPGIPANGLRLGNDFRYNKTVTYQCVPGYMMESHRVSVLSCTKDRTWNGTKPVCKALMCKPPPLIPNGKVVGSDFMWGSSVTYACLEGYQLSLPAVFTCEGNGSWTGELPQCFPVFCGDPGVPSRGRREDRGFSYRSSVSFSCHPPLVLVGSPRRFCQSDGTWSGTQPSCIDPTLTTCADPGVPQFGIQNNSQGYQVGSTVLFRCQKGYLLQGSTTRTCLPNLTWSGTPPDCVPHHCRQPETPTHANVGALDLPSMGYTLIYSCQEGFSLKGGSEHRTCKADGSWTGKPPICLEVRPSGRPINTAREPPLTQALIPGDVFAKNSLWKGAYEYQGKKQPAMLRVTGFQVANSKVNATMIDHSGVELHLAGTYKKEDFHLLLQVYQITGPVEIFMNKFKDDHWALDGHVSSESSGATFIYQGSVKGQGFGQFGFQRLDLRLLESDPESIGRHFASNSSSVAAAILVPFIALIIAGFVLYLYKHRRRPKVPFNGYAGHENTNVRATFENPMYDRNIQPTDIMASEAEFTVSTVCTAV

SEQ ID NO: 1135 - protein, 3707 aa, unidentified
MKGIRKGESRAKESKPWEPGKRRCAKCGRLDFILMKKMGIKSGFTFWNLVFLLTVSCVKGFIYTCGGTLKGLNGTIESPGFPYGYPNGANCTWVIIAEERNRIQIVFQSFALEEEYDYLSLYDGHPHPTNFRTRLTGFHLPPPVTSTKSVFSLRLTSDFAVSAHGFKVYYEELQSSSCGNPGVPPKGVLYGTRFDVGDKIRYSCVTGYILDGHPQLTCIANSVNTASWDFPVPICRAEDACGGTMRGSSGIISSPSFPNEYHNNADCTWTIVAEPGDTISLIFTDFQMEEKYDYLEIEGSEPPTIWLSGMNIPPPIISNKNWLRLHFVTDSNHRYRGFSAPYQGSSTLTHTTSTGELEEHNRTTTGAIAVASTPADVTVSSVTAVTIHRLSEEQRVQVTSLRNSGLDPNTSKDGLSPHPADTQSTRRRPRHAEQIERTKELAVVTHRVKKAIDFKSRGFKLFPGKDNSNKFSILNEGGIKTASNLCPDPGEPENGKRIGSDFSLGSTVQFSCDEDYVLQGAKSITCQRIAEVFAAWSDHRPVCKVKTCGSNLQGPSGTFTSPNFPFQYDSNAQCVWVITAVNTNKVIQINFEEFDLEIGYDTLTIGDGGEVGDPRTVLQVLTGSFVPDLIVSMSSQMWLHLQTDESVGSVGFKVNYKEIEKESCGDPGTPLYGIREGDGFSNRDVLRFECQFGFELIGEKSIVCQENNQWSANIPICIFPCLSNFTAPMGTVLSPDYPEGYGNNLNCIWTIISDPGSRIHLSFNDFDLESQFDFLAVKDGDSPESPILGTFTGAEVPSHLTSNSHILRLEFQADHSMSGRGFNITYNTFGHNECPDPGIPINARRFGDNFQLGSSISVICEEGFIKTQGTETITCILMDGKVMWSGLIPKCGAPCGGHFSAPSGVILSPGWPGYYKDSLNCEWVIEAEPGHSIKITFERFQTELNYDVLEVHDGPNLLSPLLGSYNGTQVPQFLFSSSNFIYLLFTTDNSRSNNGFKIHYESVTVNTYSCLDPGIPVHGRRYGHDFSIGSTVSFSCDSGYRLSHEEPLLCEKNHWWSHPLPTCDALCGGDVRGPSGTILSPGYPEFYPNSLNCTWTVDVTHGKGVQFNFHTFHLEDHHDYLLITENGSFTQPLARLTGSDLPPTINAGLYGNFRAQLRFISDFSISYEGFNITFSEYNLEPCEDPGIPQYGSRIGFNFGIGDTLTFSCSSGYRLEGTSEIICLGGGRRVWSAPLPRCVAECGASATNNEGILLSPNYPLNYENNHECIYSIQVQAGKGINISARTFHLAQGDVLKIYDGKDKTTHLLGAFTGASMRGLTLSSTSNQLWLEFNSDTEGTDEGFQLVYTSFELSHCEDPGIPQFGYKISDQGHFAGSTIIYGCNPGYTLHGSSLLKCMTGERRAWDYPLPSCIAECGGRFKGESSGRILSPGYPFPYDNNLRCMWMIEVDPGNIVSLQFLAFDTEASHDILRVWDGPPENDMLLKEISGSLIPEGIHSTLNIVTIQFDTDFYISKSGFAIQFSSSVATACRDPGVPMNGTRNGDGREPGDTVVFQCDPGYELQGEERITCIQVENRYFWQPSPPVCIAPCGGNLTGSSGFILSPNFPHPYPHSRDCDWTITVNADYVISLAFISFSIEPNYDFLYIYDGPDSNSPLIGSFQDSKLPERIESSSNTMHLAFRSDGSVSYTGFHLEYKAKLRESCFDPGNIMNGTRLGMDYKLGSTVTYYCDAGYVLQGYSTLTCIMGDDGRPGWNRALPSCHAPCGSRSTGSEGTVLSPNYPKNYSVGHNCVYSIAVPKEFVVFGQFVFFQTSLHDVVEVYDGPTQQSSLLSSLSGSHSGESLPLSSGNQITIRFTSVGPITAKGFHFVYQAVPRTSSTQCSSVPEPRFGRRIGNEFAVGSSVLFDCNPGYILHGSIAIRCETVPNSLAQWNDSLPTCIVPCGGILTKRKGTILSPGYPEPYDNNLNCVWKITVPEGAGIQVQVVSFATEHNWDSLDFYDGGDNNAPRLGSYSGTTIPHLLNSTSNNLYLNFQSDISVSAAGFHLEYTAIGLDSCPEPQTPSSGIKIGDRYMVGDVVSFQCDQGYSLQGHSHITCMPGPVRRWNYPIPICLAQCGGAMSDFSGVILSPGFPGNYPSSLDCTWTINLPIGFGVHLQFVNFSTETIHDYLEVRSGSSETSTVIGRLSGPQIPSSLFSTTHETSLYFHSDYSQNKQGFHIVYQAYQLQSCPDPRPFRNGFVIGNDFTVGQTISFECFPGYTLIGNSALTCLHGVSRNWNHPLPRCEALCGGNITAMNGTIYSPGYPDEYPNFQDCFWLVRVPPGNGIYINFTVLQTEPIYDFITVWDGPDQNSPQIGQFSGNTALESVYSTSNQILIKFHSDFTTSGFFVLSYHAYQLRVCQPPPPVPNAEILTEDDEFEIGDIIRYQCLPGFTLVGNAILTCRLGERLQMDGAPPVCQVLCPANELRLDSTGVILSPGYPDSYPNLQMCAWSISVEKGYNITMFVEFFQTEKEFDVLQVYDGPNIQSPVLISLSGDYSSAFNITSNGHEVFLQWSADHGNNKKGFRIRYIAFYCSTPESPPHGYIISQTGGQLNSVVRWACDRGFRLVGKSSAVCRKSSYGYHAWDAPVPACQAISCGIPKAPTNGGILTTDYLVGTRVTYFCNDGYRLSSKELTTAVCQSDGTWSNHNKTPRCVVVTCPSINSFILEHGRWRIVNGSHYEYKTKVVFSCDPGYHGLGPASIECLPNGTWSWRNERPYCQIISCGELPTPPNGNKIGTQTSYGSTAIFTCDLGFMLVGSAVRECLSSGLWSESETRCLAGHCGIPELIVNGQVIGENYGYRDTVVYQCNPGFRLIGSSVRICQQDHNWSGQLPSCVPVSCGHPGSPIYGRTSGNGFNFNDVVTFSCNIGYLMQGPTKAQCQANRQWSHPPPMCKVVNCSDPGIPANSKRESKIEHGNFTYGTVVFYDCNPGYFLFGSSVLICQPNGQWDKPLPECIMIDCGHPGVPPNAVLSGEKYTFGSTVHYSCTGKRSLLGQSSRTCQLNGHWSGSQPHCSGDATGTCGDPGTPGHGSRQESNFRTKSTVRYACDTGYILHGSEERTCLANGSWTGRQPECKAVQCGNPGTTANGKVFRIDGTTFSSSVIYSCMEGYILSGPSVRQCTANGTWSGTLPNCTIISCGDPGIPANGLRYGDDYVVGQNVSYMCQPGYTMELNGSRIRTCTINGTWSGVMPTCRAVTCPTPPQISNGRLEGTNFDWGFSISYICSPGYELSFPAVLTCVGNGTWSGEVPQCLPKFCGDPGIPAQGKREGKSFIYQSEVSFSCNFPFILVGSSTRICQADGTWSGSSPHCIEPTQTSCENPGVPRHGSQNNTFGFQVGSVVQFHCKKGHLLQGSTTRTCLPDLTWSGIQPECIPHSCKQPETPAHANVVGMDLPSHGYTLIYTCQPGFFLAGGTEHRVCRSDNTWTGKVPICEAGSKILVKDPRPALGTPSPKLSVPDDVFAQNYIWKGSYNFKGRKQPMTLTVTSFNASTGRVNATLSNSNMELLLSGVYKSQEARLMLRIYLIKVPAHASVKKMKEENWAMDGFVSAEPDGATYVFQGFIQGKDYGQFGLQRLGLNMSEGSNSSNQPHGTNSSSVAIAILVPFFALIFAGFGFYLYKQRTAPKTQYTGCSVHENNNGQAAFENPMYDTNAKSVEGKAVRFDPNLNTVCTMV

SEQ ID NO: 1136 - protein, 422 aa, unidentified
MDHPSREKDERQRTTKPMAQRSAHCSRPSGSSSSSGVLMVGPNFRVGKKIGCGNFGELRLGKNLYTNEYVAIKLEPIKSRAPQLHLEYRFYKQLGSAGEGLPQVYYFGPCGKYNAMVLELLGPSLEDLFDLCDRTFTLKTVLMIAIQLLSRMEYVHSKNLIYRDVKPENFLIGRQGNKKEHVIHIIDFGLAKEYIDPETKKHIPYREHKSLTGTARYMSINTHLGKEQSRRDDLEALGHMFMYFLRGSLPWQGLKADTLKERYQKIGDTKRNTPIEALCENFPEEMATYLRYVRRLDFFEKPDYEYLRTLFTDLFEKKGYTFDYAYDWVGRPIPTPVGSVHVDSGASAITRESHTHRDRPSQQQPLRNQVVSSTNGELNVDDPTGAHSNAPITAHAEVEVVEEAKCCCFFKRKRKKTAQRHK

SEQ ID NO: 1137 - protein, 2322 aa, unidentified
MQSGPRPPLPAPGLALALTLTMLARLASAASFFGENHLEVPVATALTDIDLQLQFSTSQPEALLLLAAGPADHLLLQLYSGRLQVRLVLGQEELRLQTPAETLLSDSIPHTVVLTVVEGWATLSVDGFLNASSAVPGAPLEVPYGLFVGGTGTLGLPYLRGTSRPLRGCLHAATLNGRSLLRPLTPDVHEGCAEEFSASDDVALGFSGPHSLAAFPAWGTQDEGTLEFTLTTQSRQAPLAFQAGGRRGDFIYVDIFEGHLRAVVEKGQGTVLLHNSVPVADGQPHEVSVHINAHRLEISVDQYPTHTSNRGVLSYLEPRGSLLLGGLDAEASRHLQEHRLGLTPEATNASLLGCMEDLSVNGQRRGLREALLTRNMAAGCRLEEEEYEDDAYGHYEAFSTLAPEAWPAMELPEPCVPEPGLPPVFANFTQLLTISPLVVAEGGTAWLEWRHVQPTLDLMEAELRKSQVLFSVTRGARHGELELDIPGAQARKMFTLLDVVNRKARFIHDGSEDTSDQLVLEVSVTARVPMPSCLRRGQTYLLPIQVNPVNDPPHIIFPHGSLMVILEHTQKPLGPEVFQAYDPDSACEGLTFQVLGTSSGLPVERRDQPGEPATEFSCRELEAGSLVYVHRGGPAQDLTFRVSDGLQASPPATLKVVAIRPAIQIHRSTGLRLAQGSAMPILPANLSVETNAVGQDVSVLFRVTGALQFGELQKQGAGGVEGAEWWATQAFHQRDVEQGRVRYLSTDPQHHAYDTVENLALEVQVGQEILSNLSFPVTIQRATVWMLRLEPLHTQNTQQETLTTAHLEATLEEAGPSPPTFHYEVVQAPRKGNLQLQGTRLSDGQGFTQDDIQAGRVTYGATARASEAVEDTFRFRVTAPPYFSPLYTFPIHIGGDPDAPVLTNVLLVVPEGGEGVLSADHLFVKSLNSASYLYEVMERPRHGRLAWRGTQDKTTMVTSFTNEDLLRGRLVYQHDDSETTEDDIPFVATRQGESSGDMAWEEVRGVFRVAIQPVNDHAPVQTISRIFHVARGGRRLLTTDDVAFSDADSGFADAQLVLTRKDLLFGSIVAVDEPTRPIYRFTQEDLRKRRVLFVHSGADRGWIQLQVSDGQHQATALLEVQASEPYLRVANGSSLVVPQGGQGTIDTAVLHLDTNLDIRSGDEVHYHVTAGPRWGQLVRAGQPATAFSQQDLLDGAVLYSHNGSLSPRDTMAFSVEAGPVHTDATLQVTIALEGPLAPLKLVRHKKIYVFQGEAAEIRRDQLEAAQEAVPPADIVFSVKSPPSAGYLVMVSRGALADEPPSLDPVQSFSQEAVDTGRVLYLHSRPEAWSDAFSLDVASGLGAPLEGVLVELEVLPAAIPLEAQNFSVPEGGSLTLAPPLLRVSGPYFPTLLGLSLQVLEPPQHGALQKEDGPQARTLSAFSWRMVEEQLIRYVHDGSETLTDSFVLMANASEMDRQSHPVAFTVTVLPVNDQPPILTTNTGLQMWEGATAPIPAEALRSTDGDSGSEDLVYTIEQPSNGRVVLRGAPGTEVRSFTQAQLDGGLVLFSHRGTLDGGFRFRLSDGEHTSPGHFFRVTAQKQVLLSLKGSQTLTVCPGSVQPLSSQTLRASSSAGTDPQLLLYRVVRGPQLGRLFHAQQDSTGEALVNFTQAEVYAGNILYEHEMPPEPFWEAHDTLELQLSSPPARDVAATLAVAVSFEAACPQRPSHLWKNKGLWVPEGQRARITVAALDASNLLASVPSPQRSEHDVLFQVTQFPSRGQLLVSEEPLHAGQPHFLQSQLAAGQLVYAHGGGGTQQDGFHFRAHLQGPAGASVAGPQTSEAFAITVRDVNERPPQPQASVPLRLTRGSRAPISRAQLSVVDPDSAPGEIEYEVQRAPHNGFLSLVGGGLGPVTRFTQADVDSGRLAFVANGSSVAGIFQLSMSDGASPPLPMSLAVDILPSAIEVQLRAPLEVPQALGRSSLSQQQLRVVSDREEPEAAYRLIQGPQYGHLLVGGRPTSAFSQFQIDQGEVVFAFTNFSSSHDHFRVLALARGVNASAVVNVTVRALLHVWAGGPWPQGATLRLDPTVLDAGELANRTGSVPRFRLLEGPRHGRVVRVPRARTEPGGSQLVEQFTQQDLEDGRLGLEVGRPEGRAPGPAGDSLTLELWAQGVPPAVASLDFATEPYNAARPYSVALLSVPEAARTEAGKPESSTPTGEPGPMASSPEPAVAKGGFLSFLEANMFSVIIPMCLVLLLLALILPLLFYLRKRNKTGKHDVQVLTAKPRNGLAGDTETFRKVEPGQAIPLTAVPGQGPPPGGQPDPELLQFCRTPNPALKNGQYWV

SEQ ID NO: 1138 - protein, 566 aa, unidentified
MGRAGGGGPGRGPPPLLLFLGAALVLASGAVPAREAGSAVEAEELVKGSPAWEPPANDTREEAGPPAAGEDEASWTAPGGELAGPEEVLQESAAVTGTAWLEADSPGLGGVTAEAGSGDAQALPATLQAPHEVLGQSIMPPAIPEATEASGPPSPTPGDKLSPASELPKESPLEVWLNLGGSTPDPQGPELTYPFQGTLEPQPASDIIDIDYFEGLDGEGRGADLGSFPGSPGTSENHPDTEGETPSWSLLDLYDDFTPFDESDFYPTTSFYDDLDEEEEEEEDDKDAVGGGDLEDENELLVPTGKPGLGPGTGQPTSRWHAVPPQHTLGSVPGSSIALRPRPGEPGRDLASSENGTECRSGFVRHNGSCRSVCDLFPSYCHNGGQCYLVENIGAFCRCNTQDYIWHKGMRCESIITDFQVMCVAVGSAALVLLLLFMMTVFFAKKLYLLKTENTKLRRTNKFRTPSELHNDNFSLSTIAEGSHPNVRKLCNTPRTSSPHARALAHYDNVICQDDPSAPHKIQEVLKSCLKEEESFNIQNSMSPKLEGGKGDQADLDVNCLQNNLT

SEQ ID NO: 1139 - protein, 745 aa, unidentified
MRPDSHPYGFPWELVIRAAVAGFFAVLFLWRSFRSVTSRLYVRREKKFAVALSGLIEEKCKLLEKFSLVQKEYEGYEVESSLKNASFEKEATEAQSLEATCEKLNRFNSELVHEILCLEKELKEEKSKHSEQNELMADISKRIQSLEDESKSLKSQVAEAKMTFKRFQANEERLEIEIQDAWKENSELQESQKQLLQEAEVWKEQVSELIKQKRTFEDSKVHAEQVLNDKENHIKTLTERLLKMKDGVAMLEEDVTDDDNLELEMNSESEDGAYLDNPPKGALKKLIHAAKLNASLKTLEGERNQIYIQLSEVDKTKEELTEHIKNLQTEQASLQSENTHFESENQKLQQKLKVMTELYQENEMKLYRKLIVEEKCRLEKEEKLSKVDEMISHATEELETYRKRAKDLKEFEKTIHFYQKKIILHEKKAHDNWSAAWTAERNLNDLRKENAHNRQKLTEIEFKIKLLEKDPYGLDVPNTAFGRQHSPYGPSPLGWPSSETRASLYPPTLLEGPLRLSPLLPRGGGRGSRGPGNPPDHQITKERGESSCDRLTDPHRAPSDAGPLAPPWEQDYRMMFPPPGQSYPDSALPPQRQDRFYSNCARLSGPAELRSFNMPSLDKMDGSMPSEMESSRNDTKDNLGNLKVPDSSLPAENEATGPGFVPPPLAPIRGLLFPVDTRGPFIRRGPPFPPPPPGTVFGASPDYFSPRDVPGPPRAPFAMRNVYLPRGFLPYRPPRPAFFPPAPTF

SEQ ID NO: 1140 - protein, 777 aa, unidentified
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGEVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISRATEGLETYRKLAKDLEEELERTVHFYQKQVISYEKRGHDNWLAARTAERNLSDLRKENAHNKQKLTETELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGLIPPPLAPISGPLFPVDTRGPFMRRGPPFPPPPPGTMFGASRGYFPPRDFPGPPHAPFAMRNIYPPRGLPPYLHPRPGFYPNPTF

SEQ ID NO: 1141 - protein, 777 aa, unidentified
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGEVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQESLQSENIYFESENQKLQQKLKIMTEFYQEDEMKLYRKLTVEENYRIEEEEKLSKVEEKLSRATEQLETYRKLAKDLEEELERTVHFYQKQVISYEKRGHDNWLAARTAERNLSDLRKENAHNKQKLTETELKFELLEKDPNALDVSNTAFGREHAPNGPAPLGQRSSETRAFLSPQTLLEDPLGLSPVLPEGGGRGPRGPGNPLDHQITNERGEPSCDRLTDPHRAPSDTGSLSSPVEQDCKMMFPPPGQSYPDSALPPQREDRFYSNSERLSGSAEPRSFKMTSLDKMDGSMPSEMESSRNDAKDDLGNLNVPDSSLPAENEATGPGFIPPPLAPVRGPLFPVDTRGPFMRRGPPFPPPPPGTMFGASRGYFPPRDFPGPPHAPFAMRNIYPPRGLPPYFHPRPGFYPNPAF

SEQ ID NO: 1142 - protein, 777 aa, unidentified
MEEPGATPQPYLGLVLEELRRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLNRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELEVNSQWENGANLDDPLKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISRATEGLETYRKLAKDLEEELERTVHFYQKQVISYEKRGHDNWLAARTAERNLSDLRKENAHNKQKLTETELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGFIPPPLAPVRGPLFPVDTRGPFMRRGPPFPPPPPGTMFGASRGYFPPRDFPGPPHAPFAMRNIYPPRGLPPYLHPRPGFYPNPTF

SEQ ID NO: 1143 - protein, 777 aa, unidentified
MEEPGATPQPYLGLVLEELGRVVAALPESMRPDENPYGFPSELVVCAAVIGFFVVLLFLWRSFRSVRSRLYVGREQKLGATLSGLIEEKCKLLEKFSLIQKEYEGYEVESSLEDASFEKAAAEEARSLEATCEKLSRSNSELEDEILCLEKDLKEEKSKHSQQDELMADISKSIQSLEDESKSLKSQIAEAKIICKTFKMSEERRAIAIKDALNENSQLQTSHKQLFQQEAEVWKGQVSELNKQKITFEDSKVHAEQVLNDKENHIKTLTGHLPMMKDQAAVLEEDTTDDDNLELKVNSQWENGANLDDPPKGALKKLIHAAKLNVSLKSLEGERNHIIIQLSEVDKTKEELTEHIKNLQTQQASLQSENIYFESENQKLQQKLKIMTEFYQENEMKLYRKLTVEENYRIEEEEKLSRVEEKISHATEELETYRKLAKDLEEELERTVHFYQKQVISYEKRGHDNWLAARTAERNLSDLRKENAHNKQKLTERELKFELLEKDPNALDVSNTAFGREHSPCSPSPLGRPSSETRAFPSPQTLLEDPLRLSPVLPGGGGRGPSSPGNPLDHQITNERGEPSYDRLIDPHRAPSDTGSLSSPVEQDRRMMFPPPGQSYPDSTLPPQREDRFYSNSERLSGPAEPRSFKMTSLDKMDRSMPSEMESSRNDAKDDLGNLNVPDSSLPAENEATGPGLIPPPLAPISGPLFPVDTRGPFMRRGPPFPPPPPGTMFGASRGYFPPRDFPGPPHAPFAMRNIYPPRGLPPYLHPRPGFYPNPTF

SEQ ID NO: 1144 - protein, 663 aa, unidentified
MAATEISVLSEQFTKIKELELMPEKGLKEEEKDGVCREKDHRSPSELEAERTSGAFQDSVLEEEVELVLAPSEESEKYILTLQTVHFTSEAVELQDMSLLSIQQQEGVQVVVQQPGPGLLWLEEGPRQSLQQCVAISIQQELYSPQEMEVLQFHALEENVMVASEDSKLAVSLAETTGLIKLEEEQEKNQLLAERTKEQLFFVETMSGDERSDEIVLTVSNSNVEEQEDQPTAGQADAEKAKSTKNQRKTKGAKGTFHCDVCMFTSSRMSSFNRHMKTHTSEKPHLCHLCLKTFRTVTLLRNHVNTHTGTRPYKCNDCNMAFVTSGELVRHRRYKHTHEKPFKCSMCKYASVEASKLKRHVRSHTGERPFQCCQCSYASRDTYKLKRHMRTHSGEKPYECHICHTRFTQSGTMKIHILQKHGENVPKYQCPHCATIIARKSDLRVHMRNLHAYSAAELKCRYCSAVFHERYALIQHQKTHKNEKRFKCKHCSYACKQERHMTAHIRTHTGEKPFTCLSCNKCFRQKQLLNAHFRKYHDANFIPTVYKCSKCGKGFSRWINLHRHSEKCGSGEAKSAASGKGRRTRKRKQTILKEATKGQKEAAKGWKEAANGDEAAAEEASTTKGEQFPGEMFPVACRETTARVKEEVDEGVTCEMLLNTMDK

SEQ ID NO: 1145 - protein, 244 aa, unidentified
MMRTQCLLGLRTFVAFAAKLWSFFIYLLRRQIRTVIQYQTVRYDILPLSPVSRNRLAQVKRKILVLDLDETLIHSHHDGVLRPTVRPGTPPDFILKVVIDKHPVRFFVHKRPHVDFFLEVVSQWYELVVFTASMEIYGSAVADKLDNSRSILKRRYYRQHCTLELGSYIKDLSVVHSDLSSIVILDNSPGAYRSHPDNAIPIKSWFSDPSDTALLNLLPMLDALRFTADVRSVLSRNLHQHRLW

SEQ ID NO: 1146 - protein, 223 aa, unidentified
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSDFLLWILAAVSSGLFFYSFLLTAVSLSKMLKKRSPLTTGVYVKMPPTEPECEKQFQPYFIPIN

SEQ ID NO: 1147 - protein, 367 aa, unidentified
MIRNWLTIFILFPLKLVEKCESSVSLTVPPVVKLENGSSTNVSLTLRPPLNATLVITFEITFRSKNITILELPDEVVVPPGVTNSSFQVTSQNVGQLTVYLHGNHSNQTGPRIRFLVIRSSAISIINQVIGWIYFVAWSISFYPQVIMNWRRKSVIGLSFDFVALNLTGFVAYSVFNIGLLWVPYIKEQFLLKYPNGVNPVNSNDVFFSLHAVVLTLIIIVQCCLYERGGQRVSWPAIGFLVLAWLFAFVTMIVAAVGVTTWLQFLFCFSYIKLAVTLVKYFPQAYMNFYYKSTEGWSIGNVLLDFTGGSFSLLQMFLQSYNNDQWTLIFGDPTKFGLGVFSIVFDVVFFIQHFCLYRKRPGYDQLN

SEQ ID NO: 1148 - protein, 329 aa, unidentified
MWGLKVLLLPVVSFALYPEEILDTHWELWKKTHRKQYNNKVDEISRRLIWEKNLKYISIHNLEASLGVHTYELAMNHLGDMTSEEVVQKMTGLKVPLSHSRSNDTLYIPEWEGRAPDSVDYRKKGYVTPVKNQGQCGSCWAFSSVGALEGQLKKKTGKLLNLSPQNLVDCVSENDGCGGGYMTNAFQYVQKNRGIDSEDAYPYVGQEESCMYNPTGKAAKCRGYREIPEGNEKALKRAVARVGPVSVAIDASLTSFQFYSKGVYYDESCNSDNLNHAVLAVGYGIQKGNKHWIIKNSWGENWGNKGYILMARNKNNACGIANLASFPKM

SEQ ID NO: 1149 - protein, 82 aa, unidentified
MSATWTLSPEPLPPSTGPPVGAGLDAEQRTVFAFVLCLLVVLVLLMVRCVRILLDPYSRMPASSWTDHKEALERGQFDYALV

SEQ ID NO: 1150 - protein, 81 aa, unidentified
MSSTYCGNSSAKMSVNEVSAFSLTLEQKTGFAFVGILCIFLGLLIIRCFKILLDPYSSMPSSTWEDEVEEFDKGTFEYALA

SEQ ID NO: 1151 - protein, 81 aa, unidentified
MDGGQPIPSSLVPLGNESADSSMSLEQKMTFVFVILLFIFLGILIVRCFRILLDPYRSMPTSTWADGLEGLEKGQFDHALA

SEQ ID NO: 1152 - protein, 678 aa, unidentified
MAANVGSMFQYWKRFDLQQLQRELDATATVLANRQDESEQSRKRLIEQSREFKKNTPEDLRKQVAPLLKSFQGEIDALSKRSKEAEAAFLNVYKRLIDVPDPVPALDLGQQLQLKVQRLHDIETENQKLRETLEEYNKEFAEVKNQEVTIKALKEKIREYEQTLKNQAETIALEKEQKLQNDFAEKERKLQETQMSTTSKLEEAEHKVQSLQTALEKTRTELFDLKTKYDEETTAKADEIEMIMTDLERANQRAEVAQREAETLREQLSSANHSLQLASQIQKAPDVEQAIEVLTRSSLEVELAAKEREIAQLVEDVQRLQASLTKLRENSASQISQLEQQLSAKNSTLKQLEEKLKGQADYEEVKKELNILKSMEFAPSEGAGTQDAAKPLEVLLLEKNRSLQSENAALRISNSDLSGRCAELQVRITEAVATATEQRELIARLEQDLSIIQSIQRPDAEGAAEHRLEKIPEPIKEATALFYGPAAPASGALPEGQVDSLLSIISSQRERFRARNQELEAENRLAQHTLQALQSELDSLRADNIKLFEKIKFLQSYPGRGSGSDDTELRYSSQYEERLDPFSSFSKRERQRKYLSLSPWDKATLSMGRLVLSNKMARTIGFFYTLFLHCLVFLVLYKLAWSESMERDCATFCAKKFADHLHKFHENDNGAAAGDLWQ

SEQ ID NO: 1153 - protein, 1486 aa, unidentified
MAANVGSMFQYWKRFDLRRLQKELNSVASELSARQEESEHSHKHLIELRREFKKNVPEEIREMVAPVLKSFQAEVVALSKRSQEAEAAFLSVYKQLIEAPDPVPVFEAARSLDDRLQPPSFDPSGQPRRDLHTSWKRNPELLSPKEQREGTSPAGPTLTEGSRLPGIPGKALLTETLLQRNEAEKQKGLQEVQITLAARLGEAEEKIKVLHSALKATQAELLELRRKYDEEAASKADEVGLIMTNLEKANQRAEAAQREVESLREQLASVNSSIRLACCSPQGPSGDKVNFTLCSGPRLEAALASKDREILRLLKDVQHLQSSLQELEEASANQIADLERQLTAKSEAIEKLEEKLQAQSDYEEIKTELSILKAMKLASSTCSLPQGMAKPEDSLLIAKEAFFPTQKFLLEKPSLLASPEEDPSEDDSIKDSLGTEQSYPSPQQLPPPPGPEDPLSPSPGQPLLGPSLGPDGTRTFSLSPFPSLASGERLMMPPAAFKGEAGGLLVFPPAFYGAKPPTAPATPAPGPEPLGGPEPADGGGGGAAGPGAEEEQLDTAEIAFQVKEQLLKHNIGQRVFGHYVLGLSQGSVSEILARPKPWRKLTVKGKEPFIKMKQFLSDEQNVLALRTIQVRQRGSITPRIRTPETGSDDAIKSILEQAKKEIESQKGGEPKTSVAPLSIANGTTPASTSEDAIKSILEQARREMQAQQQALLEMEVAPRGRSVPPSPPERPSLATASQNGAPALVKQEEGSGGPAQAPLPVLSPAAFVQSIIRKVKSEIGDAGYFDHHWASDRGLLSRPYASVSPSLSSSSSSGYSGQPNGRAWPRGDEAPVPPEDEAAAGAEDEPPRTGELKAEGATAEAGARLPYYPAYVPRTLKPTVPPLTPEQYELYMYREVDTLELTRQVKEKLAKNGICQRIFGEKVLGLSQGSVSDMLSRPKPWSKLTQKGREPFIRMQLWLSDQLGQAVGQQPGASQASPTEPRSSPSPPPSPTEPEKSSQEPLSLSLESSKENQQPEGRSSSSLSGKMYSGSQAPGGIQEIVAMSPELDTYSITKRVKEVLTDNNLGQRLFGESILGLTQGSVSDLLSRPKPWHKLSLKGREPFVRMQLWLNDPHNVEKLRDMKKLEKKAYLKRRYGLISTGSDSESPATRSECPSPCLQPQDLSLLQIKKPRVVLAPEEKEALRKAYQLEPYPSQQTIELLSFQLNLKTNTVINWFHNYRSRMRREMLVEGTQDEPDLDPSGGPGILPPGHSHPDPTPQSPDSETEDQKPTVKELELQEGPEENSTPLTTQDKAQVRIKQEQMEEDAEEEAGSQPQDSGELDKGQGPPKEEHPDPPGNDGLPKVAPGPLLPGGSTPDCPSLHPQQESEAGERLHPDPLSFKSASESSRCSLEVSLNSPSAASSPGLMMSVSPVPSSSAPISPSPPGAPPAKVPSASPTADMAGALHPSAKVNPNLQRRHEKMANLNNIIYRVERAANREEALEWEF

SEQ ID NO: 1154 - protein, 607 aa, unidentified
MELVRRLMPLTLLILSCLAELTMAEAEGNASCTVSLGGANMAETHKAMILQLNPSENCTWTIERPENKSIRIIFSYVQLDPDGSCESENIKVFDGTSSNGPLLGQVCSKNDYVPVFESSSSTLTFQIVTDSARIQRTVFVFYYFFSPNISIPNCGGYLDTLEGSFTSPNYPKPHPELAYCVWHIQVEKDYKIKLNFKEIFLEIDKQCKFDFLAIYDGPSTNSGLIGQVCGRVTPTFESSSNSLTVVLSTDYANSYRGFSASYTSIYAENINTTSLTCSSDRMRVIISKSYLEAFNSNGNNLQLKDPTCRPKLSNVVEFSVPLNGCGTIRKVEDQSITYTNIITFSASSTSEVITRQKQLQIIVKCEMGHNSTVEIIYITEDDVIQSQNALGKYNTSMALFESNSFEKTILESPYYVDLNQTLFVQVSLHTSDPNLVVFLDTCRASPTSDFASPTYDLIKSGCSRDETCKVYPLFGHYGRFQFNAFKFLRSMSSVYLQCKVLICDSSDHQSRCNQGCVSRSKRDISSYKWKTDSIIGPIRLKRDRSASGNSGFQHETHAEETPNQPFNSVHLFSFMVLALNVVTVATITVRHFVNQRADYKYQKLQNY

SEQ ID NO: 1155 - protein, 699 aa, unidentified
MPSLWREILLESLLGCVSWSLYHDLGPMIYYFPLQTLELTGLEGFSIAFLSPIFLTITPFWKLVNKKWMLTLLRIITIGSIASFQAPNAKLRLMVLALGVSSSLIVQAVTWWSGSHLQRYLRIWGFILGQIVLVVLRIWYTSLNPIWSYQMSNKVILTLSAIATLDRIGTDGDCSKPEEKKTGEVATGMASRPNWLLAGAAFGSLVFLTHWVFGEVSLVSRWAVSGHPHPGPDPNPFGGAVLLCLASGLMLPSCLWFRGTGLIWWVTGTASAAGLLYLHTWAAAVSGCVFAIFTASMWPQTLGHLINSGTNPGKTMTIAMIFYLLEIFFCAWCTAFKFVPGGVYARERSDVLLGTMMLIIGLNMLFGPKKNLDLLLQTKNSSKVLFRKSEKYMKLFLWLLVGVGLLGLGLRHKAYERKLGKVAPTKEVSAAIWPFRFGYDNEGWSSLERSAHLLNETGADFITILESDASKPYMGNNDLTMWLGEKLGFYTDFGPSTRYHTWGIMALSRYPIVKSEHHLLPSPEGEIAPAITLTVNISGKLVDFVVTHFGNHEDDLDRKLQAIAVSKLLKSSSNQVIFLGYITSAPGSRDYLQLTEHGNVKDIDSTDHDRWCEYIMYRGLIRLGYARISHAELSDSEIQMAKFRIPDDPTNYRDNQKVVIDHREVSEKIHFNPRFGSYKEGHNYENNHHFHMNTPKYFL

SEQ ID NO: 1156 - protein, 397 aa, unidentified
MAPISLSWLLRLATFCHLTVLLAGQHHGVTKCNITCSKMTSKIPVALLIHYQQNQASCGKRAIILETRQHRLFCADPKEQWVKDAMQHLDRQAAALTRNGGTFEKQIGEVKPRTTPAAGGMDESVVLEPEATGESSSLEPTPSSQEAQRALGTSPELPTGVTGSSGTRLPPTPKAQDGGPVGTELFRVPPVSTAATWQSSAPHQPGPSLWAEAKTSEAPSTQDPSTQASTASSPAPEENAPSEGQRVWGQGQSPRPENSLEREEMGPVPAHTDAFQDWGPGSMAHVSVVPVSSEGTPSREPVASGSWTPKAEEPIHATMDPQRLGVLITPVPDAQAATRRQAVGLLAFLGLLFCLGVAMFTYQSLQGCPRKMAGEMAEGLRYIPRSCGSNSYVLVPV

SEQ ID NO: 1157 - protein, 355 aa, unidentified
MDQFPESVTENFEYDDLAEACYIGDIVVFGTVFLSIFYSVIFAIGLVGNLLVVFALTNSKKPKSVTDIYLLNLALSDLLFVATLPFWTHYLINEKGLHNAMCKFTTAFFFIGFFGSIFFITVISIDRYLAIVLAANSMNNRTVQHGVTISLGVWAAAILVAAPQFMFTKQKENECLGDYPEVLQEIWPVLRNVETNFLGFLLPLLIMSYCYFRIIQTLFSCKNHKKAKAIKLILLVVIVFFLFWTPYNVMIFLETLKLYDFFPSCDMRKDLRLALSVTETVAFSHCCLNPLIYAFAGEKFRRYLYHLYGKCLAVLCGRSVHVDFSSSESQRSRHGSVLSSNFTYHTSDGDALLLL

SEQ ID NO: 1158 - protein, 365 aa, unidentified
MALLLCFVLLCGVVDFARSLSITTPEEMIEKAKGETAYLPCKFTLSPEDQGPLDIEWLISPADNQKVDQVIILYSGDKIYDDYYPDLKGRVHFTSNDLKSGDASINVTNLQLSDIGTYQCKVKKAPGVANKKIHLVVLVKPSGARCYVDGSEEIGSDFKIKCEPKEGSLPLQYEWQKLSDSQKMPTSWLAEMTSSVISVKNASSEYSGTYSCTVRNRVGSDQCLLRLNVVPPSNKAGLIAGAIIGTLLALALIGLIIFCCRKKRREEKYEKEVHHDIREDVPPPKSRTSTARSYIGSNHSSLGSMSPSNMEGYSKTQYNQVPSEDFERTPQSPTLPPAKVAAPNLSRMGAIPVMIPAQSKDGSIV

SEQ ID NO: 1159 - protein, 254 aa, unidentified
MGRDLRPGSRVLLLLLLLLLVYLTQPGNGNEGSVTGSCYCGKRISSDSPPSVQFMNRLRKHLRAYHRCLYYTRFQLLSWSVCGGNKDPWVQELMSCLDLKECGHAYSGIVAHQKHLLPTSPPISQASEGASSDIHTPAQMLLSTLQSTQRPTLPVGSLSSDKELTRPNETTIHTAGHSLAAGPEAGENQKQPEKNAGPTARTSATVPVLCLLAIIFILTAALSYVLCKRRRGQSPQSSPDLPVHYIPVAPDSNT

SEQ ID NO: 1160 - protein, 350 aa, unidentified
MSNITDPQMWDFDDLNFTGMPPADEDYSPCMLETETLNKYVVIIAYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRHLVKFVCLGCWGLSMNLSLPFFLFRQAYHPNNSSPVCYEVLGNDTAKWRMVLRILPHTFGFIVPLFVMLFCYGFTLRTLFKAHMGQKHRAMRVIFAVVLIFLLCWLPYNLVLLADTLMRTQVIQESCERRNNIGRALDATEILGFLHSCLNPIIYAFIGQNFRHGFLKILAMHGLVSKEFLARHRVTSYTSSSVNVSSNL

SEQ ID NO: 1161 - protein, 360 aa, unidentified
MEDFNMESDSFEDFWKGEDLSNYSYSSTLPPFLLDAAPCEPESLEINKYFVVIIYALVFLLSLLGNSLVMLVILYSRVGRSVTDVYLLNLALADLLFALTLPIWAASKVNGWIFGTFLCKVVSLLKEVNFYSGILLLACISVDRYLAIVHATRTLTQKRYLVKFICLSIWGLSLLLALPVLLFRRTVYSSNVSPACYEDMGNNTANWRMLLRILPQSFGFIVPLLIMLFCYGFTLRTLFKAHMGQKHRAMRVIFAVVLIFLLCWLPYNLVLLADTLMRTQVIQETCERRNHIDRALDATEILGILHSCLNPLIYAFIGQKFRHGLLKILAIHGLISKDSLPKDSRPSFVGSSSGHTSTTL

SEQ ID NO: 1162 - protein, 368 aa, unidentified
MVLEVSDHQVLNDAEVAALLENFSSSYDYGENESDSCCTSPPCPQDFSLNFDRAFLPALYSLLFLLGLLGNGAVAAVLLSRRTALSSTDTFLLHLAVADTLLVLTLPLWAVDAAVQWVFGSGLCKVAGALFNINFYAGALLLACISFDRYLNIVHATQLYRRGPPARVTLTCLAVWGLCLLFALPDFIFLSAHHDERLNATHCQYNFPQVGRTALRVLQLVAGFLLPLLVMAYCYAHILAVLLVSRGQRRLRAMRLVVVVVVAFALCWTPYHLVVLVDILMDLGALARNCGRESRVDVAKSVTSGLGYMHCCLNPLLYAFVGVKFRERMWMLLLRLGCPNQRGLQRQPSSSRRDSSWSETSEASYSGL

SEQ ID NO: 1163 - protein, 352 aa, unidentified
MEGISIYTSDNYTEEMGSGDYDSMKEPCFREENANFNKIFLPTIYSIIFLTGIVGNGLVILVMGYQKKLRSMTDKYRLHLSVADLLFVITLPFWAVDAVANWYFGNFLCKAVHVIYTVNLYSSVLILAFISLDRYLAIVHATNSQRPRKLLAEKVVYVGVWIPALLLTIPDFIFANVSEADDRYICDRFYPNDLWVVVFQFQHIMVGLILPGIVILSCYCIIISKLSHSKGHQKRKALKTTVILILAFFACWLPYYIGISIDSFILLEIIKQGCEFENTVHKWISITEALAFFHCCLNPILYAFLGAKFKTSAQHALTSVSRGSSLKILSKGKRGGHSSVSTESESSSFHSS

SEQ ID NO: 1164 - protein, 372 aa, unidentified
MNYPLTLEMDLENLEDLFWELDRLDNYNDTSLVENHLCPATEGPLMASFKAVFVPVAYSLIFLLGVIGNVLVLVILERHRQTRSSTETFLFHLAVADLLLVFILPFAVAEGSVGWVLGTFLCKTVIALHKVNFYCSSLLLACIAVDRYLAIVHAVHAYRHRRLLSIHITCGTIWLVGFLLALPEILFAKVSQGHHNNSLPRCTFSQENQAETHAWFTSRFLYHVAGFLLPMLVMGWCYVGVVHRLRQAQRRPQRQKAVRVAILVTSIFFLCWSPYHIVIFLDTLARLKAVDNTCKLNGSLPVAITMCEFLGLAHCCLNPMLYTFAGVKFRSDLSRLLTKLGCTGPASLCQLFPSWRRSSLSESENATSLTTF

SEQ ID NO: 1165 - protein, 342 aa, unidentified
MAEHDYHEDYGFSSFNDSSQEEHQDFLQFSKVFLPCMYLVVFVCGLVGNSLVLVISIFYHKLQSLTDVFLVNLPLADLVFVCTLPFWAYAGIHEWVFGQVMCKSLLGIYTINFYTSMLILTCITVDRFIVVVKATKAYNQQAKRMTWGKVTSLLIWVISLLVSLPQIIYGNVFNLDKLICGYHDEAISTVVLATQMTLGFFLPLLTMIVCYSVIIKTLLHAGGFQKHRSLKIIFLVMAVFLLTQMPFNLMKFIRSTHWEYYAMTSFHYTIMVTEAIAYLRACLNPVLYAFVSLKFRKNFWKLVKDIGCLPYLGVSHQWKSSEDNSKTFSASHNVEATSMFQL

SEQ ID NO: 1166 - protein, 361 aa, unidentified
MNLVICVLLLSIWKNNCMTTNQTNGSSTTGDKPVESMQTKLNYLRRNLLILVGIIIMVFVFICFCYLHYNCLSDDASKAGMVKKKGIAAKSSKTSFSEAKTASQCSPETQPMLSTADKSSDSSSPERASAQSSTEKLIRPSSLQKPSIPNSAGKLTRPSYPKRSSKSSCSKKLSKSSHLEKAHKKGSLEKLCKLDYACKLASSDKPVRPPQLFKPLYSSHPQNEISPSKPFGPQELAKPPKHFNPKRSVSLGRAALLSNSELAETCQPYKKKHLVAKTYRPLVNDISEAKEKNTQNLHVSSKVKSSSRSFRKLDSRNNAYGDHVNDSDTMKYYSEVDSDKVIIITCDRGYNQVTSEVTLND

SEQ ID NO: 1167 - protein, 194 aa, unidentified
MEGGAAAATPTALPYYVAFSQLLGLTLVAMTGAWLGLYRGGIAWESDLQFNAHPLCMVIGLIFLQGNALLVYRVFRNEAKRTTKVLHGLLHIFALVIALVGEFPGAAFPATCLPLQAWWRCSTTTGRRATLTCTAYTAGAGSLSLSCTLCSGWWASASSCSPELHSPCGAATAHSTSSLVLPSSSFPWAPPCWA

SEQ ID NO: 1168 - protein, 242 aa, unidentified
MVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLLHDGE

SEQ ID NO: 1169 - protein, 229 aa, unidentified
MQPLEVGLVPAPAGEPRLTRWLRRGSGILAHLVALGFTIFLTALSRPGTSLFSWHPVFMALAFCLCMAEAILLFSPEHSLFFFCSRKARIRLHWAGQTLAILCAALGLGFIISSRTRSELPHLVSWHSWVGALTLLATAVQALCGLCLLCPRAARVSRVARLKLYHLTCGLVVYLMATVTVLLGMYSVWFQAQIKGAAWYLCLALPVYPALVIMHQISRSYLPRKKMEM

SEQ ID NO: 1170 - protein, 222 aa, unidentified
MALSAETESHIYRALRTASGAAAHLVALGFTIFVAVLARPGSSLFSWHPVLMSLAFSFLMTEALLVFSPESSLLHSLSRKGRARCHWVLQLLALLCALLGLGLVILHKEQLGKAHLVTRHGQAGLLAVLWAGLQCSGGVGLLYPKLLPRWPLAKLKLYHATSGLVGYLLGSASLLLGMCSLWFTASVTGAAWYLAVLCPVLTSLVIMNQVSNAYLYRKRIQP

SEQ ID NO: 1171 - protein, 134 aa, unidentified
MAEQSDEAVKYYTLEEIQKHNHSKSTWLILHHKVYDLTKFLEEHPGGEEVLREQAGGDATENFEDVGHSTDAREMSKTFIIGELHPDDRPKLNKPPETLITTIDSSSSWWTNWVIPAISAVAVALMYRLYMAED

SEQ ID NO: 1172 - protein, 150 aa, unidentified
MSGSMATAEASGSDGKGQEVETSVTYYRLEEVAKRNSLKELWLVIHGRVYDVTRFLNEHPGGEEVLLEQAGVDASESFEDVGHSSDAREMLKQYYIGDIHPSDLKPESGSKDPSKNDTCKSCWAYWILPIIGAVLLGFLYRYYTSESKSS

SEQ ID NO: 1173 - protein, 276 aa, unidentified
MNSRRREPITLQDPEAKYPLPLIEKEKISHNTRRFRFGLPSPDHVLGLPVGNYVQLLAKIDNELVVRAYTPVSSDDDRGFVDLIIKIYFKNVHPQYPEGGKMTQYLENMKIGETIFFRGPRGRLFYHGPGNLGIRPDQTSEPKKTLADHLGMIAGGTGITPMLQLIRHITKDPSDRTRMSLIFANQTEEDILVRKELEEIARTHPDQFNLWYTLDRPPIGWKYSSGFVTADMIKEHLPPPAKSTLILVCGPPPLIQTAAHPNLEKLGYTQDMIFTY

SEQ ID NO: 1174 - protein, 301 aa, unidentified
MGAQLSTLGHMVLFPVWFLYSLLMKLFQRSTPAITLESPDIKYPLRLIDREIISHDTRRFRFALPSPQHILGLPVGQHIYLSARIDGNLVVRPYTPISSDDDKGFVDLVIKVYFKDTHPKFPAGGKMSQYLESMQIGDTIEFRGPSGLLVYQGKGKFAIRPDKKSNPIIRTVKSVGMIAGGTGITPMLQVIRAIMKDPDDHTVCHLLFANQTEKDILLRPELEELRNKHSARFKLWYTLDRAPEAWDYGQGFVNEEMIRDHLPPPEEEPLVLMCGPPPMIQYACLPNLDHVGHPTERCFVF

SEQ ID NO: 1175 - protein, 195 aa, unidentified
MGQIEWAMWANEQALASGLILITGGIVATAGRFTQWYFGAYSIVAGVFVCLLEYPRGKRKKGSTMERWGQKYMTAVVKLFGPFTRNYYVRAVLHLLLSVPAGFLLATILGTACLAIASGIYLLAAVRGEQWTPIEPKPRERPQIGGTIKQPPSNPPPRPPAEARKKPSEEEAAVAAGGPPGGPQVNPIPVTDEVV

SEQ ID NO: 1176 - protein, 570 aa, unidentified
MGNWAVNEGLSIFVILVWLGLNVFLFVWYYRVYDIPPKFFYTRKLLGSALALARAPAACLNFNCMLILLPVCRNLLSFLRGSSACCSTRVRRQLDRNLTFHKMVAWMIALHSAIHTIAHLFNVEWCVNARVNNSDPYSVALSELGDRQNESYLNFARKRIKNPEGGLYLAVTLLAGITGVVITLCLILIITSSTKTIRRSYFEVFWYTHHLFVIFFIGLAIHGAERIVRGQTAESLAVHNITVCEQKISEWGKIKECPIPQFAGNPPMTWKWIVGPMFLYLCERLVRFWRSQQKVVITKVVTHPFKTIELQMKKKGFKMEVGQYIFVKCPKVSKLEWHPFTLTSAPEEDFFSIHIRIVGDWTEGLFNACGCDKQEFQDAWKLPKIAVDGPFGTASEDVFSYEVVMLVGAGIGVTPFASILKSVWYKYCNNATNLKLKKIYFYWLCRDTHAFEWFADLLQLLESQMQERNNAGFLSYNIYLTGWDESQANHFAVHHDEEKDVITGLKQKTLYGRPNWDNEFKTIASQHPNTRIGVFLCGPEALAETLSKQSISNSESGPRGVHFIFNKENF

SEQ ID NO: 1177 - protein, 286 aa, unidentified
MAMEGYWRFLALLGSALLVGFLSVIFALVWVLHYREGLGWDGSALEFNWHPVLMVTGFVFIQGIAIIVYRLPWTWKCSKLLMKSIHAGLNAVAAILAIISVVAVFENHNVNNIANMYSLHSWVGLIAVICYLLQLLSGFSVFLLPWAPLSLRAFLMPIHVYSGIVIFGTVIATALMGLTEKLIFSLRDPAYSTFPPEGVFVNTLGLLILVFGALIFWIVTRPQWKRPKEPNSTILHPNGGTEQGARGSMPAYSGNNMDKSDSELNSEVAARKRNLALDEAGQRSTM

SEQ ID NO: 1178 - protein, 325 aa, unidentified
MAAAAASLRGVVLGPRGAGLPGARARGLLCSARPGQLPLRTPQAVALSSKSGLSRGRKVMLSALGMLAAGGAGLAMALHSAVSASDLELHPPSYPWSHRGLLSSLDHTSIRRGFQVYKQVCASCHSMDFVAYRHLVGVCYTEDEAKELAAEVEVQDGPNEDGEMFMRPGKLFDYFPKPYPNSEAARAANNGALPPDLSYIVRARHGGEDYVFSLLTGYCEPPTGVSLREGLYFNPYFPGQAIAMAPPIYTDVLEFDDGTPATMSQIAKDVCTFLRWASEPEHDHRKRMGLKMLMMMALLVPLVYTIKRHKWSVLKSRKLAYRPPK

SEQ ID NO: 1179 - protein, 362 aa, unidentified
MAPKPGAEWSTALSHLVLGVVSLHAAVSTAEASRGAAAGFLLQVLAATTTLAPGLSTHEDCLAGAWVATVIGLPLLAFDFHWCTNGHLMCAGCFIHLLADARLKEEQATCPNCRCEISKSLCCRNLAVEKAVSELPSECGFCLRQFPRSLLERHQKEECQDRVTQCKYKRIGCPWHGPFHELTVHEAACAHPTKTGSELMEILDGMDQSHRKEMQLYNSIFSLLSFEKIGYTEVQFRPYRTDDFITRLYYETPRFTVLNQTWVLKARVNDSERNPNLSCKRTLSFQLLLKSKVTAPLECSFLLLKGPYDDVRISPVIYHFVFTNESNETDYVPLPIIDSVECNKLLAAKNINLRLFLFQIQK

SEQ ID NO: 1180 - protein, 503 aa, unidentified
MVLEMLNPIHYNITSIVPEAMPAATMPVLLLTGLFLLVWNYEGTSSIPGPGYCMGIGPLISHGRFLWMGIGSACNYYNRVYGEFMRVWISGEETLIISKSSSMFHIMKHNHYSSRFGSKLGLQCIGMHEKGIIFNNNPELWKTTRPFFMKALSGPGLVRMVTVCAESLKTHLDRLEEVTNESGYVDVLTLLRRVMLDTSNTLFLRIPLDESAIVVKIQGYFDAWQALLIKPDIFFKISWLYKKYEKSVKDLKDAIEVLIAEKRRRISTEEKLEECMDFATELILAEKRGDLTRENVNQCILEMLIAAPDTMSVSLFFMLFLIAKHPNVEEAIIKEIQTVIGERDIKIDDIQKLKVMENFIYESMRYQPVVDLVMRKALEDDVIDGYPVKKGTNIILNIGRMHRLEFFPKPNEFTLENFAKNVPYRYFQPFGFGPRGCAGKYIAMVMMKAILVTLLRRFHVKTLQGQCVESIQKIHDLSLHPDETKNMLEMIFTPRNSDRCLEH

SEQ ID NO: 1181 - protein, 512 aa, unidentified [sequence omitted]

SEQ ID NO: 1182 - protein, 516 aa, unidentified
MALSQSVPFSATELLLASAIFCLVFWVLKGLRPRVPKGLKSPPEPWGWPLLGHVLTLGKNPHLALSRMSQRYGDVLQIRIGSTPVLVLSRLDTIRQALVRQGDDFKGRPDLYTSTLITDGQSLTFSTDSGPVWAARRRLAQNALNTFSIASDPASSSSCYLEEHVSKEAKALISRLQELMAGPGHFDPYNQVVVSVANVIGAMCFGQHFPESSDEMLSLVKNTHEFVETASSGNPLDFFPILRYLPNPALQRFKAFNQRFLWFLQKTVQEHYQDFDKNSVRDITGALFKHSKKGPRASGNLIPQEKIVNLVNDIFGAGFDTVTTAISWSLMYLVTKPEIQRKIQKELDTVIGRERRPRLSDRPQLPYLEAFILETFRHSSFLPFTIPHSTTRDTTLNGFYIPKKCCVFVNQWQVNHDPELWEDPSEFRPERFLTADGTAINKPLSEKMMLFGMGKRRCIGEVLAKWEIFLFLAILLQQLEFSVPPGVKVDLTPIYGLTMKHARCEHVQARLRFSIN

SEQ ID NO: 1183 - protein, 543 aa, unidentified
MGTSLSPNDPWPLNPLSIQQTTLLLLLSVLATVHVGQRLLRQRRRQLRSAPPGPFAWPLIGNAAAVGQAAHLSFARLARRYGDVFQIRLGSCPIVVLNGERAIHQALVQQGSAFADRPAFASFRVVSGGRSMAFGHYSEHWKVQRRAAHSMMRNFFTRQPRSRQVLEGHVLSEARELVALLVRGSADGAFLDPRPLTVVAVANVMSAVCFGCRYSHDDPEFRELLSHNEEFGRTVGAGSLVDVMPWLQYFPNPVRTVFREFEQLNRNFSNFILDKFLRHCESLRPGAAPRDMMDAFILSAEKKAAGDSHGGGARLDLENVPATITDIFGASQDTLSTALQWLLLLFTRYPDVQTRVQAELDQVVGRDRLPCMGDQPNLPYVLAFLYEAMRFSSFVPVTIPHATTANTSVLGYHIPKDTVVFVNQWSVNHDPLKWPNPENFDPARFLDKDGLINKDLTSRVMIFSVGKRRCIGEELSKMQLFLFISILAHQCDFRANPNEPAKMNFSYGLTIKPKSFKVNVTLRESMELLDSAVQNLQAKETCQ

SEQ ID NO: 1184 - protein, 462 aa, unidentified
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTVWSEIGKGFLDGSLDKNMTRKKQYEDALMQLESVLRNIIKERKGRNFSQHIFIDSLVQGNLNDQQILEDSMIFSLASCIITAKLCTWAICFLTTSEEVQKKLYEEINQVFGNGPVTPEKIEQLRYCQHVLCETVRTAKLTPVSAQLQDIEGKIDRFIIPRETLVLYALGVVLQDPNTWPSPHKFDPDRFDDELVMKTFSSLGFSGTQECPELRFAYMVTTVLLSVLVKRLHLLSVEGQVIETKYELVTSSREEAWITVSKRY

SEQ ID NO: 1185 - protein, 522 aa, unidentified
MFPWGLSCLSVLGAAGTALLCAGLLLSLAQHLWTLRWMLSRDRASTLPLPKGSMGWPFFGETLHWLVQGSRFHSSRRERYGTVFKTHLLGRPVIRVSGAENVRTILLGEHRLVRSQWPQSAHILLGSHTLLGAVGEPHRRRRKVLARVFSRAALERYVPRLQGALRHEVRSWCAAGGPVSVYDASKALTFRMAARILLGLRLDEAQCATLARTFEQLVENLFSLPLDVPFSGLRKGIRARDQLHRHLEGAISEKLHEDKAAEPGDALDLIIHSARELGHEPSMQELKESAVELLFAAFFTTASASTSLVLLLLQHPAAIAKIREELVAQGLGRACGCAPGAAGGSEGPPPDCGCEPDLSLAALGRLRYVDCVVKEVLRLLPPVSGGYRTALRTFELDGYQIPKGWSVMYSIRDTHETAAVYRSPPEGFDPERFGAAREDSRGASSRFHYIPFGGGARSCLGQELAQAVLQLLAVELVRTARWELATPAFPAMQTVPIVHPVDGLRLFFHPLTPSVAGNGLCL

SEQ ID NO: 1186 - protein, 497 aa, unidentified [sequence omitted]

SEQ ID NO: 1187 - protein, 504 aa, unidentified
MEATGTWALLLALALLLLLTLALSGTRARGHLPPGPTPLPLLGNLLQLRPGALYSGLMRLSKKYGPVFTIYLGPWRPVVVLVGQEAVREALGGQAEEFSGRGTVAMLEGTFDGHGVFFSNGERWRQLRKFTMLALRDLGMGKREGEELIQAEARCLVETFQGTEGRPFDPSLLLAQATSNVVCSLLFGLRFSYEDKEFQAVVRAAGGTLLGVSSQGGQTYEMFSWFLRPLPGPHKQLLHHVSTLAAFTVRQVQQHQGNLDASGPARDLVDAFLLKMAQEEQNPGTEFTNKNMLMTVIYLLFAGTMTVSTTVGYTLLLLMKYPHVQKWVREELNRELGAGQAPSLGDRTRLPYTDAVLHEAQRLLALVPMGIPRTLMRTTRFRGYTLPQGTEVFPLLGSILHDPNIFKHPEEFNPDRFLDADGRFRKHEAFLPFSLGKRVCLGEGLAKAELFLFFTTILQAFSLESPCPPDTLSLKPTVSGLFNIPPAFQLQVRPTDLHSTTQTR

SEQ ID NO: 1188 - protein, 544 aa, unidentified
MSSPGPSQPPAEDPPWPARLLRAPLGLLRLDPSGGALLLCGLVALLGWSWLRRRRARGIPPGPTPWPLVGNFGHVLLPPFLRRRSWLSSRTRAAGIDPSVIGPQVLLAHLARVYGSIFSFFIGHYLVVVLSDFHSVREALVQQAEVFSDRPRVPLISIVTKEKGVVFAHYGPVWRQQRKFSHSTLRHFGLGKLSLEPKIIEEFKYVKAEMQKHGEDPFCPFSIISNAVSNIICSLCFGQRFDYTNSEFKKMLGFMSRGLEICLNSQVLLVNICPWLYYLPFGPFKELRQIEKDITSFLKKIIKDHQESLDRENPQDFIDMYLLHMEEERKNNSNSSFDEEYLFYIIGDLFIAGTDTTTNSLLWCLLYMSLNPDVQEKVHEEIERVIGANRAPSLTDKAQMPYTEATIMEVQRLTVVVPLAIPHMTSENTVLQGYTIPKGTLILPNLWSVHRDPAIWEKPEDFYPNRFLDDQGQLIKKETFIPFGIGKRVCMGEQLAKMELFLMFVSLMQSFAFALPEDSKKPLLTGRFGLTLAPHPFNITISRR

SEQ ID NO: 1189 - protein, 469 aa, unidentified
MELISPTVIIILGCLALFLLLQRKNLRRPPCIKGWIPWIGVGFEFGKAPLEFIEKARIKYGPIFTVFAMGNRMTFVTEEEGINVFLKSKKVDFELAVQNIVYRTASIPKNVFLALHEKLYIMLKGKMGTVNLHQFTGQLTEELHEQLENLGTHGTMDLNNLVRHLLYPVTVNMLFNKSLFSTNKKKIKEFHQYFQVYDEDFEYGSQLPECLLRNWSKSKKWFLELFEKNIPDIKACKSAKDNSMTLLQATLDIVETETSKENSPNYGLLLLWASLSNAVPVAFWTLAYVLSHPDIHKAIMEGISSVFGKAGKDKIKVSEDDLENLLLIKWCVLETIRLKAPGVITRKVVKPVEILNYIIPSGDLLMLSPFWLHRNPKYFPEPELFKPERWKKANLEKHSFLDCFMAFGSGKFQCPARWFALLEVQMCIILILYKYDCSLLDPLPKQSYLHLVGVPQPEGQCRIEYKQRI

SEQ ID NO: 1190 - protein, 503 aa, unidentified
MALIPDLAMETWLLLAVSLVLLYLYGTHSHGLFKKLGIPGPTPLPFLGNILSYHKGFCMFDMECHKKYGKVWGFYDGQQPVLAITDPDMIKTVLVKECYSVFTNRRPFGPVGFMKSAISIAEDEEWKRLRSLLSPTFTSGKLKEMVPIIAQYGDVLVRNLRREAETGKPVTLKDVFGAYSMDVITSTSFGVNIDSLNNPQDPFVENTKKLLRFDFLDPFFLSITVFPFLIPILEVLNICVFPREVTNFLRKSVKRMKESRLEDTQKHRVDFLQLMIDSQNSKETESHKALSDLELVAQSIIFIFAGYETTSSVLSFIMYELATHPDVQQKLQEEIDAVLPNKAPPTYDTVLQMEYLDMVVNETLRLFPIAMRLERVCKKDVEINGMFIPKGVVVMIPSYALHRDPKYWTEPEKFLPERFSKKNKDNIDPYIYTPFGSGPRNCIGMRFALMNMKLALIRVLQNFSFKPCKETQIPLKLSLGGLLQPEKPVVLKVESRDGTVSGA

SEQ ID NO: 1191 - protein, 503 aa, unidentified
MDLIPNFAMETWVLVATSLVLLYIYGTHSHKLFKKLGIPGPTPLPFLGTILFYLRGLWNFDRECNEKYGEMWGLYEGQQPMLVIMDPDMIKTVLVKECYSVFTNQMPLGPMGFLKSALSFAEDEEWKRIRTLLSPAFTSVKFKEMVPIISQCGDMLVRSLRQEAENSKSINLKDFFGAYTMDVITGTLFGVNLDSLNNPQDPFLKNMKKLLKLDFLDPFLLLISLFPFLTPVFEALNIGLFPKDVTHFLKNSIERMKESRLKDKQKHRVDFFQQMIDSQNSKETKSHKALSDLELVAQSIIIIFAAYDTTSTTLPFIMYELATHPDVQQKLQEEIDAVLPNKAPVTYDALVQMEYLDMVVNETLRLFPVVSRVTRVCKKDIEINGVFIPKGLAVMVPIYALHHDPKYWTEPEKFCPERFSKKNKDSIDLYRYIPFGAGPRNCIGMRFALTNIKLAVIRALQNFSFKPCKETQIPLKLDNLPILQPEKPIVLKVHLRDGITSGP

SEQ ID NO: 1192 - protein, 39 aa, unidentified
MDLIPNLAVETWLLLAVSLVLLYLMRVPKSAKSPLTKQT

SEQ ID NO: 1193 - protein, 503 aa, unidentified
MDLIPNLAVETWLLLAVSLILLYLYGTRTHGLFKKLGIPGPTPLPFLGNALSFRKGYWTFDMECYKKYRKVWGIYDCQQPMLAITDPDMIKTVLVKECYSVFTNRRPFGPVGFMKNAISIAEDEEWKRIRSLLSPTFTSGKLKEMVPIIAQYGDVLVRNLRREAETGKPVTLKHVFGAYSMDVITSTSFGVSIDSLNNPQDPFVENTKKLLRFNPLDPFVLSIKVFPFLTPILEALNITVFPRKVISFLTKSVKQIKEGRLKETQKHRVDFLQLMIDSQNSKDSETHKALSDLELMAQSIIFIFAGYETTSSVLSFIIYELATHPDVQQKVQKEIDTVLPNKAPPTYDTVLQLEYLDMVVNETLRLFPVAMRLERVCKKDVEINGMFIPKGVVVMIPSYVLHHDPKYWTEPEKFLPERFSKKNKDNIDPYIYTPFGSGPRNCIGMRFALVNMKLALVRVLQNFSFKPCKETQIPLKLRFGGLLLTEKPIVLKAESRDETVSGA

SEQ ID NO: 1194 - protein, 519 aa, unidentified
MSVSVLSPSRLLGDVSGILQAASLLILLLLLIKAVQLYLHRQWLLKALQQFPCPPSHWLFGHIQELQQDQELQRIQKWVETFPSACPHWLWGGKVRVQLYDPDYMKVILGRSDPKSHGSYRFLAPWIGYGLLLLNGQTWFQHRRMLTPAFHYDILKPYVGLMADSVRVMLDKWEELLGQDSPLEVFQHVSLMTLDTIMKCAFSHQGSIQVDRNSQSYIQAISDLNNLVFSRVRNAFHQNDTIYSLTSAGRWTHRACQLAHQHTDQVIQLRKAQLQKEGELEKIKRKRHLDFLDILLLAKMENGSILSDKDLRAEVDTFMFEGHDTTASGISWILYALATHPKHQERCREEIHSLLGDGASITWNHLDQMPYTTMCIKEALRLYPPVPGIGRELSTPVTFPDGRSLPKGIMVLLSIYGLHHNPKVWPNPEVFDPFRFAPGSAQHSHAFLPFSGGSRNCIGKQFAMNELKVATALTLLRFELLPDPTRIPIPIARLVLKSKNGIHLRLRRLPNPCEDKDQL

SEQ ID NO: 1195 - protein, 421 aa, unidentified
MSVSVLSPSRRLGGVSGILQVTSLLILLLLLIKAAQLYLHRQWLLKALQQFPCPPSHWLFGHIQEFQHDQELQRIQERVKTFPSACPYWIWGGKVRVQLYDPDYMKVILGRSDPKSHGSYKFLAPRIGYGLLLLNGQTWFQHRRMLTPAFHNDILKPYVGLMADSVRVMLDKWEELLGQDSPLEVFQHVSLMTLDTIMKSAFSHQGSIQVDRPSDPTEEGSTTEGGGAGEDQEEEALGFSGHPPLGQRAPGLPRPCWCSGWNCFRNHLDQMPYTTMCIKEALRLYPPVPGIGRELSTPVTFPDGRSLPKGIMVLLSIYGLHHNPKVWPNLEVFDPSRFAPGSAQHSHAFLPFSGGSRNCIGKQFAMNQLKVARALTLLRFELLPDPTRIPIPMARLVLKSKNGIHLRLRRLPNPCEDKDQL

SEQ ID NO: 1196 - protein, 511 aa, unidentified
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGDPKAPDVYDFFLQWIGRGLLVLEGPKWLQHRKLLTPGFHYDVLKPYVAVFTESTRIMLDKWEEKAREGKSFDIFCDVGHMALNTLMKCTFGRGDTGLGHRDSSYYLAVSDLTLLMQQRLVSFQYHNDFIYWLTPHGRRFLRACQVAHDHTDQVIRERKAALQDEKVRKKIQNRRHLDFLDILLGARDEDDIKLSDADLRAEVDTFMFEGHDTTTSGISWFLYCMALYPEHQHRCREEVREILGDQDFFQWDDLGKMTYLTMCIKESFRLYPPVPQVYRQLSKPVTFVDGRSLPAGSLISMHIYALHRNSAVWPDPEVFDSLRFSTENASKRHPFAFMPFSAGPRNCIGQQFAMSEMKVVTAMCLLRFEFSLDPSRLPIKMPQLVLRSKNGFHLHLKPLGPGSGK

SEQ ID NO: 1197 - protein, 524 aa, unidentified
MSLLSLPWLGLRPVATSPWLLLLLVVGSWLLARILAWTYAFYNNCRRLQCFPQPPKRNWFWGHLGLITPTEEGLKNSTQMSATYSQGFTVWLGPIIPFIVLCHPDTIRSITNASAAIAPKDNLFIRFLKPWLGEGILLSGGDKWSRHRRMLTPAFHFNILKSYITIFNKSANIMLDKWQHLASEGSSRLDMFEHISLMTLDSLQKCIFSFDSHCQERPSEYIATILELSALVEKRSQHILQHMDFLYYLSHDGRRFHRACRLVHDFTDAVIRERRRTLPTQGIDDFFKDKAKSKTLDFIDVLLLSKDEDGKALSDEDIRAEADTFMFGGHDTTASGLSWVLYNLARHPEYQERCRQEVQELLKDRDPKEIEWDDLAQLPFLTMCVKESLRLHPPAPFISRCCTQDIVLPDGRVIPKGITCLIDIIGVHHNPTVWPDPEVYDPFRFDPENSKGRSPLAFIPFSAGPRNCIGQAFAMAEMKVVLALMLLHFRFLPDHTEPRRKLELIMRAEGGLWLRVEPLNVSLQ

SEQ ID NO: 1198 - protein, 520 aa, unidentified
MSQLSLSWLGLWPVAASPWLLLLLVGASWLLAHVLAWTYAFYDNCRRLRCFPQPPRRNWFWGHQGMVNPTEEGMRVLTQLVATYPQGFKVWMGPISPLLSLCHPDIIRSVINASAAIAPKDKFFYSFLEPWLGDGLLLSAGDKWSRHRRMLTPAFHFNILKPYMKIFNESVNIMHAKWQLLASEGSACLDMFEHISLMTLDSLQKCVFSFDSHCQEKPSEYIAAILELSALVSKRHHEILLHIDFLYYLTPDGQRFRRACRLVHDFTDAVIQERRRTLPSQGVDDFLQAKAKSKTLDFIDVLLLSKDEDGKKLSDEDIRAEADTFMFEGHDTTASGLSWVLYHLAKHPEYQERCRQEVQELLKDREPKEIEWDDLAHLPFLTMCMKESLRLHPPVPVISRHVTQDIVLPDGRVIPKGIICLISVFGTHHNPAVWPDPEVYDPFRFDPENIKERSPLAFIPFSAGPRNCIGQTFAMAEMKVVLALTLLRFRVLPDHTEPRRKPELVLRAEGGLWLRVEPLS

SEQ ID NO: 1199 - protein, 531 aa, unidentified
MLPITDRLLHLLGLEKTAFRIYAVSTLLLFLLFFLFRLLLRFLRLCRSFYITCRRLRCFPQPPRRNWLLGHLGMYLPNEAGLQDEKKVLDNMHHVLLVWMGPVLPLLVLVHPDYIKPLLGASAAIAPKDDLFYGFLKPWLGDGLLLSKGDKWSRHRRLLTPAFHFDILKPYMKIFNQSADIMHAKWRHLAEGSAVSLDMFEHISLMTLDSLQKCVFSYNSNCQEKMSDYISAIIELSALSVRRQYRLHHYLDFIYYRSADGRRFRQACDMVHHFTTEVIQERRRALRQQGAEAWLKAKQGKTLDFIDVLLLARDEDGKELSDEDIRAEADTFMFEGHDTTSSGISWMLFNLAKYPEYQEKCREEIQEVMKGRELEELEWDDLTQLPFTTMCIKESLRQYPPVTLVSRQCTEDIKLPDGRIIPKGIICLVSIYGTHHNPTVWPDSKVYNPYRFDPDNPQQRSPLAYVPFSAGPRNCIGQSFAMAELRVVVALTLLRFRLSVDRTRKVRRKPELILRTENGLWLKVEPLPPRA

SEQ ID NO: 1200 - protein, 525 aa, unidentified
MAGLWLGLVWQKLLLWGAASALSLAGASLVLSLLQRVASYARKWQQMRPIPTVARAYPLVGHALLMKPDGREFFQQIIEYTEEYRHMPLLKLWVGPVPMVALYNAENVEVILTSSKQIDKSSMYKFLEPWLGLGLLTSTGNKWRSRRKMLTPTFHFTILEDFLDIMNEQANILVKKLEKHINQEAFNCFFYITLCALDIICETAMGKNIGAQSNDDSEYVRAVYRMSEMIFRRIKMPWLWLDLWYLMFKEGWEHKKSLQILHTFTNSVIAERANEMNANEDCRGDGRGSAPSKNKRRAFLDLLLSVTDDEGNRLSHEDIREEVDTFMFEGHDTTAAAINWSLYLLGSNPEVQKKVDHELDDVFGKSDRPATVEDLKKLRYLECVIKETLRLFPSVPLFARSVSEDCEVAGYRVLKGTEAVIIPYALHRDPRYFPNPEEFQPERFFPENAQGRHPYAYVPFSAGPRNCIGQKFAVMEEKTILSCILRHFWIESNQKREELGLEGQLILRPSNGIWIKLKRRNADER

SEQ ID NO: 1201 - protein, 509 aa, unidentified
MEFSWLETRWARPFYLAFVFCLALGLLQAIKLYLRRQRLLRDLRPFPAPPTHWFLGHQKFIQDDNMEKLEEIIEKYPRAFPFWIGPFQAFFCIYDPDYAKTLLSRTDPKSQYLQKFSPPLLGKGLAALDGPKWFQHRRLLTPGFHFNILKAYIEVMAHSVKMMLDKWEKICSTQDTSVEVYEHINSMSLDIIMKCAFSKETNCQTNSTHDPYAKAIFELSKIIFHRLYSLLYHSDIIFKLSPQGYRFQKLSRVLNQYTDTIIQERKKSLQAGVKQDNTPKRKYQDFLDIVLSAKDESGSSFSDIDVHSEVSTFLLAGHDTLAASISWILYCLALNPEHQERCREEVRGILGDGSSITWDQLGEMSYTTMCIKETCRLIPAVPSISRDLSKPLTFPDGCTLPAGITVVLSIWGLHHNPAVWKNPKVFDPLRFSQENSDQRHPYAYLPFSAGSRNCIGQEFAMIELKVTIALILLHFRVTPDPTRPLTFPNHFILKPKNGMYLHLKKLSEC

SEQ ID NO: 1202 - protein, 505 aa, unidentified
MEPSWLQELMAHPFLLLILLCMSLLLFQVIRLYQRRRWMIRALHLFPAPPAHWFYGHKEFYPVKEFEVYHKLMEKYPCAVPLWVGPFTMFFSVHDPDYAKILLKRQDPKSAVSHKILESWVGRGLVTLDGSKWKKHRQIVKPGFNISILKIFITMMSESVRMMLNKWEEHIAQNSRLELFQHVSLMTLDSIMKCAFSHQGSIQLDSTLDSYLKAVFNLSKISNQRMNNFLHHNDLVFKFSSQGQIFSKFNQELHQFTEKVIQDRKESLKDKLKQDTTQKRRWDFLDILLSAKSENTKDFSEADLQAEVKTFMFAGHDTTSSAISWILYCLAKYPEHQQRCRDEIRELLGDGSSITWEHLSQMPYTTMCIKECLRLYAPVVNISRLLDKPITFPDGRSLPAGITVFINIWALHHNPYFWEDPQVFNPLRFSRENSEKIHPYAFIPFSAGLRNCIGQHFAIIECKVAVALTLLRFKLAPDHSRPPQPVRQVVLKSKNGIHVFAKKVC

SEQ ID NO: 1203 - protein, 503 aa, unidentified [sequence omitted]

SEQ ID NO: 1204 - protein, 506 aa, unidentified
MAGEVSAATGRFSLERLGLPGLALAAALLLLALCLLVRRTRRPGEPPLIKGWLPYLGVVLNLRKDPLRFMKTLQKQHGDTFTVLLGGKYITFILDPFQYQLVIKNHKQLSFRVFSNKLLEKAFSISQLQKNHDMNDELHLCYQFLQGKSLDILLESMMQNLKQVFEPQLLKTTSWDTAELYPFCSSIIFEITFTTIYGKVIVCDNNKFISELRDDFLKFDDKFAYLVSNIPIELLGNVKSIREKIIKCFSSEKLAKMQGWSEVFQSRQDVLEKYYVHEDLEIGAHHLGFLWASVANTIPTMFWAMYYLLRHPEAMAAVRDEIDRLLQSTGQKKGSGFPIHLTREQLDSLICLESSIFEALRLSSYSTTIRFVEEDLTLSSETGDYCVRKGDLVAIFPPVLHGDPEIFEAPEEFRYDRFIEDGKKKTTFFKRGKKLKCYLMPFGTGTSKCPGRFFALMEIKQLLVILLTYFDLEIIDDKPIGLNYSRLLFGIQYPDSDVLFRYKVKS

SEQ ID NO: 1205 - protein, 501 aa, unidentified
MVLWGPVLGALLVVIAGYLCLPGMLRQRRPWEPPLDKGTVPWLGHAMAFRKNMFEFLKRMRTKHGDVFTVQLGGQYFTFVMDPLSFGSILKDTQRKLDFGQYAKKLVLKVFGYRSVQGDHEMIHSASTKHLRGDGLKDLNETMLDSLSFVMLTSKGWSLDASCWHEDSLFRFCYYILFTAGYLSLFGYTKDKEQDLLQAGELFMEFRKFDLLFPRFVYSLLWPREWLEVGRLQRLFHKMLSVSHSQEKEGISNWLGNMLQFLREQGVPSAMQDKFNFMMLWASQGNTGPTSFWALLYLLKHPEAIRAVREEATQVLGEARLETKQSFAFKLGALQHTPVLDSVVEETLRLRAAPTLLRLVHEDYTLKMSSGQEYLFRHGDILALFPYLSVHMDPDIHPEPTVFKYDRFLNPNGSRKVDFFKTGKKIHHYTMPWGSGVSICPGRFFALSEVKLFILLMVTHFDLELVDPDTPLPHVDPQRWGFGTMQPSHDVRFRYRLHPTE

SEQ ID NO: 1206 - protein, 337 aa, unidentified
MDETGNLTVSSATCHDTIDDFRNQVYSTLYSMISVVGFFGNGFVLYVLIKTYHKKSAFQVYMINLAVADLLCVCTLPLRVVYYVHKGIWLFGDFLCRLSTYALYVNLYCSIFFMTAMSFFRCIAIVFPVQNINLVTQKKARFVCVGIWIFVILTSSPFLMAKPQKDEKNNTKCFEPPQDNQTKNHVLVLHYVSLFVGFIIPFVIIIVCYTMIILTLLKKSMKKNLSSHKKAIGMIMVVTAAFLVSFMPYHIQRTIHLHFLHNETKPCDSVLRMQKSVVITLSLAASNCCFDPLLYFFSGGNFRKRLSTFRKHSLSSVTYVPRKKASLPEKGEEICKV

SEQ ID NO: 1207 - protein, 346 aa, unidentified
MERKFMSLQPSISVSEMEPNGTFSNNNSRNCTIENFKREFFPIVYLIIFFWGVLGNGLSIYVFLQPYKKSTSVNVFMLNLAISDLLFISTLPFRADYYLRGSNWIFGDLACRIMSYSLYVNMYSSIYFLTVLSVVRFLAMVHPFRLLHVTSIRSAWILCGIIWILIMASSIMLLDSGSEQNGSVTSCLELNLYKIAKLQTMNYIALVVGCLLPFFTLSICYLLIIRVLLKVEVPESGLRVSHRKALTTIIITLIIFFLCFLPYHTLRTVHLTTWKVGLCKDRLHKALVITLALAAANACFNPLLYYFAGENFKDRLKSALRKGHPQKAKTKCVFPVSVWLRKETRV

SEQ ID NO: 1208 - protein, 154 aa, unidentified
MDAPRLPVRPGVLLPKLVLLFVYADDCLAQCGKDCKSYCCDGTTPYCCSYYAYIGNILSGTAIAGIVFGIVFIMGVIAGIAICICMCMKNHRATRVGILRTTHINTVSSYPGPPPYGHDHEMEYCADLPPPYSPTPQGPAQRSPPPPYPGNARK

SEQ ID NO: 1209 - protein, 113 aa, unidentified
MSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 1210 - protein, 895 aa, unidentified
MRMSVGLSLLLPLSGRTFLLLLSVVMAQSHWPSEPSEAVRDWENQLEASMHSVLSDLHEAVPTVVGIPDGTAVVGRSFRVTIPTDLIASSGDIIKVSAAGKEALPSWLHWDSQSHTLEGLPLDTDKGVHYISVSATRLGANGSHIPQTSSVFSIEVYPEDHSELQSVRTASPDPGEVVSSACAADEPVTVLTVILDADLTKMTPKQRIDLLHRMRSFSEVELHNMKLVPVVNNRLFDMSAFMAGPGNAKKVVENGALLSWKLGCSLNQNSVPDIHGVEAPAREGAMSAQLGYPVVGWHIANKKPPLPKRVRRQIHATPTPVTAIGPPTTAIQEPPSRIVPTPTSPAIAPPTETMAPPVRDPVPGKPTVTIRTRGAIIQTPTLGPIQPTRVSEAGTTVPGQIRPTMTIPGYVEPTAVATPPTTTTKKPRVSTPKPATPSTDSTTTTTRRPTKKPRTPRPVPRVTTKVSITRLETASPPTRIRTTTSGVPRGGEPNQRPELKNHIDRVDAWVGTYFEVKIPSDTFYDHEDTTTDKLKLTLKLREQQLVGEKSWVQFNSNSQLMYGLPDSSHVGKHEYFMHATDKGGLSAVDAFEIHVHRRPQGDRAPARFKAKFVGDPALVLNDIHKKIALVKKLAFAFGDRNCSTITLQNITRGSIVVEWTNNTLPLEPCPKEQIAGLSRRIAEDDGKPRPAFSNALEPDFKATSITVTGSGSCRHLQFIPVVPPRRVPSEAPPTEVPDRDPEKSSEDDVYLHTVIPAVVVAAILLIAGIIAMICYRKKRKGKLTLEDQATFIKKGVPIIFADELDDSKPPPSSSMPLILQEEKAPLPPPEYPNQSVPETTPLNQDTMGEYTPLRDEDPNAPPYQPPPPFTAPMEGKGSRPKNMTPYRSPPPYVPP

SEQ ID NO: 1211 - protein, 1042 aa, unidentified
MPGIVVFRRRWSVGSDDLVLPAIFLFLLHTTWFVILSVVLFGLVYNPHEACSLNLVDHGRGYLGILLSCMIAEMAIIWLSMRGGILYTEPRDSMQYVLYVRLAILVIEFIYAIVGIVWLTQYYTSCNDLTAKNVTLGMVVCNWVVILSVCITVLCVFDPTGRTFVKLRATKRRQRNLRTYNLRHRLEEGQATSWSRRLKVFLCCTRTKDSQSDAYSEIAYLFAEFFRDLDIVPSDIIAGLVLLRQRQRAKRNAVLDEANNDILAFLSGMPVTRNTKYLDLKNSQEMLRYKEVCYYMLFALAAYGWPMYLMRKPACGLCQLARSCSCCLCPARPRFAPGVTIEEDNCCGCNAIAIRRHFLDENMTAVDIVYTSCHDAVYETPFYVAVDHDKKKVVISIRGTLSPKDALTDLTGDAERLPVEGHHGTWLGHKGMVLSAEYIKKKLEQEMVLSQAFGRDLGRGTKHYGLIVVGHSLGAGTAAILSFLLRPQYPTLKCFAYSPPGGLLSEDAMEYSKEFVTAVVLGKDLVPRIGLSQLEGFRRQLLDVLQRSTKPKWRIIVGATKCIPKSELPEEVEVTTLASTRLWTHPSDLTIALSASTPLYPPGRIIHVVHNHPAEQCCCCEQEEPTYFAIWGDNKAFNEVIISPAMLHEHLPYVVMEGLNKVLENYNKGKTALLSAAKVMVSPTEVDLTPELIFQQQPLPTGPPMPTGLALELPTADHRNSSVRSKSQSEMSLEGFSEGRLLSPVVAAAARQDPVELLLLSTQERLAAELQARRAPLATMESLSDTESLYSFDSRRSSGFRSIRGSPSLHAVLERDEGHLFYIDPAIPEENPSLSSRTELLAADSLSKHSQDTQPLEAALGSGGVTPERPPSAAANDEEEEVGGGGGGPASRGELALHNGRLGDSPSPQVLEFAEFIDSLFNLDSKSSSFQDLYCMVVPESPTSDYAEGPKSPSQQEILLRAQFEPNLVPKPPRLFAGSADPSSGISLSPSFPLSSSGELMDLTPTGLSSQECLAADKIRTSTPTGHGASPAKQDELVISAR

SEQ ID NO: 1212 - protein, 672 aa, unidentified
MPGMVLFGRRWAIASDDLVFPGFFELVVRVLWWIGILTLYLMHRGKLDCAGGALLSSYLIVLMILLAVVICTVSAIMCVSMRGTICNPGPRKSMSKLLYIRLALFFPEMVWASLGAAWVADGVQCDRTVVNGIIATVVVSWIIIAATVVSIIIVFDPLGGKMAPYSSAGPSHLDSHDSSQLLNGLKTAATSVWETRIKLLCCCIGKDDHTRVAFSSTAELFSTYFSDTDLVPSDIAAGLALLHQQQDNIRNNQEPAQVVCHAPGSSQEADLDAELENCHHYMQFAAAAYGWPLYIYRNPLTGLCRIGGDCCRSRTTDYDLVGGDQLNCHFGSILHTTGLQYRDFIHVSFHDKVYELPFLVALDHRKESVVVAVRGTMSLQDVLTDLSAESEVLDVECEVQDRLAHKGISQAARYVYQRLINDGILSQAFSIAPEYRLVIVGHSLGGGAAALLATMLRAAYPQVRCYAFSPPRGLWSKALQEYSQSFIVSLVLGKDVIPRLSVTNLEDLKRRILRVVAHCNKPKYKILLHGLWYELFGGNPNNLPTELDGGDQEVLTQPLLGEQSLLTRWSPAYSFSSDSPLDSSPKYPPLYPPGRIIHLQEEGASGRFGCCSAAHYSAKWSHEAEFSKILIGPKMLTDHMPDILMRALDSVVSDRAACVSCPAQGVSSVDVA

SEQ ID NO: 1213 - protein, 1430 aa, unidentified
MTVFRQENVDDYYDTGEELGSGQFAVVKKCREKSTGLQYAAKFIKKRRTKSSRRGVSREDIEREVSILKEIQHPNVITLHEVYENKTDVILILELVAGGELFDFLAEKESLTEEEATEFLKQILNGVYYLHSLQIAHFDLKPENIMLLDRNVPKPRIKIIDFGLAHKIDFGNEFKNIFGTPEFVAPEIVNYEPLGLEADMWSIGVITYILLSGASPFLGDTKQETLANVSAVNYEFEDEYFSNTSALAKDFIRRLLVKDPKKRMTIQDSLQHPWIKPKDTQQALSRKASAVNMEKFKKFAARKKWKQSVRLISLCQRLSRSFLSRSNMSVARSDDTLDEEDSFVMKAIIHAINDDNVPGLQHLLGSLSNYDVNQPNKHGTPPLLIAAGCGNIQILQLLIKRGSRIDVQDKGGSNAVYWAARHGHVDTLKFLSENKCPLDVKDKSGEMALHVAARYGHADVAQLLCSFGSNPNIQDKEEETPLHCAAWHGYYSVAKALCEAGCNVNIKNREGETPLLTASARGYHDIVECLAEHGADLNACDKDGHIALHLAVRRCQMEVIKTLLSQGCFVDYQDRHGNTPLHVACKDGNMPIVVALCEANCNLDISNKYGRTPLHLAANNGILDVVRYLCLMGASVEALTTDGKTAEDLARSEQHEHVAGLLARLRKDTHRGLFIQQLRPTQNLQPRIKLKLFGHSGSGKTTLVESLKCGLLRSFFRRRRPRLSSTNSSRFPPSPLASKPTVSVSINNLYPGCENVSVRSRSMMFEPGLTKGMLEVFVAPTHHPHCSADDQSTKAIDIQNAYLNGVGDFSVWEFSGNPVYFCCYDYFAANDPTSIHVVVFSLEEPYEIQLNQVIFWLSFLKSLVPVEEPIAFGGKLKNPLQVVLVATHADIMNVPRPAGGEFGYDKDTSLLKEIRNRFGNDLHISNKLFVLDAGASGSKDMKVLRNHLQEIRSQIVSVCPPMTHLCEKIISTLPSWRKLNGPNQLMSLQQFVYDVQDQLNPLASEEDLRRIAQQLHSTGEINIMQSETVQDVLLLDPRWLCTNVLGKLLSVETPRALHHYRGRYTVEDIQRLVPDSDVEELLQILDAMDICARDLSSGTMVDVPALIKTDNLHRSWADEEDEVMVYGGVRIVPVEHLTPFPCGIFHKVQVNLCRWIHQQSTEGDADIRLWVNGCKLANRGAELLVLLVNHGQGIEVQVRGLETEKIKCCLLLDSVCSTIENVMATTLPGLLTVKHYLSPQQLREHHEPVMIYQPRDFFRAQTLKETSLTNTMGGYKESFSSIMCFGCHDVYSQASLGMDIHASDLNLLTRRKLSRLLDPPDPLGKDWCLLAMNLGLPDLVAKYNTSNGAPKDFLPSPLHALLREWTTYPESTVGTLMSKLRELGRRDAADFLLKASSVFKINLDGNGQEAYASSCNSGTSYNSISSVVSR

SEQ ID NO: 1214 - protein, 370 aa, unidentified
MFQASMRSPNMEPFKQQKVEDFYDIGEELGSGQFAIVKKCREKSTGLEYAAKFIKKRQSRASRRGVSREEIEREVSILRQVLHHNVITLHDVYENRTDVVLILELVSGGELFDFLAQKESLSEEEATSFIKQILDGVNYLHTKKIAHFDLKPENIMLLDKNIPIPHIKLIDFGLAHEIEDGVEFKNIFGTPEFVAPEIVNYEPLGLEADMWSIGVITYILLSGASPFLGDTKQETLANITAVSYDFDEEFFSQTSELAKDFIRKLLVKETRKRLTIQEALRHPWITPVDNQQAMVRRESVVNLENFRKQYVRRRWKLSFSIVSLCNHLTRSLMKKVHLRPDEDLRNCESDTEEDIARRKALHPRRRSSTS

SEQ ID NO: 1215 - protein, 454 aa, unidentified
MSTFRQEDVEDHYEMGEELGSGQFAIVRKCRQKGTGKEYAAKFIKKRRLSSSRRGVSREEIEREVNILREIRHPNIITLHDIFENKTDVVLILELVSGGELFDFLAEKESLTEDEATQFLKQILDGVHYLHSKRIAHFDLKPENIMLLDKNVPNPRIKLIDFGIAHKIEAGNEFKNIFGTPEFVAPEIVNYEPLGLEADMWSIGVITYILLSGASPFLGETKQETLTNISAVNYDFDEEYFSNTSELAKDFIRRLLVKDPKRRMTIAQSLEHSWIKAIRRRNVRGEDSGRKPERRRLKTTRLKEYTIKSHSSLPPNNSYADFERFSKVLEEAAAAEEGLRELQRSRRLCHEDVEALAAIYEEKEAWYREESDSLGQDLRRLRQELLKTEALKRQAQEEAKGALLGTSGLKRRFSRLENRYEALAKQVASEMRFVQDLVRALEQEKLQGVECGLR

SEQ ID NO: 1216 - protein, 107 aa, unidentified
MANEVQDLLSPRKGGHPPAVKAGGMRISKKQEIGTLERHTKKTGFEKTSAIANVAKIQTLDALNDALEKLNYKFPATVHMAHQKPTPALEKVVPLKRIYIIQQPRKC

SEQ ID NO: 1217 - protein, 520 aa, unidentified
MGPTRKPNVCSRLSRRALGCFSRDAGVVQRTNLGILRALVCQESTKFKNVWTTHSRSPIAYERGRIYFDNYRRCVSSVASEPRKLYEMPKCSKSEKIEDALLWECPVGDILPNSSDYKSSLIALTAHNWLLRISATTGKILEKIYLAPYCKFRYLSWDTPQEVIAVKSAQNRGSAVARQAGIQQHVLLYLAVFRVLPFSLVGILEINKKIFGNVTDATLSHGILIVMYSSGLVRLYSFQTIAEQFMQQKLDLGCACRWGGTTGTVGEAPFGIPCNIKITDMPPLLFEVSSLENAFQIGGHPWHYIVTPNKKKQKGVFHICALKDNSLAKNGIQEMDCCSLESDWIYFHPDASGRIIHVGPNQVKVLKLTEIENNSSQHQISEDFVILANRENHKNENVLTVTASGRVVKKSFNLLDDDPEQETFKIVDYEDELDLLSVVAVTQIDAEGKAHLDFHCNEYGTLLKSIPLVESWDVTYSHEVYFDRDLVLHIEQKPNRVFSCYVYQMICDTGEEEETINRSC

SEQ ID NO: 1218 - protein, 231 aa, unidentified
MFLVGLTGGIASGKSSVIQVFQQLGCAVIDVDVMARHVVQPGYPAHRRIVEVFGTEVLLENGDINRKVLGDLIFNQPDRRQLLNAITHPEIRKEMMKETFKYFLRGYRYVILDIPLLFETKKLLKYMKHTVVVYCDRDTQLARLMRRNSLNRKDAEARINAQLPLTDKARMARHVLDNSGEWSVTKRQVILLHTELERSLEYLPLRFGVLTGLAAIASLLYLLTHYLLPYA

SEQ ID NO: 1219 - protein, 715 aa, unidentified
MVPGARGGGALARAAGRGLLALLLAVSAPLRLQAEELGDGCGHLVTYQDSGTMTSKNYPGTYPNHTVCEKTITVPKGKRLILRLGDLDIESQTCASDYLLFTSSSDQYGPYCGSMTVPKELLLNTSEVTVRFESGSHISGRGFLLTYASSDHPDLITCLERASHYLKTEYSKFCPAGCRDVAGDISGNMVDGYRDTSLLCKAAIHAGIIADELGGQISVLQRKGISRYEGILANGVLSRDGSLSDKRFLFTSNGCSRSLSFEPDGQIRASSSWQSVNESGDQVHWSPGQARLQDQGPSWASGDSSNNHKPREWLEIDLGEKKKITGIRTTGSTQSNFNFYVKSFVMNFKNNNSKWKTYKGIVNNEEKVFQGNSNFRDPVQNNFIPPIVARYVRVVPQTWHQRIALKVELIGCQITQGNDSLVWRKTSQSTSVSTKKEDETITRPIPSEETSTGINITTVAIPLVLLVVLVFAGMGIFAAFRKKKKKGSPYGSAEAQKTDCWKQIKYPFARHQSAEFTISYDNEKEMTQKLDLITSDMADYQQPLMIGTGTVTRKGSTFRPMDTDAEEAGVSTDAGGHYDCPQRAGRHEYALPLAPPEPEYATPIVERHVLRAHTFSAQSGYRVPGPQPGHKHSLSSGGFSPVAGVGAQDGDYQRPHSAQPADRGYDRPKAVSALATESGHPDSQKPPTHPGTSDSYSAPRDCLTPLNQTAMTALL

SEQ ID NO: 1220 - protein, 775 aa, unidentified
MASRAVVRARRCPQCPQVRAAAAAPAWAALPLSRSLPPCSNSSSFSMPLFLLLLLVLLLLLEDAGAQQGDGCGHTVLGPESGTLTSINYPQTYPNSTVCEWEIRVKMGERVRIKFGDFDIEDSDSCHFNYLRIYNGIGVSRTEIGKYCGLGLQMNHSIESKGNEITLLFMSGIHVSGRGFLASYSVIDKQDLITCLDTASNFLEPEFSKYCPAGCLLPFAEISGTIPHGYRDSSPLCMAGVHAGVVSNTLGGQISVVISKGIPYYESSLANNVTSVVGHLSTSLFTFKTSGCYGTLGMESGVIADPQITASSVLEWTDHTGQENSWKPKKARLKKPGPPWAAFATDEYQWLQIDLNKEKKITGIITTGSTMVEHNYYVSAYRILYSDDGQKWTVYREPGVEQDKIFQGNKDYHQDVRNNFLPPIIARFIRVNPTQWQQKIAMKMELLGCQFIPKGRPPKLTQPPPPRNSNDLKNTTAPPKIAKGRAPKFTQPLQPRSSNEFPAQTEQTTASPDIRNTTVTPNVTKDVALAAVLVPVLVMVLTTLILILVCAWHWRNRKKKTEGTYDLPYWDRAGWWKGMKQFLPAKAVDHEETPVRYSSSEVNHLSPREVTTVLQADSAEYAQPLVGGIVGTLHQRSTFKPEEGKEAGYADLDPYNSPGQEVYHAYAEPLPITGPEYATPIIMDMSGHPTTSVGQPSTSTFKATGNQPPPLVGTYNTLLSRTDSCSSAQAQYDTPKAGKPGLPAPDELVYQVPQSTQEVSGAGRDGECDVFKEIL

SEQ ID NO: 1221 - protein, 1447 aa, unidentified
MENSLRCVWVPKLAFVLFGASLFSAHLQVTGFQIKAFTALRFLSEPSDAVTMRGGNVLLDCSAESDRGVPVIKWKKDGIHLALGMDERKQQLSNGSLLIQNILHSRHHKPDEGLYQCEASLGDSGSIISRTAKVAVAGPLRFLSQTESVTAFMGDTVLLKCEVIGEPMPTIHWQKNQQDLTPIPGDSRVVVLPSGALQISRLQPGDIGIYRCSARNPASSRTGNEAEVRILSDPGLHRQLYFLQRPSNVVAIEGKDAVLECCVSGYPPPSFTWLRGEEVIQLRSKKYSLLGGSNLLISNVTDDDSGMYTCVVTYKNENISASAELTVLVPPWFLNHPSNLYAYESMDIEFECTVSGKPVPTVNWMKNGDVVIPSDYFQIVGGSNLRILGVVKSDEGFYQCVAENEAGNAQTSAQLIVPKPAIPSSSVLPSAPRDVVPVLVSSRFVRLSWRPPAEAKGNIQTFTVFFSREGDNRERALNTTQPGSLQLTVGNLKPEAMYTFRVVAYNEWGPGESSQPIKVATQPELQVPGPVENLQAVSTSPTSILITWEPPAYANGPVQGYRLFCTEVSTGKEQNIEVDGLSYKLEGLKKFTEYSLRFLAYNRYGPGVSTDDITVVTLSDVPSAPPQNVSLEVVNSRSIKVSWLPPPSGTQNGFITGYKIRHRKTTRRGEMETLEPNNLWYLFTGLEKGSQYSFQVSAMTVNGTGPPSNWYTAETPENDLDESQVPDQPSSLHVRPQTNCIIMSWTPPLNPNIVVRGYIIGYGVGSPYAETVRVDSKQRYYSIERLESSSHYVISLKAFNNAGEGVPLYESATTRSITDPTDPVDYYPLLDDFPTSVPDLSTPMLPPVGVQAVALTHDAVRVSWADNSVPKNQKTSEVRLYTVRWRTSFSASAKYKSEDTTSLSYTATGLKPNTMYEFSVMVTKNRRSSTWSMTAHATTYEAAPTSAPKDLTVITREGKPRAVIVSWQPPLEANGKITAYILFYTLDKNIPIDDWIMETISGDRLTHQIMDLNLDTMYYFRIQARNSKGVGPLSDPILFRTLKVEHPDKMANDQGRHGDGGYWPVDTNLIDRSTLNEPPIGQMHPPHGSVTPQKNSNLLVIIVVTVGVITVLVVVIVAVICTRRSSAQQRKKRATHSAGKRKGSQKDLRPPDLWIHHEEMEMKNIEKPSGTDPAGRDSPIQSCQDLTPVSHSQSETQLGSKSTSHSGQDTEEAGSSMSTLERSLAARRAPRAKLMIPMDAQSNNPAVVSAIPVPTLESAQYPGILPSPTCGYPHPQFTLRPVPFPTLSVDRGFGAGRSQSVSEGPTTQQPPMLPPSQPEHSSSEEAPSRTIPTACVRPTHPLRSFANPLLPPPMSAIEPKVPYTPLLSQPGPTLPKTHVKTASLGLAGKARSPLLPVSVPTAPEVSEESHKPTEDSANVYEQDDLSEQMASLEGLMKQLNAITGSAF

SEQ ID NO: 1222 - protein, 3298 aa, unidentified
MQKELGIVPSCPGMKSPRPHLLLPLLLLLLLLLGAGVPGAWGQAGSLDLQIDEEQPAGTLIGDISAGLPAGTAAPLMYFISAQEGSGVGTDLAIDEHSGVVRTARVLDREQRDRYRFTAVTPDGATVEVTVRVADINDHAPAFPQARAALQVPEHTAFGTRYPLEPARDADAGRLGTQGYALSGDGAGETFRLETRPGPDGTPVPELVVTGELDRENRSHYMLQLEAYDGGSPPRRAQALLDVTLLDINDHAPAFNQSRYHAVVSESLAPGSPVLQVFASDADAGVNGAVTYEINRRQSEGDGPFSIDAHTGLLQLERPLDFEQRRVHELVVQARDGGAHPELGSAFVTVHVRDANDNQPSMTVIFLSADGSPQVSEAAPPGQLVARISVSDPDDGDFAHVNVSLEGGEGHFALSTQDSVIYLVCVARRLDREERDAYNLRVTATDSGSPPLRAEAAFVLHVTDVNDNAPAFDRQLYRPEPLPEVALPGSFVVRVTARDPDQGTNGQVTYSLAPGAHTHWFSIDPTSGIITTAASLDYELEPQPQLIVVATDGGLPPLASSATVSVALQDVNDNEPQFQRTFYNASLPEGTQPGTCFLQVTATDADSGPFGLLSYSLGAGLGSSGSPPFRIDAHSGDVCTTRTLDRDQGPSSFDFTVTAVDGGGLKSMVYVKVFLSDENDNPPQFYPREYAASISAQSPPGTAVLRLRAHDPDQGSHGRLSYHILAGNSPPLFTLDEQSGLLTVAWPLARRANSVVQLEIGAEDGGGLQAEPSARVDISIVPGTPTPPIFEQLQYVFSVPEDVAPGTSVGIVQAHNPPGRLAPVTLSLSGGDPRGLFSLDAVSGLLQTLRPLDRELLGPVLELEVRAGSGVPPAFAVARVRVLLDDVNDNSPAFPAPEDTVLLPPNTAPGTPIYTLRALDPDSGVNSRVTFTLLAGGGGAFTVDPTTGHVRLMRPLGPSGGPAHELELEARDGGSPPRTSHFRLRVVVQDVGTRGLAPRFNSPTYRVDLPSGTTAGTQVLQVQAQAPDGGPITYHLAAEGASSPFGLEPQSGWLWVRAALDREAQELYILKVMAVSGSKAELGQQTGTATVRVSILNQNEHSPRLSEDPTFLAVAENQPPGTSVGRVFATDRDSGPNGRLTYSLQQLSEDSKAFRIHPQTGEVTTLQTLDREQQSSYQLLVQVQDGGSPPRSTTGTVHVAVLDLNDNSPTFLQASGAAGGGLPIQVPDRVPPGTLVTTLQAKDPDEGENGTILYTLTGPGSELFSLHPHSGELLTAAPLIRAERPHYVLTLSAHDQGSPPRSASLQLLVQVLPSARLAEPPPDLAERDPAAPVPVVLTVTAAEGLRPGSLLGSVAAPEPAGVGALTYTLVGGADPEGTFALDAASGRLYLARPLDFEAGPPWRALTVRAEGPGGAGARLLRVQVQVQDENEHAPAFARDPLALALPENPEPGAALYTFRASDADGPGPNSDVRYRLLRQEPPVPALRLDARTGALSAPRGLDRETTPALLLLVEATDRPANASRRRAARVSARVFVTDENDNAPVFASPSRVRLPEDQPPGPAALHVVARDPDLGEAARVSYRLASGGDGHFRLHSSTGALSVVRPLDREQRAEHVLTVVASDHGSPPRSATQVLTVSVADVNDEAPTFQQQEYSVLLRENNPPGTSLLTLRATDPDVGANGQVTYGGVSSESFSLDPDTGVLTTLRALDREEQEEINLTVYAQDRGSPPQLTHVTVRVAVEDENDHAPTFGSAHLSLEVPEGQDPQTLTMLRASDPDVGANGQLQYRILDGDPSGAFVLDLASGEFGTMRPLDREVEPAFQLRIEARDGGQPALSATLLLTVTVLDANDHAPAFPVPAYSVEVPEDVPAGTLLLQLQAHDPDAGANGHVTYYLGAGTAGAFLLEPSSGELRTAAALDREQCPSYTFSVSAVDGAAAGPLSTTVSVTITVRDVNDHAPTFPTSPLRLRLPRPGPSFSTPTLALATLRAEDRDAGANASILYRLAGTPPPGTTVDSYTGEIRVARSPVALGPRDRVLFIVATDLGRPARSATGVIIVGLQGEAERGPRFPRASSEATIRENAPPGTPIVSPRAVHAGGTNGPITYSILSGNEKGTFSIQPSTGAITVRSAEGLDFEVSPRLRLVLQAESGGAFAFTVLTLTLQDANDNAPRFLRPHYVAFLPESRPLEGPLLQVEADDLDQGSGGQISYSLAASQPARGLFHVDPTTGTITTTAILDREIWAETRLVLMATDRGSPALVGSATLTVMVIDTNDNRPTIPQPWELRVSEDALLGSEIAQVTGNDVDSGPVLWYVLSPSGPQDPFSVGRYGGRVSLTGPLDFEQCDRYQLQLLAHDGPHEGRANLTVLVEDVNDNAPAFSQSLYQVMLLEHTPPGSAILSVSATDRDSGANGHISYHLASPADGFSVDPNNGTLFTIVGTVALGHDGSGAVDVVLEARDHGAPGRAARATVHVQLQDQNDHAPSFTLSHYRVAVTEDLPPGSTLLTLEATDADGSRSHAAVDYSIISGNWGRVFQLEPRLAEAGESAGPGPRALGCLVLLEPLDFESLTQYNLTVAAADRGQPPQSSVVPVTVTVLDVNDNPPVFTRASYRVTVPEDTPVGAELLHVEASDADPGPHGLVRFTVSSGDPSGLFELDESSGTLRLAHALDCETQARHQLVVQAADPAGAHFALAPVTIEVQDVNDHGPAFPLNLLSTSVAENQPPGTLVTTLHAIDGDAGAFGRLRYSLLEAGPGPEGREAFALNSSTGELRARVPFDYEHTESFRLLVGAADAGNLSASVTVSVLVTGEDEYDPVFLAPAFHFQVPEGARRGHSLGHVQATDEDGGADGLVLYSLATSSPYFGINQTTGALYLRVDSRAPGSGTATSGGGGRTRREAPRELRLEVIARGPLPGSRSATVPVTVDITHTALGLAPDLNLLLVGAVAASLGVVVVLALAALVLGLVRARSRKAEAAPGPMSQAAPLASDSLQKLGREPPSPPPSEHLYHQTLPSYGGPGAGGPYPRGGSLDPSHSSGRGSAEAAEDDEIRMINEFPRVASVASSLAARGPDSGIQQDADGLSDTSCEPPAPDTWYKGRKAGLLLPGAGATLYREEGPPATATAFLGGCGLSPAPTGDYGFPADGKPCVAGALTAIVAGEEELRGSYNWDYLLSWCPQFQPLASVFTEIARLKDEARPCPPAPRIDPPPLITAVAHPGAKSVPPKPANTAAARAIFPPASHRSPISHEGSLSSAAMSPSFSPSLSPLAARSPVVSPFGVAQGPSASALSAESGLEPPDDTELHI

SEQ ID NO: 1223 - protein, 2916 aa, unidentified
MRLDEITKSENEDGEKKMFTQQFESTDACVYEVYVKINSIVKSQSQCGLKRGSPETELWGAIVFRSQEENAKPVKETEVTASDADSGLYGFIEYSLYDGFLSYEAPQAFRIDPHDGQICVSQDIDRERDPATYDLLVEAKDGDEQRMTHLALVKGGLSAQAFVRVDLEDVNDNHPVFNPSTYVTSISDETQPGTEIINVLATDQDSGIYGTVAYELIPGNVSSLFTIDSTTGLYSPEVEILSAVNFSADKEVMNSLEMFLPLLRHFKKVERDEEAAEKKFEASRGWFMRFKGRRHLHYLKVQDEAASADGEAAARYVANLAKILGEGIIYLTLPLSHLESTTLSLMVSAQDGGGLTAVINADVTIHIFQTTLAPAEFERPKYTFLVYEDVPEDSPIGTVKAREPLNSSEPIFYRISSGDLGGKFSIHPRLGTIRTRKPLDHETQPVVVLTVQAQLGSAPACSSTEVNITVMDVNDNHPAFLRTSDEIRISQTTPPGTALYLARAEDRDSGRNGLIRYSIASPQPGVFAIDRALGVLFLNGSLGAGEQRELTLTLRAEDQGVHPQAALLVLTVVIEKREHSPSWTFEHLVYQVEVSESLSPMTQMLQTQAHPLGPQRAASPLRYSLEPSVDSAMFGIRPYTGWIYLRRQFDYESTQTYNFRVFAWIPEDGFLQNVSTTVIVRVWDENDNSPTFLHDVLFLKVEESPVPQGVIGKITAIDMDSGKNGQLLYFLLSDGKFFKMNPNTGPAGTIYVITWADGAAAFSGTDFAFSSDELQAFVLKSLFCELGEGELINWVALDREHRGHHEMTVLVTDRGSPPRNATMAVYVSVTDINDNRPFFPQCLPGKELHVKVLEGQPVNMLVTTVFAKDPDEGNNAEVTYSVSSEDSSDHFKIDANNGEIRTTTILSYDYRPSYRMSVIATDQGVPPLQGQAVVNIQVIPLSKGRAIMSQNIRHLIIPENLKPTKIMSLIKSSDHLQQHYNGKLHFSIVADDKDGHFEIDSSTGDLFLSKELDYETTSHYLFRVITTDHSKNLSLSSTVFLSIDVEDQNDHSPSFQDELIVISVEENVPIGTLVYVFNAKDDDGSFLNSRIQYYIESHNPGTNPFLIHPSFGTLVTVSRLDRESIPTVILTVTASDQAVNVTDRRLRSLTAQIVILDVNDHNPTFISFPNAHVKEDVTVGSLVHHITAHDPDEGRNGKVTYSILSGNENMTFMLDESSGLLTTTCPLDYEMKTQHILTVLALDDGTPALSSSQTLTVTVLDVNDEAPVFKQHLYEASVKENQNPGEFVTRVEALDRDSGVNSKLQFEIMPGASFELFEINSDTGEVVTTTILDREIQEVFTLRVLVRDGGFPSLSSTTTILCTVEDENDHAPEFIVSSYDIEVLENQEPEVVYTVLASDMDAGNNRAVEYHIIDGNTDECFTINEMSGELSTTRALDREQISNFTLVILCSDLGDPPRSSVIHLQVRVLDANDHSPSFPTLYYQSSVREDAEVGTVVLVLSAVDKDEGLNGQTEYFLTDEASGAFTIDPMSGTLKTSNTLDREARSQHTFSAVARDCSIQGSRSTTVIIKVYVTDVNDNDPVLEQNPFDVFLSPESPTNQTTVIVRADDLDLGPNGTVVFSFAETQSMFSIDKYTGEIQFQQNPSSEYFPIWLQLKVTDQGIPARTTTGLLVIHMEGEDVKISFSHHLYKGLVTENCEAGTSIVTVKAFAPDSIQDSMKYSIFSGNEDGVLSLCSKSGQLTVKEPKFLDFEVRNEVQLIVLAESSGHRAYCKVAVLIQDENDNSPCFEQSIYQASVSESQLYNAHVIQVFATDLDSGLNGLIEYSILSGNQEEAFQIDALSGVITTKAILDYELTSSYSLIVQATDKGMPRLSNTTVIKVQVTDINDNAPAFLPSEAVEITEDSLPGVIVTHVSVHDVDLNSAFIFSFAKESNPGTKFAIDQNTGVVVLVKTLDFEEMTEYELLIQISDSVHYTEGALVVRVLDVNDNPPVFSQDFYQVTVPESIPVGYSVLTLSATDLESNENISYRILSSSKEFSIDPKNGTIFTISPVLLLDTISTTQFLVEASDGGNPDLRALTLVEIGIEDMNNYAPEFTVKSYNLSLSEDALVGSTLVTFSNIDHDWTRENTYVEYSIISGNSQNNFHVETKFFHSEYPYKQVGYLVLLHSLDREASASHELVILASDSGCPPLSSTAVISIQVLDVNDNPPNFSSLSYHTHVKESTPLGSHITVVSANDRDTGSHAEIIYNIISGNEKGHFYLEENTGVLYLIKPLDYEKMTKFTLTVQASDAEKKHFSFAVVFVSVLDDNDHAPQFMFSSFSCIVPENLPISSTICSINALDFDAGPYGELTYSIVSPCFLTHGMSYDHDLFLIDPLTGDIHAKQILDYENGNKYCLTVQAKDKGDATASLVVWVDIEGIDEFEPIFTQDQYFFTLPEKNKDRQLIGRVEASDADAGIDGVILYSLGTSSPFFSVNKTNGNIYLIRALPLIKSQLNKEDTLEMKIIAHSPKSDSKFASCTVFVNVSFSSEGTPLAVFASSFSISLVVSFLVFLILICILIVMILRHKQKDTINNYEEKKTSSLDADLRVTRDASVLKAFQKTDDCSNEVVPVDATPEWLSLISIMEKDIVNLYRHSNSSGHCSVEGETAEDKEIQRINEHPYRKCSDSALSDHESRVPDSGIPRDSDQLSCLSGETDVMVTAETAEASQTFGEGDQGEGCSTTCAQNNVLPQTVQKREAKESILADVRKESVFISGDQEVRCAALSTQTTSDHDGKDNYHWNYLLSWEPKFQPLASVFNDIAKLKDEHLHMPGIPKEKKSFVFPPPLITAVAQPGIKAVPPRMPAVNLGQVPPKHPRSPIPYHLGSLPEGMTPNFSPSLSLLTMQPPALSPLLREGELLGTHISGTCHELKAEDEVQI

SEQ ID NO: 1224 - protein, 740 aa, unidentified
MSFGRDMELEHFDERDKAQRYSRGSRVNGLPSPTHSAHCSFYRTRTLQTLSSEKKAKKVRFYRNGDRYFKGIVYAISPDRFRSFEALLADLTRTLSDNVNLPQGVRTIYTIDGLKKISSLDQLVEGESYVCGSIEPFKKLEYTKNVNPNWSVNVKTTSASRAVSSLATAKGSPSEVRENKDFIRPKLVTIIRSGVKPRKAVRILLNKKTAHSFEQVLTDITDAIKLDSGVVKRLYTLDGKQVMCLQDFFGDDDIFIACGPEKFRYQDDFLLDESECRVVKSTSYTKIASSSRRSTTKSPGPSRRSKSPASTSSVNGTPGSQLSTPRSGKSPSPSPTSPGSLRKQRSSQHGGSSTSLASTKVCSSMDENDGPGEEVSEEGFQIPATITERYKVGRTIGDGNFAVVKECVERSTAREYALKIIKKSKCRGKEHMIQNEVSILRRVKHPNIVLLIEEMDVPTELYLVMELVKGGDLFDAITSTNKYTERDASGMLYNLASAIKYLHSLNIVHRDIKPENLLVYEHQDGSKSLKLGDFGLATIVDGPLYTVCGTPTYVAPEIIAETGYGLKVDIWAAGVITYILLCGFPPFRGSGDDQEVLFDQILMGQVDFPSPYWDNVSDSAKELITMMLLVDVDQRFSAVQVLEHPWVNDDGLPENEHQLSVAGKIKKHFNTGPKPNSTAAGVSVIATTALDKERQVFRRRRNQDVRSRYKAQPAPPELNSESEDYSPSSSETVRSPNSPF

SEQ ID NO: 1225 - protein, 648 aa, unidentified
MGKEPLTLKSIQVAVEELYPNKARALTLAQHSRAPSPRLRSRLFSKALKGDHRCGETETPKSCSEVAGCKAAMRHQGKIPEELSLDDRARTQKKWGRGKWEPEPSSKPPREATLEERHARGEKHLGVEIEKTSGEIIRCEKCKRERELQQSLERERLSLGTSELDMGKGPMYDVEKLVRTRSCRRSPEANPASGEEGWKGDSHRSSPRNPTQELRRPSKSMDKKEDRGPEDQESHAQGAAKAKKDLVEVLPVTEEGLREVKKDTRPMSRSKHGGWLLREHQAGFEKLRRTRGEEKEAEKEKKPCMSGGRRMTLRDDQPAKLEKEPKTRPEENKPERPSGRKPRPMGIIAANVEKHYETGRVIGDGNFAVVKECRHRETRQAYAMKIIDKSRLKGKEDMVDSEILIIQSLSHPNIVKLHEVYETDMEIYLILEYVQGGDLFDAIIESVKFPEPDAALMIMDLCKALVHMHDKSIVHRDLKPENLLVQRNEDKSTTLKLADFGLAKHVVRPIFTVCGTPTYVAPEILSEKGYGLEVDMWAAGVILYILLCGFPPFRSPERDQDELFNIIQLGHFEFLPPYWDNISDAAKDLVSRLLVVDPKKRYTAHQVLQHPWIETAGKTNTVKRQKQVSPSSEGHFRSQHKRVVEQVS

SEQ ID NO: 1226 - protein, 617 aa, unidentified
MAAVAAGGLVGKGRDISLAALQRHDPYINRIVDVASQVALYTFGHRANEWEKTDVEGTLFVYTRSASPKHGFTIMNRLSMENRTEPITKDLDFQLQDPFLLYRNARLSIYGIWFYDKEECQRIAELMKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQQQQQQQEKLPIRQGVVRSLSYEEPRRHSPPIEKQLCPAIQKLMVRSADLHPLSELPENRPCENGSTHSAGEFFTGPVQPGSPHNIGTSRGVQNASRTQNLFEKLQSTPGAANKCDPSTPAPASSAALNRSRAPTSVTPVAPGKGLAQPPQAYFNGSLPPQTVGHQAHGREQSTLPRQTLPISGSQTGSSGVISPQELLKKLQIVQQEQQLHASNRPALAAKFPVLAQSSGTGKPLESWINKTPNTEQQTPLFQVISPQRIPATAAPSLLMSPMVFAQPTSVPPKERESGLLPVGGQEPPAAATSLLLPIQSPEPSVITSSPLTKLQLQEALLYLIQNDDNFLNIIYEAYLFSMTQAAMKKTM

SEQ ID NO: 1227 - protein, 706 aa, unidentified
MDIKHHQNGTRGQRRKQPHTTVQRLLTWGLPVSCSWFLWRQPGEFPVTALLLGAGAGGLLAIGLFQLLVNPMNIYEEQKIMFLYSLVGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQAILSCRRWFDRKHEQCMKHIWVPLLTHLLCLPMKFKFFCGIAKVMEVWCRNRIPVEGNFGQTYDSLNQSIRGLDGEFSANIDFKEEKQAGVLGLNTSWERVSTEVRDYVYRQEARLEWALGLLHVLLSCTFLLVLHASFSYMDSYNHDIRFDNIYISTYFCQIDDRRKKLGKRTLLPLRKAEEKTVIFPCKPTIQASEMSNVVRELLETLPILLLLVVLCGLDWALYSIFDTIRHHSFLQYSFRSSHKLEVKVGGDSMLARLLRKTIGALNTSSETVMESNNMPCLPQPVGLDARAYWRAAVPIGLLVCLCLLQAFGYRLRRVIAAFYFPKREKKRILFLYNDLLKKRAAFTKLRRAAILRRERQQKAPRHPLADILHRGCPLLRRWLCRRCVVCQAPETPESYVCRTLDCEAVYCWSCWDDMRQRCPVCTPREELSSSAFSDSNDDTAYAG

SEQ ID NO: 1228 - protein, 773 aa, unidentified
MPKVMKDVVHPLGGEEPSMARAVVRSVGGFTLGLSLATAYGLLELLVEGHSPWGCLVGTLTLAAFLSLGMGFSRQVRATVLLLLPQAFSRQGRTLLLVAAFGLVLQGPCANTLRNFTRASEAVACGAELALNQTAEVLQRAKQPLVSALNKIKAIARKTKEVADRVRKFFRSIMDGVKHIARALRNVWQWLLHIGDVCNSELGNPYLKCARVFDDAKDSCMMVIPQAYHLCYVLMPFKLALCGLASLVQVFCVIPKYIQPFLRQTIGTPVIQLLNRVRQEFEFNMTATHHFSVDLNASRSLSQVAMDLHEAVSMKLHRVREALALMGFTTPLLLVLLYLQALFYRYCYLNWDHYDNIYITSRFLRMEAVRSTAGLPTVLPLSAHEARRYIPPGSIFLSQWEKFFYILETFNLIRHLLLVLFLVFLDYAVFWVLDLARHQLQGEIVARSPVLVSLTVEGTGYAGNIYRDLVSAFDVLQQGNISILSRRCLLRPSEPDSTGYIVIGVMYGLCFFITLFGSYVSRLRRVICASYYPSREQERISYLYNVLLSRRTNLLAALHRSVRRRAADQGHRSAFLVLASRCPCLGPFVSHFWLHQAYCLGCGQPQDEGDMENTVSCSTPGCQGLYCLTCFRLLDNTCSVCASPLSYQGDLDLELDSSDEEGPQLWLAAAQRKDPEQAWLLQQQLQEVLGRSLSMESTSESSDLDEEKGPQQRKHGQQPLPEAHQPVSILTSPEPHRPPETSSATKGAPTPASEPSVPLSPPSLPDPSHPPPK

SEQ ID NO: 1229 - protein, 470 aa, unidentified
MGIWTSGTDIFLSLWEIYVSPRSPGWMDFIQHLGVCCLVALISVGLLSVAACWFLPSIIAAAASWIITCVLLCCSKHARCFILLVFLSCGLREGRNALIAAGTGIVILGHVENIFHNFKGLLDGMTCNLRAKSFSIHFPLLKKYIEAIQWIYGLATPLSVFDDLVSWNQTLAVSLFSPSHVLEAQLNDSKGEVLSVLYQMATTTEVLSSLGQKLLAFAGLSLVLLGTGLFMKRFLGPCGWKYENIYITRQFVQFDERERHQQRPCVLPLNKEERRKYVIIPTFWPTPKERKNLGLFFLPILIHLCIWVLFAAVDYLLYRLIFSVSKQFQSLPGFEVHLKLHGEKQGTQDIIHDSSFNISVFEPNCIPKPKFLLSETWVPLSVILLILVMLGLLSSILMQLKILVSASFYPSVERKRIQYLHAKLLKKRSKQPLGEVKRRLSLYLTKIHFWLPVLKMIRKKQMDMASADKS

SEQ ID NO: 1230 - protein, 519 aa, unidentified
MSPLWWGFLLSCLGCKILPGAQGQFPRVCMTVDSLVNKECCPRLGAESANVCGSQQGRGQCTEVRADTRPWSGPYILRNQDDRELWPRKFFHRTCKCTGNFAGYNCGDCKFGWTGPNCERKKPPVIRQNIHSLSPQEREQFLGALDLAKKRVHPDYVITTQHWLGLLGPNGTQPQFANCSVYDFFVWLHYYSVRDTLLGPGRPYRAIDFSHQGPAFVTWHRYHLLCLERDLQRLIGNESFALPYWNFATGRNECDVCTDQLFGAARPDDPTLISRNSRFSSWETVCDSLDDYNHLVTLCNGTYEGLLRRNQMGRNSMKLPTLKDIRDCLSLQKFDNPPFFQNSTFSFRNALEGFDKADGTLDSQVMSLHNLVHSFLNGTNALPHSAANDPIFVVLHSFTDAIFDEWMKRFNPPADAWPQELAPIGHNRMYNMVPFFPPVTNEELFLTSDQLGYSYAIDLPVSVEETPGWPTTLLVVMGTLVALVGLFVLLAFLQYRRLRKGYTPLMETHLSSKRYTEEA

SEQ ID NO: 1231 - protein, 341 aa, unidentified
MDTARIAVVGAGVVGLSTAVCISKLVPRCSVTIISDKFTPDTTSDVAAGMLIPHTYPDTPIHTQKQWFRETFNHLFAIANSAEAGDAGVHLVSGWQIFQSTPTEEVPFWADVVLGFRKMTEAELKKFPQYVFGQAFTTLKCECPAYLPWLEKRIKGSGGWTLTRRIEDLWELHPSFDIVVNCSGLGSRQLAGDSKIFPVRGQVLQVQAPWVEHFIRDGSGLTYIYPGTSHVTLGGTRQKGDWNLSPDAENSREILSRCCALEPSLHGACNIREKVGLRPYRPGVRLQTELLARDGQRLPVVHHYGHGSGGISVHWGTALEAARLVSECVHALRTPIPKSNL

SEQ ID NO: 1232 - protein, 456 aa, unidentified
MGYFRCARAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARVIFSGSLDFFSDSFFNSAVQKAAPGSQRYSQTGNYELAVALSRWVFKEEGVLRVGPVSHHRVGETAPPNAYTVTDLVEYSIVIQQLSNGKWVPFDGDDIQLEFVRIDPFVRTFLKKKGGKYSVQFKLPDVYGVFQFKVDYNRLGYTHLYSSTQVSVRPLQHTQYERFIPSAYPYYASAFSMMLGLFIFSIVFLHMKEKEKSD

SEQ ID NO: 1233 - protein, 913 aa, unidentified
MGPEALSSLLLLLLVASGDADMKGHFDPAKCRYALGMQDRTIPDSDISASSSWSDSTAARHSRLESSDGDGAWCPAGSVFPKEEEYLQVDLQRLHLVALVGTQGRHAGGLGKEFSRSYRLRYSRDGRRWMGWKDRWGQEVISGNEDPEGVVLKDLGPPMVARLVRFYPRADRVMSVCLRVELYGCLWRDGLLSYTAPVGQTMYLSEAVYLNDSTYDGHTVGGLQYGGLGQLADGVVGLDDFRKSQELRVWPGYDYVGWSNHSFSSGYVEMEFEFDRLRAFQAMQVHCNNMHTLGARLPGGVECRFRRGPAMAWEGEPMRHNLGGNLGDPRARAVSVPLGGRVARFLQCRFLFAGPWLLFSEISFISDVVNNSSPALGGTFPPAPWWPPGPPPTNFSSLELEPRGQQPVAKAEGSPTAILIGCLVAIILLLLLIIALMLWRLHWRRLLSKAERRVLEEELTVHLSVPGDTILINNRPGPREPPPYQEPRPRGNPPHSAPCVPNGSALLLSNPAYRLLLATYARPPRGPGPPTPAWAKPTNTQAYSGDYMEPEKPGAPLLPPPPQNSVPHYAEADIVTLQGVTGGNTYAVPALPPGAVGDGPPRVDFPRSRLRFKEKLGEGQFGEVHLCEVDSPQDLVSLDFPLNVRKGHPLLVAVKILRPDATKNARNDFLKEVKIMSRLKDPNIIRLLGVCVQDDPLCMITDYMENGDLNQFLSAHQLEDKAAEGAPGDGQAAQGPTISYPMLLHVAAQIASGMRYLATLNFVHRDLATRNCLVGENFTIKIADFGMSRNLYAGDYYRVQGRAVLPIRWMAWECILMGKFTTASDVWAFGVTLWEVLMLCRAQPFGQLTDEQVIENAGEFFRDQGRQVYLSRPPACPQGLYELMLRCWSRESEQRPPFSQLHRFLAEDALNTV

SEQ ID NO: 1234 - protein, 855 aa, unidentified
MILIPRMLLVLFLLLPILSSAKAQVNPAICRYPLGMSGGQIPDEDITASSQWSESTAAKYGRLDSEEGDGAWCPEIPVEPDDLKEFLQIDLHTLHFITLVGTQGRHAGGHGIEFAPMYKINYSRDGTRWISWRNRHGKQVLDGNSNPYDIFLKDLEPPIVARFVRFIPVTDHSMNVCMRVELYGCVWLDGLVSYNAPAGQQFVLPGGSIIYLNDSVYDGAVGYSMTEGLGQLTDGVSGLDDFTQTHEYHVWPGYDYVGWRNESATNGYIEIMFEFDRIRNFTTMKVHCNNMFAKGVKIFKEVQCYFRSEASEWEPNAISFPLVLDDVNPSARFVTVPLHHRMASAIKCQYHFADTWMMFSEITFQSDAAMYNNSEALPTSPMAPTTYDPMLKVDDSNTRILIGCLVAIIFILLAIIVIILWRQFWQKMLEKASRRMLDDEMTVSLSLPSDSSMFNNNRSSSPSEQGSNSTYDRIFPLRPDYQEPSRLIRKLPEFAPGEEESGCSGVVKPVQPSGPEGVPHYAEADIVNLQGVTGGNTYSVPAVTMDLLSGKDVAVEEFPRKLLTFKEKLGEGQFGEVHLCEVEGMEKFKDKDFALDVSANQPVLVAVKMLRADANKNARNDFLKEIKIMSRLKDPNIIHLLAVCITDDPLCMITEYMENGDLNQFLSRHEPPNSSSSDVRTVSYTNLKFMATQIASGMKYLSSLNFVHRDLATRNCLVGKNYTIKIADFGMSRNLYSGDYYRIQGRAVLPIRWMSWESILLGKFTTASDVWAFGVTLWETFTFCQEQPYSQLSDEQVIENTGEFFRDQGRQTYLPQPAICPDSVYKLMLSCWRRDTKNRPSFQEIHLLLLQQGDE

SEQ ID NO: 1235 - protein, 323 aa, unidentified
MGSRVSREDFEWVYTDQPHADRRREILAKYPEIKSLMKPDPNLIWIIIMMVLTQLGAFYIVKDLDWKWVIFGAYAFGSCINHSMTLAIHEIAHNAAFGNCKAMWNRWFGMFANLPIGIPYSISFKRYHMDHHRYLGADGVDVDIPTDFEGWFFCTAFRKFIWVILQPLFYAFRPLFINPKPITYLEVINTVAQVTFDILIYYFLGIKSLVYMLAASLLGLGLHPISGHFIAEHYMFLKGHETYSYYGPLNLLTFNVGYHNEHHDFPNIPGKSLPLVRKIAAEYYDNLPHYNSWIKVLYDFVMDDTISPYSRMKRHQKGEMVLE

SEQ ID NO: 1236 - protein, 323 aa, unidentified
MGNSASRSDFEWVYTDQPHTQRRKEILAKYPAIKALMRPDPRLKWAVLVLVLVQMLACWLVRGLAWRWLLFWAYAFGGCVNHSLTLAIHDISHNAAFGTGRAARNRWLAVFANLPVGVPYAASFKKYHVDHHRYLGGDGLDVDVPTRLEGWFFCTPARKLLWLVLQPFFYSLRPLCVHPKAVTRMEVLNTLVQLAADLAIFALWGLKPVVYLLASSFLGLGLHPISGHFVAEHYMFLKGHETYSYYGPLNWITFNVGYHVEHHDFPSIPGYNLPLVRKIAPEYYDHLPQHHSWVKVLWDFVFEDSLGPYARVKRVYRLAKDGL

SEQ ID NO: 1237 - protein, 1009 aa, unidentified
MGSRIKQNPETTFEVYVEVAYPRTGGTLSDPEVQRQFPEDYSDQEVLQTLTKFCFPFYVDSLTVSQVGQNFTFVLTDIDSKQRFGFCRLSSGAKSCFCILSYLPWFEVFYKLLNILADYTTKRQENQWNELLETLHKLPIPDPGVSVHLSVHSYFTVPDTRELPSIPENRNLTEYFVAVDVNNMLHLYASMLYERRILIICSKLSTLTACIHGSAAMLYPMYWQHVYIPVLPPHLLDYCCAPMPYLIGIHLSLMEKVRNMALDDVVILNVDTNTLETPFDDLQSLPNDVISSLKNRLKKVSTTTGDGVARAFLKAQAAFFGSYRNALKIEPEEPITFCEEAFVSHYRSGAMRQFLQNATQLQLFKQFIDGRLDLLNSGEGFSDVFEEEINMGEYAGSDKLYHQWLSTVRKGSGAILNTVKTKANPAMKTVYKFAKDHAKMGIKEVKNRLKQKDIAENGCAPTPEEQLPKTAPSPLVEAKDPKLREDRRPITVHFGQVRPPRPHVVKRPKSNIAVEGRRTSVPSPEQPQPYRTLRESDSAEGDEAESPEQQVRKSTGPVPAPPDRAASIDLLEDVFSNLDMEAALQPLGQAKSLEDLRAPKDLREQPGTFDYQRLDLGGSERSRGVTVALKLTHPYNKLWSLGQDDMAIPSKPPAASPEKPSALLGNSLALPRRPQNRDSILNPSDKEEVPTPTLGSITIPRPQGRKTPELGIVPPPPIPRPAKLQAAGAALGDVSERLQTDRDRRAALSPGLLPGVVPQGPTELLQPLSPGPGAAGTSSDALLALLDPLSTAWSGSTLPSRPATPNVATPFTPQFSFPPAGTPTPFPQPPLNPFVPSMPAAPPTLPLVSTPAGPFGAPPASLGPAFASGLLLSSAGFCAPHRSQPNLSALSMPNLFGQMPMGTHTSPLQPLGPPAVAPSRIRTLPLARSSARAAETKQGLALRPGDPPLLPPRPPQGLEPTLQPSAPQQARDPFEDLLQKTKQDVSPSPALAPAPDSVEQLRKQWETFE

SEQ ID NO: 1238 - protein, 775 aa, unidentified
MDCRTKANPDRTFDLVLKVKCHASENEDPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVNQEIFIACEQVLKDQPALVPHSYFIAPDVTGLPTIPESRNLTEYFVAVDVNNMLQLYASMLHERRIVIISSKLSTLTACIHGSAALLYPMYWQHIYIPVLPPHLLDYCCAPMPYLIGIHSSLIERVKNKSLEDVVMLNVDTNTLESPFSDLNNLPSDVVSALKNKLKKQSTATGDGVARAFLRAQAALFGSYRDALRYKPGEPITFCEESFVKHRSSVMKQFLETAINLQLFKQFIDGRLAKLNAGRGFSDVFEEEITSGGFCGGNPRSYQQWVHTVKKGGALFNTAMTKATPAVRTAYKFAKNHAKLGLKEVKSKLKHKENEEDYGTCSSSVQYTPVYKLHNEKGGNSEKRKLAQARLKRPLKSLDGALYDDEDDDDIERASKLSSEDGEEASAYLYESDDSVETRVKTPYSGEMDLLGEILDTLSTHSSDQGKLAAAKSLDFFRSMDDIDYKPTNKSNAPSENNLAFLCGGSGDQAEWNLGQDDSALHGKHLPPSPRKRVSSSGLTDSLFILKEENSNKHLGADNVSDPTSGLDFQLTSPEVSQTDKGKTEKRETLSQISDDLLIPGLGRHSSTFVPWEKEGKEAKETSEDIGLLHEVVSLCHMTSDFQQSLNISDKNTNGNQT

SEQ ID NO: 1239 - protein, 1198 aa, unidentified
MRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQMLDFVMAPTSFLMGCHLDHFEEVSKEADGLVLINIDHGSITYSKSTDDNVDIPDVPLLAAQTFIQRVQSLQLHHELHAAHLLSSTDLKEGRAHRRSWQQKLNCQIQQTTLQLLVSIFRDVKNHLNYEHRVFNSEEFLKTRAPGDHQFYKQVLDTYMFHSFLKARLNRRMDAFAQMDLDTQSEEDRINGMLLSPRRPTVEKRASRKSSHLHVTHRRMVVSMPNLQDIAMPELAPRNSSLRLTDTAGCRGSSAVLNVTPKSPYTFKIPEIHFPLESKCVQAYHAHFVSMLSEAMCFLAPDNSLLLARYLYLRGLVYLMQGQLLNALLDFQNLYKTDIRIFPTDLVKRTVESMSAPEWEGAEQAPELMRLISEILDKPHEASKLDDHVKKFKLPKKHMQLGDFMKRVQESGIVKDASIIHRLFEALTVGQEKQIDPETFKDFYNCWKETEAEAQEVSLPWLVMEHLDKNECVCKLSSSVKTNLGVGKIAMTQKRLFLLTEGRPGYLEISTFRNIEEVRRTTTTFLLRRIPTLKIRVASKKEVFEANLKTECDLWHLMVKEMWAGKKLADDHKDPHYVQQALTNVLLMDAVVGTLQSPGAIYAASKLSYFDKMSNEMPMTLPETTLETLKHKINPSAGEAFPQAVDVLLYTPGHLDPAEKVEDAHPKLWCALSEGKVTVFNASSWTIHQHSFKVGTAKVNCMVMADQNQVWVGSEDSVIYIINVHSMSCNKQLTAHCSSVTDLIVQDGQEAPSNVYSCSMDGMVLVWNVSTLQVTSRFQLPRGGLTSIRLHGGRLWCCTGNSIMVMKMNGSLHQELKIEENFKDTSTSFLAFQLLPEEEQLWAACAGRSEVYIWSLKDLAQPPQRVPLEDCSEINCMIRVKKQVWVGSRGLGQGTPKGKIYVIDAERKTVEKELVAHMDTVRTLCSAEDRYVLSGSGREEGKVAIWKGE

SEQ ID NO: 1240 - protein, 1496 aa, unidentified
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPVPVFSTFVLTGAAGDKVYGAALQFYEAFPRARLSERQARALGLLSAVERGRALGGRAVRSRRAIAVLSRWPAFPAFRAFLTFLYRYSVSGPHRLPLEAHISHFIHNVPFPSPQRPRILVQMSPYDNLLLCQPVSSPLPLSGASFLQLLQSLGPELAITLLLAVLTEHKLLVHSLRPDLLTSVCEALVSMIFPLHWQCPYIPLCPLVLADVLSAPVPFIVGIHSSYFDLHDPPADVICVDLDTNTLFQTEEKKLLSPRTLPRRPYKVLLATLTNLYQQLDQTYTGPEEEASLEFLLTDYEAVCGRRARLEREVQGAFLRFMACLLKGYRVFLRPLTQAPSEGARDVDNLFFLQGFLKSRERSSHKLYSQLLHTQMFSQFIEECSFGSARHAALEFFDSCVEKVHPEQEKPEPTPLVELEELSGSELTVFITPPEEPALPEGSESTPQYCYDGFPELRAELFESLQEQPGALPVPGPSRSAPSSPAPRRTKQEMKVAQRMAQKSAAVPELWARCLLGHCYGLWFLCLPAYVRSAPSRVQALHTAYHVLRQMESGKVVLPDEVCYRVLMQLCSHYGQPVLSVRVMLEMRQAGIVPNTITYGYYNKAVLESKWPSGTPGGRLRWAKLRNVVLGAAQFRQPLRERQQQQQQQQQQQQQQQQEQVSAHQEAGSSQAEPYLERPSPTRPLQRQTTWAGRSLRDPASPPGRLVKSGSLGSARGAQPTVEAGVAHMIEALGVLEPRGSPVPWHDGSLSDLSLTGEEPLPGGSPGGSGSALSAQSTEALEGLSGRGPKAGGRQDEAGTPRRGLGARLQQLLTPSRHSPASRIPPPELPPDLPPPARRSPMDSLLHPRERPGSTASESSASLGSEWDLSESSLSNLSLRRSSERLSDTPGSFQSPSLEILLSSCSLCRACDSLVYDEEIMAGWAPDDSNLNTTCPFCACPFVPLLSVQTLDSRPSVPSPKSAGASGSKDAPVPGGPGPVLSDRRLCLALDEPQLCNGHMGGASRRVESGAWAYLSPLVLRKELESLVENEGSEVLALPELPSAHPIIFWNLLWYFQRLRLPSILPGLVLASCDGPSHSQAPSPWLTPDPASVQVRLLWDVLTPDPNSCPPLYVLWRVHSQIPQRVVWPGPVPASLSLALLESVLRHVGLNEVHKAVGLLLETLGPPPTGLHLQRGIYREILFLTMAALGKDHVDIVAFDKKYKSAFNKLASSMGKEELRHRRAQMPTPKAIDCRKCFGAPPEC

SEQ ID NO: 1241 - protein, 1909 aa, unidentified
MIEDKGPRVTDYFVVAGLTDTSTLLDQEINRLDTKSTGPKAPITDIAIIIKSAGETVPEGYTCVEATPSALQANLNYGSLKSPELFLCYKRGRDKPPLTDIGVLYEGKERLIPGCEVILATPYGRCANVNNSSTTSQRIFITYRRAPPVRPQNSLAVTDICVIVTSKGETPPHTFCKVDKNLNCGMWGSSVFLCYKKSVPASNAIAYKAGLIFRYPEEDYESFPLSESDVPLFCLPMGATIECWDPETKYPLPVFSTFVLTGSSAKKVYGAAIQFYEPYSRELLSEKQLMHLGLLTPVERKMVSKSINTNKCICLLSHWPFFEAFRKFLMFIYKLSVSGPHPLPIEKHISHFMQNIPFPSPQRPRILVQLSVHDALILSQPVSTPLPLSGANFSTLLMNLGPENCATLLLFVLLESKILLHSLRPAVLTGVAEAVVAMIFPFQWQCPYIPLCPLSLAAVLSAPLPFIVGVDSRYFDLHDPPQDVVCIDLDTNMLYVSDEKKNMNWKQLPKKPCKNLLSTLKKLYPQLSSVHQKTQEGSAIDMTPIEADFSWQKKMTQLEMEIQEAFLRFMASILKGYRTYLRPITEAPSNKATAADSLFDRQGFLKSRDRAYAKFYTLLSKTQIFIRFIEECSFVSDKDTGLAFFDDCIEKLFPDKGTEKTDKVDFDSAEDTRLIELDDSQKSEHTVFIMPPEPPPDDGKDLSPKYSYKYFPRLDLKLFDRPQELKLCFSRHPTGNSITKSPPLMAKRTKQEIKTAHKLAKRCYTNPPQWAKCLFSHCYSLWFICLPAYVRVSHPKVRALQQAYDVLIKMRKTDVDPLDEVCYRVVMQLCGLWGHPVLAVRVLFEMKTARIKPNAITYGYYNKVVLESPWPSSTRSGIFLWTKVRNVVRGLAQFRQPLKKTVQRSQVSSISGGQSDQGYGSKDELIKDDAEIHVPEEQAARELITKTKMQTEEVCDASAIVAKHSQPSPEPHSPTEPPAWGSSIVKVPSGIFDVNSRKSSTGSISNVLFSTQDPVEDAVFGEATNLKKNGDRGEKRQKHFPERSCSFSSESRAGMLLKKSSLDSNSSEMAIMMGADAKILTAALTCPKTSLLHIARTHSFENVSCHLPDSRTCMSESTWNPEHRSSPVPEMLEESQELLEPVVDDVPKTTATVDTYESLLSDSNSNQSRDLKTVSKDLRNKRSSLYGIAKVVQREDVETGLDPLSLLATECTGGKTPDSEDKLFSPVIARNLADEIESYMNLKSPLGSKSSSMELHREENRESGMTTAFIHALERRSSLPLDHGSPAQENPESEKSSPAVSRSKTFTGRFKQQTPSRTHKERSTSLSALVRSSPHGSLGSVVNSLSGLKLDNILSGPKIDVLKSGMKQAATVASKMWVAVASAYSYSDDEEETNRDYSFPAGLEDHILGENISPNTSISGLVPSELTQSNTSLGSSSSSGDVGKLHYPTGEVPFPRGMKGQDFEKSDHGSSQNTSMSSIYQNCAMEVLMSSCSQCRACGALVYDEEIMAGWTADDSNLNTACPFCKSNFLPLLNIEFKDLRGSASFFLKPSTSGDSLQSGSIPLANESLEHKPVSSLAEPDLINFMDFPKHNQIITEETGSAVEPSDEIKRASGDVQTMKISSVPNSLSKRNVSLTRSHSVGGPLQNIDFTQRPFHGISTVSLPNSLQEVVDPLGKRPNPPPVSVPYLSPLVLRKELESLLENEGDQVIHTSSFINQHPIIFWNLVWYFRRLDLPSNLPGLILTSEHCNEGVQLPLSSLSQDSKLVYIQLLWDNINLHQEPREPLYVSWRNFNSEKKSSLLSEEQQETSTLVETIRQSIQHNNVLKPINLLSQQMKPGMKRQRSLYREILFLSLVSLGRENIDIEAFDNEYGIAYNSLSSEILERLQKIDAPPSASVEWCRKCFGAPLI

SEQ ID NO: 1242 - protein, 1287 aa, unidentified
MSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 1243 - protein, 1309 aa, unidentified
MGTHHHAQLIFVFLVEMRFHHVDQAGLELLTSSNSPASASRSAEITVVSQHAQPGFLYQWLEADRHGKSQGAANTTSGENFDQSPLRRTFKSKVLAHYPQNIEWNPFDQDAVNMLCMPKGLSFRTQTDNKDPQFHSFIITREDGSRTYGFVLTFYEEVTSKQICTAMQTLYQMHNAEHYSSVYASSSCSMDSLASSLDEGDTTSLLKLQRYNSYDISRDTLYVSKSICLITPLPFMQACKKFLIQLYKAVTSQQPPPLPLESYIHNILYEVPLPPPGRSLKFYGVYEPVICQRPGPSELPLSDYPLREAFELLGLENLVQVFTCVLLEMQILLYSQDYQRLMTVAEGITTLLFPFQWQHVYVPILPASLLHFLDAPVPYLMGLQSKEGTDRSKLELPQEANLCFVDIDNHFIELPEEFPQFPNKVDFIQELSEVLVQFGIPPEGSLHCSESTSKLKNMVLKDLVNDKKNGNVCTNNISMYELLKGNETIARLQALAKRTGVAVEKMDLSASLGEKDKDLKLHCEEAELRDYQLNVQLREVFANRFTQMFADYEAFVIQTAQDMESWLTNREQMQNFDKASFLSDQPEPYLPFLSRFIETQMFATFIDNKIMSQWEEKDPLLRVFDTRIDKIRLYNVRAPTLRTSIYQKCSTLKEAAQSIEQRLMKMDHTAIHPHLLDMKIGQGKYEQGFFPKLQSDVLATGPTSNNRWVSRSATAQRRKERLRQHSEHVGLDNDLREKYMQEARSLGKNLRQPKLSDLSPAVIAQTNCKFVEGLLKECRMKTKRMLVEKMGHEAVELGHGEANITGLEENTLIASLCDLLERIWSHGLQVKQGKSALWSHLIQFQDREEKQEHLAESPVALGPERRKSDSGVMLPTLRVSLIQDMRHIQNMSEIKTDVGRARAWIRLSLEKKLLSQHLKQLLSNQPLTKKLYKRYAFLRCEEEREQFLYHLLSLNAVDYFCFTSVFTTIMIPYRSVIIPIKKLSNAIITSNPWICVSGELGDTGVMQIPKNLLEMTFECQNLGKLTTVQIGHDNSGLLAKWLVDCVMVRNEITGHTYRFPCGRWLGKGIDDGSLERILIGELMTSASDEDLVKQCRTPPQQKSPTTARRLSITSLTGKNNKPNAGQIQEGIGEAVNNIVKHFHKPEKERGSLTVLLCGENGLVAALEQVFHHGFKSARIFHKNVFIWDFIEKVVAYFETTDQILDNEDDVLIQKSSCKTFCHYVNAINTAPRNIGKDGKFQILVCLGTRDRLLPQWIPLLAECPAITRMYEESALLRDRMTVNSLIRILQTIQDFTIVLEGSLIKGVDV

SEQ ID NO: 1244 - protein, 251 aa, unidentified
MSDIGDWFRSIPAITRYWFAATVAVPLVGKLGLISPAYLFLWPEAFLYRFQIWRPITATFYFPVGPGTGFLYLVNLYFLYQYSTRLETGAFDGRPADYLFMLLFNWICIVITGLAMDMQLLMIPLIMSVLYVWAQLNRDMIVSFWFGTRFKACYLPWVILGFNYIIGGSVINELIGNLVGHLYFFLMFRYPMDLGGRNFLSTPQFLYRWLPSRRGGVSGFGVPPASMRRAADQNGGGGRHNWGQGFRLGDQ

SEQ ID NO: 1245 - protein, 239 aa, unidentified
MAYQSLRLEYLQIPPVSRAYTTACVLTTAAVQLELITPFQLYFNPELIFKHFQIWRLITNFLFFGPVGFNFLFNMIFLYRYCRMLEEGSFRGRTADFVFMFLFGGFLMTLFGLFVSLVFLGQAFTIMLVYVWSRRNPYVRMNFFGLLNFQAPFLPWVLMGFSLLLGNSIIVDLLGIAVGHIYFFLEDVFPNQPGGIRILKTPSILKAIFDTPDEDPNYNPLPEERPGGFAWGEGQRLGG

SEQ ID NO: 1246 - protein, 235 aa, unidentified
MAWQGLAAEFLQVPAVTRAYTAACVLTTAAVQLELLSPFQLYFNPHLVFRKFQVWRLVTNFLFFGPLGFSFFFNMLFVFRYCRMLEEGSFRGRTADFVFMFLFGGVLMTLLGLLGSLFFLGQALMAMLVYVWSRRSPRVRVNFFGLLTFQAPFLPWALMGFSLLLGNSILVDLLGIAVGHIYYFLEDVFPNQPGGKRLLQTPGFLKLLLDAPAEDPNYLPLPEEQPGPHLPPPQQ

SEQ ID NO: 1247 - protein, 604 aa, unidentified
MENQAHNTMGTSPCEAELQELMEQIDIMVSNKKMDWERKMRALETRLDLRDQELANAQTCLDQKGQEVGLLRQKLDSLEKCNLAMTQNYEGQLQSLKAQFSKLTNNFEKLRLHQMKQNKVPRKELPHLKEEIPFELSNLNQKLEEFRAKSREWDKQEILYQTHLISLDAQQKLLSEKCNQFQKQAQSYQTQLNGKKQCLEDSSSEIPRLICDPDPNCEINERDEFIIEKLKSAVNEIALSRNKLQDENQKLLQELKMYQRQCQAMEAGLSEVKSELQSRDDLLRIIEMERLQLHRELLKIGECQNAQGNKTRLESSYLPSIKEPERKIKELFSVMQDQPNHEKELNKIRSQLQQVEEYHNSEQERMRNEISDLTEELHQKEITIATVTKKAALLEKQLKMELEIKEKMLAKQKVSDMKYKAVRTENTHLKGMMGDLDPGEYMSMDFTNREQSRHTSINKLQYENERLRNDLAKLHVNGKSTWTNQNTYEETGRYAYQSQIKVEQNEERLSHDCEPNRSTMPPLPPSTFQAKEMTSPLVSDDDVFPLSPPDMSFPASLAAQHFLLEEEKRAKELEKLLNTHIDELQRHTEFTLNKYSKLKQNRHI

SEQ ID NO: 1248 - protein, 95 aa, unidentified
MLGARVAAHLDALGPLVPYVPPPLLPSMFYVGLFFVNVLILYYAFLMEYIVLNVGLVFLPEDMDQALVDLGVLSDPGSGLYDADSELDVFDAYLE

SEQ ID NO: 1249 - protein, 488 aa, unidentified
MGDRGSSRRRRTGSRPSSHGGGGPAAAEEEVRDAAAGPDVGAAGDAPAPAPNKDGDAGVGSGHWELRCHRLQDSLFSSDSGFSNYRGILNWCVVMLILSNARLFLENLIKYGILVDPIQVVSLFLKDPYSWPAPCLVIAANVFAVAAFQVEKRLAVGALTEQAGLLLHVANLATILCFPAAVVLLVESITPVGSLLALMAHTILFLKLFSYRDVNSWCRRARAKAASAGKKASSAAAPHTVSYPDNLTYRDLYYFLFAPTLCYELNFPRSPRIRKRFLLRRILEMLFFTQLQVGLIQQWMVPTIQNSMKPFKDMDYSRIIERLLKLAVPNHLIWLIFFYWLFHSCLNAVAELMQFGDREFYRDWWNSESVTYFWQNWNIPVHKWCIRHFYKPMLRRGSSKWMARTGVFLASAFFHEYLVSVPLRMFRLWAFTGMMAQIPLAWFVGRFFQGNYGNAAVWLSLIIGQPIAVLMYVHDYYVLNYEAPAAEA

SEQ ID NO: 1250 - protein, 388 aa, unidentified
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 1251 - protein, 337 aa, unidentified
MAFFSRLNLQEGLQTFFVLQWIPVYIFLGAIPILLIPYFLLFSKFWPLAVLSLAWLTYDWNTHSQGGRRSAWVRNWTLWKYFRNYFPVKLVKTHDLSPKHNYIIANHPHGILSFGVFINFATEATGIARIFPSITPFVGTLERIFWIPIVREYVMSMGVCPVSSSALKYLLTQKGSGNAVVIVVGGAAEALLCRPGASTLFLKQRKGFVKMALQTGAYLVPSYSFGENEVFNQETFPEGTWLRLFQKTFQDTFKKILGLNFCTFHGRGFTRGSWGFLPFNRPITTVVGEPLPIPRIKRPNQKTVDKYHALYISALRKLFDQHKVEYGLPETQELTIT

SEQ ID NO: 1252 - protein, 550 aa, unidentified
MVPKADSGAFLLLFLLVLTVTEPLRPELRCNPGQFACRSGTIQCIPLPWQCDGWATCEDESDEANCPEVTGEVRPHHGKEAVDPRQGRARGGDPSHFHAVNVAQPVRFSSFLGKCPTGWHHYEGTASCYRVYLSGENYWDAAQTCQRLNGSLATFSTDQELRFVLAQEWDQPERSFGWKDQRKLWVGYQYVITGRNRSLEGRWEVAFKGSSEVFLPPDPIFASAMSENDNVFCAQLQCFHFPTLRHHDLHSWHAESCYEKSSFLCKRSQTCVDIKDNVVDEGFYFTPKGDDPCLSCTCHGGEPEMCVAALCERPQGCQQYRKDPKECCKFMCLDPDGNSLFDSMASGMRLVVSCISSFLILSLLLFMVHRLRQRRRERIESLIGANLHHFNLGRRIPGFDYGPDGFGTGLTPLHLSDDGEGGTFHFHDPPPPYTAYKYPDIGQPDDPPPPYEASIHPDSVFYDPADDDAFEPVEVSLPAPGDGGSEGALLRRLEQPLPTAGASLADLEDSADSSSALLVPPDPAQSGSTPAAEALPGGGRHSRSSLNTVV

SEQ ID NO: 1253 - protein, 567 aa, unidentified
MEAERRPAPGSPSEGLFADGHLILWTLCSVLLPVFITFWCSLQRSRRQLHRRDIFRKSKHGWRDTDLFSQPTYCCVCAQHILQGAFCDCCGLRVDEGCLRKADKRFQCKEIMLKNDTKVLDAMPHHWIRGNVPLCSYCMVCKQQCGCQPKLCDYRCIWCQKTVHDECMKNSLKNEKCDFGEFKNLIIPPSYLTSINQMRKDKKTDYEVLASKLGKQWTPLIILANSRSGTNMGEGLLGEFRILLNPVQVFDVTKTPPIKALQLCTLLPYYSARVLVCGGDGTVGWVLDAVDDMKIKGQEKYIPQVAVLPLGTGNDLSNTLGWGTGYAGEIPVAQVLRNVMEADGIKLDRWKVQVTNKGYYNLRKPKEFTMNNYFSVGPDALMALNFHAHREKAPSLFSSRILNKAVYLFYGTKDCLVQECKDLNKKVELELDGERVALPSLEGIIVLNIGYWGGGCRLWEGMGDETYPLARHDDGLLEVVGVYGSFHCAQIQVKLANPFRIGQAHTVRLILKCSMMPMQVDGEPWAQGPCTVTITHKTHAMMLYFSGEQTDDDISSTSDQEDIKATE

SEQ ID NO: 1254 - protein, 516 aa, unidentified
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 1255 - protein, 475 aa, unidentified
MAAKSQPNIPKAKSLDGVTNDRTASQGQWGRAWEVDWFSLASVIFLLLFAPFIVYYFIMACDQYSCALTGPVVDIVTGHARLSDIWAKTPPITRKAAQLYTLWVTFQVLLYTSLPDFCHKFLPGYVGGIQEGAVTPAGVVNKYQINGLQAWLLTHLLWFANAHLLSWFSPTIIFDNWIPLLWCANILGYAVSTFAMVKGYFFPTSARDCKFTGNFFYNYMMGIEFNPRIGKWFDFKLFFNGRPGIVAWTLINLSFAAKQRELHSHVTNAMVLVNVLQAIYVIDFFWNETWYLKTIDICHDHFGWYLGWGDCVWLPYLYTLQGLYLVYHPVQLSTPHAVGVLLLGLVGYYIFRVANHQKDLFRRTDGRCLIWGRKPKVIECSYTSADGQRHHSKLLVSGFWGVARHFNYVGDLMGSLAYCLACGGGHLLPYFYIIYMAILLTHRCLRDEHRCASKYGRDWERYTAAVPYRLLPGIF

SEQ ID NO: 1256 - protein, 395 aa, unidentified
MAWRHLKKRAQDAVIILGGGGLLFASYLMATGDERFYAEHLMPTLQGLLDPESAHRLAVRFTSLGLLPRARFQDSDMLEVRVLGHKFRNPVGIAAGFDKHGEAVDGLYKMGFGFVEIGSVTPKPQEGNPRPRVFRLPEDQAVINRYGFNSHGLSVVEHRLRARQQKQAKLTEDGLPLGVNLGKNKTSVDAAEDYAEGVRVLGPLADYLVVNVSSPNTAGLRSLQGKAELRRLLTKVLQERDGLRRVHRPAVLVKIAPDLTSQDKEDIASVVKELGIDGLIVTNTTVSRPAGLQGALRSETGGLSGKPLRDLSTQTIREMYALTQGRVPIIGVGGVSSGQDALEKIRAGASLVQLYTALTFWGPPVVGKVKRELEALLKEQGFGGVTDAIGADHRR

SEQ ID NO: 1257 - protein, 302 aa, unidentified
MVWKRLGALVMFPLQMIYLVVKAAVGLVLPAKLRDLSRENVLITGGGRGIGRQLAREFAERGARKIVLWGRTEKCLKETTEEIRQMGTECHYFICDVGNREEVYQTAKAVREKVGDITILVNNAAVVHGKSLMDSDDDALLKSQHINTLGQFWTTKAFLPRMLELQNGHIVCLNSVLALSAIPGAIDYCTSKASAFAFMESLTLGLLDCPGVSATTVLPFHTSTEMFQGMRVRFPNLFPPLKPETVARRTVEAVQLNQALLLLPWTMHALVILKSILPQAALEEIHKFSGTYTCMNTFKGRT

SEQ ID NO: 1258 - protein, 325 aa, unidentified
MVSPATRKSLPKVKAMDFITSTAILPLLFGCLGVFGLFRLLQWVRGKAYLRNAVVVITGATSGLGKECAKVFYAAGAKLVLCGRNGGALEELIRELTASHATKVQTHKPYLVTFDLTDSGAIVAAAAEILQCFGYVDILVNNAGISYRGTIMDTTVDVDKRVMETNYFGPVALTKALLPSMIKRRQGHIVAISSIQGKMSIPFRSAYAASKHATQAFFDCLRAEMEQYEIEVTVISPGYIHTNLSVNAITADGSRYGVMDTTTAQGRSPVEVAQDVLAAVGKKKKDVILADLLPSLAVYLRTLAPGLFFSLMASRARKERKSKNS

SEQ ID NO: 1259 - protein, 319 aa, unidentified
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 1260 - protein, 1008 aa, unidentified
MSYDYHQNWGRDGGPRSSGGGYGGGPAGGHGGNRGSGGGGGGGGGGRGGRGRHPGHLKGREIGMWYAKKQGQKNKEAERQERAVVHMDERREEQIVQLLNSVQAKNDKESEAQISWFAPEDHGYGTEVSTKNTPCSENKLDIQEKKLINQEKKMFRIRNRSYIDRDSEYLLQENEPDGTLDQKLLEDLQKKKNDLRYIEMQHFREKLPSYGMQKELVNLIDNHQVTVISGETGCGKTTQVTQFILDNYIERGKGSACRIVCTQPRRISAISVAERVAAERAESCGSGNSTGYQIRLQSRLPRKQGSILYCTTGIILQWLQSDPYLSSVSHIVLDEIHERNLQSDVLMTVVKDLLNFRSDLKVILMSATLNAEKFSEYFGNCPMIHIPGFTFPVVEYLLEDVIEKIRYVPEQKEHRSQFKRGFMQGHVNRQEKEEKEAIYKERWPDYVRELRRRYSASTVDVIEMMEDDKVDLNLIVALIRYIVLEEEDGAILVFLPGWDNISTLHDLLMSQVMFKSDKFLIIPLHSLMPTVNQTQVFKRTPPGVRKIVIATNIAETSITIDDVVYVIDGGKIKETHFDTQNNISTMSAEWVSKANAKQRKGRAGRVQPGHCYHLYNGLRASLLDDYQLPEILRTPLEELCLQIKILRLGGIAYFLSRLMDPPSNEAVLLSIRHLMELNALDKQEELTPLGVHLARLPVEPHIGKMILFGALFCCLDPVLTIAASLSFKDPFVIPLGKEKIADARRKELAKDTRSDHLTVVNAFEGWEEARRRGFRYEKDYCWEYFLSSNTLQMLHNMKGQFAEHLLGAGFVSSRNPKDPESNINSDNEKIIKAVICAGLYPKVAKIRLNLGKKRKMVKVYTKTDGLVAVHPKSVNVEQTDFHYNWLIYHLKMRTSSIYLYDCTEVSPYCLLFFGGDISIQKDNDQETIAVDEWIVFQSPARIAHLVKELRKELDILLQEKIESPHPVDWNDTKSRDCAVLSAIIDLIKTQEKATPRNFPPRFQDGYYS

SEQ ID NO: 1261 - protein, 239 aa, unidentified
MAALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 1262 - protein, 249 aa, unidentified
MGLPQPGLWLKRLWVLLEVAVHVVVGKVLLILFPDRVKRNILAMGEKTGMTRNPHFSHDNWIPTFFSTQYFWFVLKVRWQRLEDTTELGGLAPNCPVVRLSGQRCNIWEFMQGNRPLVLNFGSCTUPSFMFKFDQFKRLIEDFSSIADFLVIYIEEAHASDGWAFKNNMDIRNHQNLQDRLQAAHLLLARSPQCPVVVDTMQNQSSQLYAALPERLYIIQEGRILYKGKSGPWNYNPEEVRAVLEKLHS

SEQ ID NO: 1263 - protein, 273 aa, unidentified
MGILSVDLLITLQILPVFFSNCLFLALYDSVILLKHVVLLLSRSKSTRGEWRRMLTSEGLRCVWKSFLLDAYKQVKLGEDAPNSSVVHVSSTEGGDNSGNGTQEKIAEGATCHLLDFASPERPLVVNFGSATUPPFTSQLPAFRKLVEEFSSVADFLLVYIDEAHPSDGWAIPGDSSLSFEVKKHQNQEDRCAAAQQLLERFSLPPQCRVVADRMDNNANIAYGVAFERVCIVQRQKIAYLGGKGPFSYNLQEVRHWLEKNFSKRUKKTRLAG

SEQ ID NO: 1264 - protein, 304 aa, unidentified
MPRQATSRLVVGEGEGSQGASGPAATMLRSLLLHSLRLCAQTASCLVLFPRFLGTAFMLWLLDFLCIRKHFLGRRRRGQPEPEVELNSEGEEVPPDDPPICVSDDNRLCTLASLKAVWHGQKLDFFKQAHEGGPAPNSEVVLPDGFQSQHILDYAQGNRPLVLNFGSCTUPPFMARMSAFQRLVTKYQRDVDFLIIYIEEAHPSDGWVTTDSPYIIPQHRSLEDRVSAARVLQQGAPGCALVLDTMANSSSSAYGAYFERLYVIQSGTIMYQGGRGPDGYQVSELRTWLERYDEQLHGARPRRV

SEQ ID NO: 1265 - protein, 1571 aa, unidentified
MADRGCPLEAAPLPAEVRESLAELELELSEGDITQKGYEKKRAKLLARYIPLIQGIDPSLQAENRIPGPSQTTAAAPKQQKSRPTASRDERFRSDVHTEAVQAALAKYKERKMPMPSKRRSVLVHSSVETYTPPDTSSASEDEGSLRRPGRLTSTPLQSHSSVEPWLDRVIQGSSTSSSASSTSSHPGGRPTTAPSAAATPGAAATTALAGLEAHTHIDLHSAPPDVTTGLVEHSYFERPQVASVRSVPRGCSGSMLETADGVPVNSRVSSKIQQLLNTLKRPKRPPLKEFFVDDFEELLEVQQPDPNQPKPEGSETSVLRGEPLTAGVPRPPSLLATLQRWGTTQPKSPCLTALDTTGKAVYTLTYGKLWSRSLKLAYTLLNKLTSKNEPLLKPGDRVALVFPNSDPVMFMVAFYGCLLAELVPVPIEVPLTRKDAGSQQVGFLLGSCGVFLALTTDACQKGLPKAQTGEVAAFKGWPPLSWLVIDGKHLAKPPKDWHPLAQDTGTGTAYIEYKTSKEGSTVGVTVSHASLLAQCRALTQACGYSEAETLTNVLDFKRDAGLWHGVLTSVMNRMHVVSVPYALMKANPLSWIQKVCFYKARAALVKSRDMHWSLLAQRGQRDVSLSSLRMLIVADGANPWSISSCDAFLNVFQSRGLRPEVICPCASSPEALTVAIRRPPDLGGPPPRKAVLSMNGLSYGVIRVDTEEKLSVLTVQDVGQVMPGANVCVVKLEGTPYLCKTDEVGEICVSSSATGTAYYGLLGITKNVFEAVPVTTGGAPIFDRPFTRTGLLGFIGPDNLVFIVGKLDGLMVTGVRRHNADDVVATALAVEPMKFVYRGRIAVFSVTVLHDDRIVLVAEQRPDASEEDSFQWMSRVLQAIDSIHQVGVYCLALVPANTLPKAPLGGIHISETKQRFLEGTLHPCNVLMCPHTCVTNLPKPRQKQPEVGPASMIVGNLVAGKRIAQASGRELAHLEDSDQARKFLFLADVLQWRAHTTPDHPLFLLLNAKGTVTSTATCVQLHKRAERVAAALMEKGRLSVGDHVALVYPPGVDLIAAFYGCLYCGCVPVTVRPPHPQNLGTTLPTVKMIVEVSKSACVLTTQAVTRLLRSKEAAAAVDIRTWPTILDTDDIPKKKIASVFRPPSPDVLAYLDFSVSTTGILAGVKMSHAATSALCRSIKLQCELYPSRQIAICLDPYCGLGFALWCLCSVYSGHQSVLVPPLELESNVSLWLSAVSQYKARVTFCSYSVMEMCTKGLGAQTGVLRMKGVNLSCVRTCMVVAEERPRIALTQSFSKLFKDLGLPARAVSTTFGCRVNVAICLQGTAGPDPTTVYVDMRALRHDRVRLVERGSPHSLPLMESGKILPGVKVIIAHTETKGPLGDSHLGEIWVSSPHNATGYYTVYGEEALHADHFSARLSFGDTQTIWARTGYLGFLRRTELTDASGGRHDALYVVGSLDETLELRGMRYHPIDIETSVIRAHRSIAECAVFTWTNLLVVVVELDGLEQDALDLVALVTNVVLEEHYLVVGVVVIVDPGVIPINSRGEKQRMHLRDGFLADQLDPIYVAYNM

SEQ ID NO: 1266 - protein, 1556 aa, unidentified
MADRSLEGMALPLEVRARLAELELELSEGDITQKGYEKKRSKLIGAYLPQPPRVDQALPQERRAPVTPSSASRYHRRRSSGSRDERYRSDVHTEAVQAALAKHKERKMAVPMPSKRRSLVVQTSMDAYTPPDTSSGSEDEGSVQGDSQGTPTSSQGSINMEHWISQAIHGSTTSTTSSSSTQSGGSGAAHRLADVMAQTHIENHSAPPDVTTYTSEHSIQVERPQGSTGSRTAPKYGNAELMETGDGVPVSSRVSAKIQQLVNTLKRPKRPPLREFFVDDFEELLEVQQPDPNQPKPEGAQMLAMRGEQLGVVTNWPPSLEAALQRWGTISPKAPCLTTMDTNGKPLYILTYGKLWTRSMKVAYSILHKLGTKQEPMVRPGDRVALVFPNNDPAAFMAAFYGCLLAEVVPVPIEVPLTRKDAGSQQIGFLLGSCGVTVALTSDACHKGLPKSPTGEIPQFKGWPKLLWFVTESKHLSKPPRDWFPHIKDANNDTAYIEYKTCKDGSVLGVTVTRTALLTHCQALTQACGYTEAETIVNVLDFKKDVGLWHGILTSVMNMMHVISIPYSLMKVNPLSWIQKVCQYKAKVACVKSRDMHWALVAHRDQRDINLSSLRMLIVADGANPWSISSCDAFLNVFQSKGLRQEVICPCASSPEALTVAIRRPTDDSNQPPGRGVLSMHGLTYGVIRVDSEEKLSVLTVQDVGLVMPGAIMCSVKPDGVPQLCRTDEIGELCVCAVATGTSYYGLSGMTKNTFEVFPMTSSGAPISEYPFIRTGLLGFVGPGGLVFVVGKMDGLMVVSGRRHNADDIVATALAVEPMKFVYRGRIAVFSVTVLHDERIVIVAEQRPDSTEEDSFQWMSRVLQAIDSIHQVGVYCLALVPANTLPKTPLGGIHLSETKQLFLEGSLHPCNVLMCPHTCVTNLPKPRQKQPEIGPASVMVGNLVSGKRIAQASGRDLGQIEDNDQARKFLFLSEVLQWRAQTTPDHILYTLLNCRGAIANSLTCVQLHKRAEKIAVMLMERGHLQDGDHVALVYPPGIDLIAAFYGCLYAGCVPITVRPPHPQNIATTLPTVKMIVEVSRSACLMTTQLICKLLRSREAAAAVDVRTWPLILDTDDLPKKRPAQICKPCNPDTLAYLDFSVSTTGMLAGVKMSHAATSAFCRSIKLQCELYPSREVAICLDPYCGLGFVLWCLCSVYSGHQSILIPPSELETNPALWLLAVSQYKVRDTFCSYSVMELCTKGLGSQTESLKARGLDLSRVRTCVVVAEERPRIALTQSFSKLFKDLGLHPRAVSTSFGCRVNLAICLQGTSGPDPTTVYVDMRALRHDRVRLVERGSPHSLPLMESGKILPGVRIIIANPETKGPLGDSHLGEIWVHSAHNASGYFTIYGDESLQSDHFNSRLSFGDTQTIWARTGYLGFLRRTELTDANGERHDALYVVGALDEAMELRGMRYHPIDIETSVIRAHKSVTECAVFTWTNLLVVVVELDGSEQEALDLVPLVTNVVLEEHYLIVGVVVVVDIGVIPINSRGEKQRMHLRDGFLADQLDPIYVAYNM

SEQ ID NO: 1267 - protein, 478 aa, unidentified
MGSRWSSEEERQPLLGPGLGPGLGASWRSREAAAAALPAAVPGPGRVYGRRWLVLLLFSLLAFVQGLVWNTWGPIQNSARQAYGFSSWDIALLVLWGPIGFLPCFAFMWLLDKRGLRITVLLTSFLMVLGTGLRCIPISDLILKRRLIHGGQMLNGLAGPTVMNAAPFLSTTWFSADERATATAIASMLSYLGGACAFLVGPLVVPAPNGTSPLLAAESSRAHIKDRIEAVLYAEFGVVCLIFSATLAYFPPRPPLPPSVAAASQRLSYRRSVCRLLSNFRFLMIALAYAIPLGVFAGWSGVLDLILTPAHVSQVDAGWIGFWSIVGGCVVGIAMARFADFIRGMLKLILLLLFSGATLSSTWFTLTCLNSITHLPLTTVTLYASCILLGVFLNSSVPIFFELFVETVYPVPEGITCGVVTFLSNMFMGVLLFFLTFYHTELSWFNWCLPGSCLLSLLLILCFRESYDRLYLDVVVSV

SEQ ID NO: 1268 - protein, 1524 aa, unidentified
MAMSNGNNDFVVLSNSSIATSAANPSPLTPCDGDHAAQQLTPKEATRTKVSPNGCLQLNGTVKSSFLPLDNQRMPQMLPQCCHPCPYHHPLTSHSSHQECHPEAGPAAPSALASCCMQPHSEYSASLCPNHSPVYQTTCCLQPSPSFCLHHPWPDHFQHQPVQQHIANIRPSRPFKLPKSYAALIADWPVVVLGMCTMFIVVCALVGVLVPELPDFSDPLLGFEPRGTAIGQRLVTWNNMVKNTGYKATLANYPFKYADEQAKSHRDDRWSDDHYEREKREVDWNFHKDSFFCDVPSDRYSRVVFTSSGGETLWNLPAIKSMCNVDNSRIRSHPQFGDLCQRTTAASCCPSWTLGNYIAILNNRSSCQKIVERDVSHTLKLLRTCAKHYQNGTLGPDCWDMAARRKDQLKCTNVPRKCTKYNAVYQILHYLVDKDFMTPKTADYATPALKYSMLFSPTEKGESMMNIYLDNFENWNSSDGVTTITGIEFGIKHSLFQDYLLMDTVYPAIAIVIVLLVMCVYTKSMFITLMTMFAIISSLIVSYFLYRVVFHFEFFPFMNLTALIILVGIGADDAFVLCDVWNYTKFDKPHAETSETVSITLQHAALSMFVTSFTTAAAFYANYVSNITAIRCFGVYAGTAILVNYVLMVTWLPAVVVLHERYLLNIFTCFKKPQQQIYDNKSCWTVACQKCHKVLFAISEASRIFFEKVLPCIVIKFRYLWLFWFLALTVGGAYIVCINPKMKLPSLELSEFQVFRSSHPFERYDAEYKKLFMFERVHHGEELHMPITVIWGVSPEDNGNPLNPKSKGKLTLDSSFNIASPASQAWILHFCQKLRNQTFFYQTDEQDFTSCFIETFKQWMENQDCDEPALYPCCSHWSFPYKQEIFELCIKRAIMELERSTGYHLDSKTPGPRFDINDTIRAVVLEFQSTYLFTLAYEKMHQFYKEVDSWISSELSSAPEGLSNGWFVSNLEFYDLQDSLSDGTLIAMGLSVAVAFSVMLLTTWNIIISLYAIISIAGTIFVTVGSLVLLGWELNVLESVTISVAVGLSVDFAVHYGVAYRLAPDPDREGKVIFSLSRVGSAMAMAALTTFVAGAMMMPSTVLAYTQLGTFMMLIMCISWAFATFFFQCMCRCLGPQGTCGQIPLPKKLQCSAFSHALSTSPSDKGQSKTHTINAYHLDPRGPKSELEHEFYELEPLASHSCTAPEKTTYEETHICSEFFNSQAKNLGMPVHAAYNSELSKSTESDAGSALLQPPLEQHTVCHFFSLNQRCSCPDAYKHLNYGPHSCQQMGDCLCHQCSPTTSSFVQIQNGVAPLKATHQAVEGFVHPITHIHHCPCLQGRVKPAGMQNSLPRNFFLHPVQHIQAQEKIGKTNVHSLQRSIEEHLPKMAEPSSFVCRSTGSLLKTCCDPENKQRELCKNRDVSNLESSGGTENKAGGKVELSLSQTDASVNSEHFNQNEPKVLFNHLMGEAGCRSCPNNSQSCGRIVRVKCNSVDCQMPNMEANVPAVLTHSELSGESLLIKTL

SEQ ID NO: 1269 - protein, 1401 aa, unidentified
MDGDSSSSSGGSGPAPGPGPEGEQRPEGEPLAPDGGSPDSTQTKAVPPEASPERSCSLHSCPLEDPSSSSGPPPTTSTLQPVGPSSPLAPAHFTYPRALQEYQGGSSLPGLGDRAALCSHGSSLSPSPAPSQRDGTWKPPAVQHHVVSVRQERAFQMPKSYSQLIAEWPVAVLMLCLAVIFLCTLAGLLGARLPDFSKPLLGFEPRDTDIGSKLVVWRALQALTGPRKLLFLSPDLELNSSSSHNTLRPAPRGSAQESAVRPRRMVEPLEDRRQENFFCGPPEKSYAKLVFMSTSSGSLWNLHAIHSMCRMEQDQIRSHTSFGALCQRTAANQCCPSWSLGNYLAVLSNRSSCLDTTQADAARTLALLRTCALYYHSGALVPSCLGPGQNKSPRCAQVPTKCSQSSAIYQLLHFLLDRDFLSPQTTDYQVPSLKYSLLFLPTPKGASLMDIYLDRLATPWGLADNYTSVTGMDLGLKQELLRHFLVQDTVYPLLALVAIFFGMALYLRSLFLTLMVLLGVLGSLLVAFFLYQVAFRMAYFPFVNLAALLLLSSVCANHTLIFFDLWRLSKSQLPSGGLAQRVGRTMHHFGYLLLVSGLTTSAAFYASYLSRLPAVRCLALFMGTAVLVHLALTLVWLPASAVLHERYLARGCARRARGRWEGSAPRRLLLALHRRLRGLRRAAAGTSRLLFQRLLPCGVIKFRYIWICWFAALAAGGAYIAGVSPRLRLPTLPPPGGQVFRPSHPFERFDAEYRQLFLFEQLPQGEGGHMPVVLVWGVLPVDTGDPLDPRSNSSLVRDPAFSASGPEAQRWLLALCHRARNQSFFDTLQEGWPTLCFVETLQRWMESPSCARLGPDLCCGHSDFPWAPQFFLHCLKMMALEQGPDGTQDLGLRFDAHGSLAALVLQFQTNFRNSPDYNQTQLFYNEVSHWLAAELGMAPPGLRRGWFTSRLELYSLQHSLSTEPAVVLGLALALAFATLLLGTWNVPLSLFSVAAVAGTVLLTVGLLVLLEWQLNTAEALFLSASVGLSVDFTVNYCISYHLCPHPDRLSRVAFSLRQTSCATAVGAAALFAAGVLMLPATVLLYRKLGIILMMVKCVSCGFASFFFQSLCCFFGPEKNCGQILWPCAHLPWDAGTGDPGGEKAGRPRPGSVGGMPGSCSEQYELQPLARRRSPSFDTSTATSKLSHRPSVLSEDLQLHDGPCCSRPPPAPASPRELLLDHQAVFSQCPALQTSSPYKQAGPSPKTRARQDSQGEEAEPLPASPEAPAHSPKAKAADPPDGFCSSASTLEGLSVSDETCLSTSEPSARVPDSVGVSPDDLDDTGQPVLERGQLNGKRDTLWLALRETVYDPSLPASHHSSLSWKGRGGPGDGSPVVLPNSQPDLPDVWLRRPSTHTSGYSS

SEQ ID NO: 1270 - protein, 1392 aa, unidentified
MDTEDDPLLQDVWLEEEQEEEEATGETFLGAQKPGPQPGAGGQCCWRHWPLASRPPASGFWSTLGWAFTNPCCAGLVLFLGCSIPMALSAFMFLYYPPLDIDISYNAFEIRNHEASQRFDALTLALKSQFGSWGRNRRDLADFTSETLQRLISEQLQQLHLGNRSRQASRAPRVIPAASLGGPGPYRDTSAAQKPTANRSGRLRRETPPLEDLAANQSEDPRNQRLSKNGRYQPSIPPHAAVAANQSRARRGASRWDYSRAYVSANTQTHAHWRIELIFLARGDAERNIFTSERLVTIHEIERKIMDHPGFREFCWKPHEVLKDLPLGSYSYCSPPSSLMTYFFPTERGGKIYYDGMGQDLADIRGSLELAMTHPEFYWYVDEGLSADNLKSSLLRSEILFGAPLPNYYSVDDRWEEQRAKFQSFVVTYVAMLAKQSTSKVQVLYGGTDLFDYEVRRTFNNDMLLAFISSSCIAALVYILTSCSVFLSFFGIASIGLSCLVALFLYHVVFGIQYLGILNGVAAFVIVGIGVDDVFVFINTYRQATHLEDPQLRMIHTVQTAGKATFFTSLTTAAAYAANVFSQIPAVHDFGLFMSLIVSCCWLAVLVTMPAALGLWSLYLAPLESSCQTSCHQNCSRKTSLHFPGDVFAAPEQVGGSPAQGPIPYLDDDIPLLEVEEEPVSLELGDVSLVSVSPEGLQPASNTGSRGHLIVQLQELLHHWVLWSAVKSRWVIVGLFVSILILSLVFASRLRPASRAPLLFRPDTNIQVLLDLKYNLSAEGISCITCSGLFQEKPHSLQNNIRTSLEKKRRGSGVPWASRPEATLQDFPGTVYISKVKSQGHPAVYRLSLNASLPAPWQAVSPGDGEVPSFQVYRAPFGNFTKKLTACMSTVGLLQAASPSRKWMLTTLACDAKRGWKFDFSFYVATKEQQHTRKLYFAQSHKPPFHGRVCMAPPGCLLSSSPDGPTKGFFFVPSEKVPKARLSATFGFNPCVNTGCGKPAVRPLVDTGAMVFVVFGIIGVNRTRQVDNHVIGDPGSVVYDSSFDLFKEIGHLCHLCKAIAANSELVKPGGAQCLPSGYSISSFLQMLHPECKELPEPNLLPGQLSHGAVGVREGRVQWISMAFESTTYKGKSSFQTYSDYLRWESFLQQQLQALPEGSVLRRGFQTCEHWKQIFMEIVGVQSALCGLVLSLLICVAAVAVFTTHILLLLPVLLSILGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 1271 - protein, 383 aa, unidentified
MTATEALLRVLLLLLAFGHSTYGAECFPACNPQNGFCEDDNVCRCQPGWQGPLCDQCVTSPGCLHGLCGEPGQCICTDGWDGELCDRDVRACSSAPCANNRTCVSLDDGLYECSCAPGYSGKDCQKKDGPCVINGSPCQHGGTCVDDEGRASHASCLCPPGFSGNFCEIVANSCTPNPCENDGVCTDIGGDFRCRCPAGFIDKTCSRPVTNCASSPCQNGGTCLQHTQVSYECLCKPEFTGLTCVKKRALSPQQVTRLPSGYGLAYRLTPGVHELPVQQPEHRILKVSMKELNKKTPLLTEGQAICFTILGVLTSLVVLGTVGIVFLNKCETWVSNLRYNHMLRKKKNLLLQYNSGEDLAVNIIFPEKIDMTTFSKEAGDEEI

SEQ ID NO: 1272 - protein, 383 aa, unidentified
MPSGCRCLHLVCLLCILGAPGQPVRADDCSSHCDLAHGCCAPDGSCRCDPGWEGLHCERCVRMPGCQHGTCHQPWQCICHSGWAGKFCDKDEHICTTQSPCQNGGQCMYDGGGEYHCVCLPGFHGRDCERKAGPCEQAGSPCRNGGQCQDDQGFALNFTCRCLVGFVGARCEVNVDDCLMRPCANGATCLDGINRFSCLCPEGFAGRFCTINLDDCASRPCQRGARCRDRVHDFDCLCPSGYGGKTCELVLPVPDPPTTVDTPLGPTSAVVVPATGPAPHSAGAGLLRISVKEVVRRQEAGLGEPSLVALVVFGALTAALVLATVLLTLRAWRRGVCPPGPCCYPAPHYAPACQDQECQVSMLPAGLPLPRDLPPEPGKTTAL

SEQ ID NO: 1273 - protein, 723 aa, unidentified
MGSRCALALAVLSALLCQVWSSGVFELKLQEFVNKKGLLGNRNCCRGGAGPPPCACRTFFRVCLKHYQASVSPEPPCTYGSAVTPVLGVDSFSLPDGGGADSAFSNPIRFPFGFTWPGTFSLIIEALHTDSPDDLATENPERLISRLATQRHLTVGEEWSQDLHSSGRTDLKYSYRFVCDEHYYGEGCSVFCRPRDDAFGHFTCGERGEKVCNPGWKGPYCTEPICLPGCDEQHGFCDKPGECKCRVGWQGRYCDECIRYPGCLHGTCQQPWQCNCQEGWGGLFCNQDLNYCTHHKPCKNGATCTNTGQGSYTCSCRPGYTGATCELGIDECDPSPCKNGGSCTDLENSYSCTCPPGFYGKICELSAMTCADGPCFNGGRCSDSPDGGYSCRCPVGYSGFNCEKKIDYCSSSPCSNGAKCVDLGDAYLCRCQAGFSGRHCDDNVDDCASSPCANGGTCRDGVNDFSCTCPPGYTGRNCSAPVSRCEHAPCHNGATCHERGHRYVCECARGYGGPNCQFLLPELPPGPAVVDLTEKLEGQGGPFPWVAVCAGVILVLMLLLGCAAVVVCVRLRLQKHRPPADPCRGETETMNNLANCQREKDISVSIIGATQIKNTNKKADFHGDHSADKNGFKARYPAVDYNLVQDLKGDDTAVRDAHSKRDTKCQPQGSSGEEKGTPTTLRGGEASERKRPDSGCSTSKDTKYQSVYVISEEKDECVIATEV

SEQ ID NO: 1274 - protein, 618 aa, unidentified
MVSPRMSGLLSQTVILALIFLPQTRPAGVFELQIHSFGPGPGPGAPRSPCSARLPCRLFFRVCLKPGLSEEAAESPCALGAALSARGPVYTEQPGAPAPDLPLPDGLLQVPFRDAWPGTFSFIIETWREELGDQIGGPAWSLLARVAGRRRLAAGGPWARDIQRAGAWELRFSYRARCEPPAVGTACTRLCRPRSAPSRCGPGLRPCAPLEDECEAPLVCRAGCSPEHGFCEQPGECRCLEGWTGPLCTVPVSTSSCLSPRGPSSATTGCLVPGPGPCDGNPCANGGSCSETPRSFECTCPRGFYGLRCEVSGVTCADGPCFNGGLCVGGADPDSAYICHCPPGFQGSNCEKRVDRCSLQPCRNGGLCLDLGHALRCRCRAGFAGPRCEHDLDDCAGRACANGGTCVEGGGAHRCSCALGFGGRDCRERADPCAARPCAHGGRCYAHFSGLVCACAPGYMGARCEFPVHPDGASALPAAPPGLRPGDPQRYLLPPALGLLVAAGVAGAALLLVHVRRRGHSQDAGSRLLAGTPEPSVHALPDALNNLRTQEGSGDGPSSSVDWNRPEDVDPQGIYVISAPSIYAREVATPLFPPLHTGRAGQRQHLLFPYPSSILSVK

SEQ ID NO: 1275 - protein, 685 aa, unidentified
MAAASRSASGWALLLLVALWQQRAAGSGVFQLQLQEFINERGVLASGRPCEPGCRTFFRVCLKHFQAVVSPGPCTFGTVSTPVLGTNSFAVRDDSSGGGRNPLQLPFNFTWPGTFSLIIEAWHAPGDDLRPEALPPDALISKIAIQGSLAVGQNWLLDEQTSTLTRLRYSYRVICSDNYYGDNCSRLCKKRNDHFGHYVCQPDGNLSCLPGWTGEYCQQPICLSGCHEQNGYCSKPAECLCRPGWQGRLCNECIPHNGCRHGTCSTPWQCTCDEGWGGLFCDQDLNYCTHHSPCKNGATCSNSGQRSYTCTCRPGYTGVDCELELSECDSNPCRNGGSCKDQEDGYHCLCPPGYYGLHCEHSTLSCADSPCFNGGSCRERNQGANYACECPPNFTGSNCEKKVDRCTSNPCANGGQCLNRGPSRMCRCRPGFTGTYCELHVSDCARNPCAHGGTCHDLENGLMCTCPAGFSGRRCEVRTSIDACASSPCFNRATCYTDLSTDTFVCNCPYGFVGSRCEFPVGLPPSFPWVAVSLGVGLAVLLVLLGMVAVAVRQLRLRRPDDGSREAMNNLSDFQKDNLIPAAQLKNTNQKKELEVDCGLDKSNCGKQQNHTLDYNLAPGPLGRGTMPGKFPHSDKSLGEKAPLRLHSEKPECRISAICSPRDSMYQSVCLISEERNECVIATEV

SEQ ID NO: 1276 - protein, 629 aa, unidentified
MSAEVRLRRLQQLVLDPGFLGLEPLLDLLLGVHQELGASELAQDKYVADFLQWAEPIVVRLKEVRLQRDDFEILKVIGRGAFSEVAVVKMKQTGQVYAMKIMNKWDMLKRGEVSCFREERDVLVNGDRRWITQLHFAFQDENYLYLVMEYYVGGDLLTLLSKFGERIPAEMARFYLAEIVMAIDSVHRLGYVHRDIKPDNILLDRCGHIRLADFGSCLKLRADGTVRSLVAVGTPDYLSPEILQAVGGGPGTGSYGPECDWWALGVFAYEMFYGQTPFYADSTAETYGKIVHYKEHLSLPLVDEGVPEEARDFIQRLLCPPETRLGRGGAGDFRTHPFFFGLDWDGLRDSVPPFTPDFEGATDTCNFDLVEDGLTAMVSGGGETLSDIREGAPLGVHLPFVGYSYSCMALRDSEVPGPTPMELEAEQLLEPHVQAPSLEPSVSPQDETAEVAVPAAVPAAEAEAEVTLRELQEALEEEVLTRQSLSREMEAIRTDNQNFASQLREAEARNRDLEAHVRQLQERMELLQAEGATAVTGVPSPRATDPPSHLDGPPAVAVGQCPLVGPGPMHRRHLLLPARVPRPGLSEALSLLLFAVVLSRAAALGCIGLVAHAGQLTAVWRRPGAARAP

SEQ ID NO: 1277 - protein, 561 aa, unidentified
MADPQAGSAAGDWEIDVESLELEEDVCGAPRSTPPGPSPPPADGDCEDDEDDDGVDEDAEEEGDGEEAGASPGMPGQPEQRGGPQPRPPLAPQASPAGTGPRERCTPAGGGAEPRKLSRTPKCARCRNHGVVSCLKGHKRFCRWRDCQCANCLLVVERQRVMAAQVALRRQQATEDKKGLSGKQNNFERKAVYQRQVRAPSLLAKSILEGYRPIPAETYVGGTFPLPPPVSDRMRKRRAFADKELENIMLEREYKEREMLETSQAAALFLPNRMVPGPDYNSYKSAYSPSPVEPPSKDFCNFLPTCLDLTMQYSGSGNMELISSNVSVATTYRQYPLSSRFLVWPKCGPISDTLLYQQCLLNATTSVQALKPGASWDLKGARVQDGLSAEQDMMPSKLEGSLVLPHTPEIQTTRSDLQGHQAVPERSAFSPPRRNFSPIVDTDSLAAQGHVLTKISKENTRHPLPLRHNPFHSLFQQTLTDKSGPELKTPFVKEAFEETPKKHRECLVKDNQKYTFTIDRCAKDLFVAKQVGTKLSVNEPLSFSVESILKRPSSAITRVSQ

SEQ ID NO: 1278 - protein, 3036 aa, unidentified
MHLHQVLTGAVNPGDNCYSVGSVGDVPFTAYGSGCDIVILANDFECVQIIPGAKHGNIQVSCVECSNQQGRIAASYGNAVCIFEPLGINSHKRNCQLKCQWLKTGQFFLSSVTYNLAWDPQDNRLLTATDSIQLWAPPGDDILEEEEEIDNTVPPVLNDWKCVWQCKTSVSVHLMEWSPDGEYFATAGKDDCLLKVWYPMTGWKSSIIPQDHHEVKRRQSSTQFSFVYLAHPRAVTGFSWRKTSKYMPRGSVCNVLLTSCHDGVCRLWAETLLPEDCLLGEQICETTTSSIASSLSHAGRHKDRIQHALETIHHLKNLRKGQRRSSVLVTHAELMPDQTAMHEVQRHISHHANALCHFHIAASINPATDIPNVLVGTAFNVDDGNGGFVVHWLNNKEFHFTSSTEVFMHQLRKLSDKQVDHENDDADREDEEHSQEDRERGLHMKLDHDLSLDRESEAGTGSSEHEDGEREGSPRTYSRLSVPMPLPTVLLDRKIETLLTEWNKNPDMLFTIHPVDGTFLVWHVKYLDEYNPGIFRQVQVSFSSRIPVAFPSGDASSLSKNIMMYACINATKDSHHTLLHQEGMSVGSPHGSQPHSRSHSTHMNILAPTVMMISKHIDGSLNQWAVTFADKSAFTTVLTVSHKFRYCGHRFHLNDLACHSVLPLLLTSSHHNALLTPELDCQWDSDNKLSRLMDPVKHIKGSSKQPLRNAATRTFHDPNAIYSELILWRVDPIGPLSYTGGVSELARINSLHTSAFSNVAWLPTLIPSYCLGTYCNSASACFVASDGKNLRLYQAVVDARKLLDELSDPESSKLIGEVFNIVSQQSTARPGCIIELDAITNQCGSNTQLLHVFQEDFIIGYKPHKEDMEKKETEIFFQPSQGYRPPPFSEKFFLVVIEKDSNNNSILHMWHLHLKSVQACLAKASEGASSESLLSVPGQKNVDSSPETSPSVSPMPHSSSIANLQTASKLILSSRLVYSQPLDLPESVEVIRATPSAGHLSSSSIYPVCLAPYLVVTTCSDNKVRFWKCCMEANPECNKSDEKEIYHWKRWPLMNDEGEDNSSTVSIVGRPVAVSCSYTGRLAVAYKQPIHHNGFVSKEFSMHVCIFECESTGGSEWVLEQTIHLDDLVKVGSVLDSRVSVDSNLFVYSKSDALLSKDRYLIPNIKHLVHLDWVSKEDGSHILTVGVGANIFMYGRLSGIVTEQTNSKDGVAVITLPLGGSIKQGVKSRWVLLRSIDLVSSVDGTPSLPVSLSWVRDGILVVGMDCEMHVYAQWKHAVKFGDTEADSSNAEEAAMQDHSTFKSNMLARKSVVEGTAISDDVFCSPTVIQDGGLFEAAHVLSPTLPQYHPTQLLELMDLGKVRRAKAILSHLVKCIAGEVAIVRDPDAGEGTKRHLSRTISVSGSTAKETVTVGKDGTRDYTEIDSIPPLPLYALLAADQDTSYRISEESTKIPQSYEDQTVSQPEDQYSELFQIQDIPTDDIDLEPEKRENKSKVINLSQYGPAYFGQEHARVLSSHLMHSSLPGLTRLEQMFLVALADTVATTSTELDESRDKSCSGRDTLDECGLRYLLAMRLHTCLLTSLPPLYRVQLLHQGVSTCHFAWAFHSEAEEELINMIPAIQRGDPQWSELRAMGIGWWVRNINTLRRCIEKVAKASFQRNNDALDAALFYLSMKKKAVVWGLFRSQHDEKMTTFFSHNFNEDRWRKAALKNAFSLLGKQRFEQSAAFFLLAGSLKDAIEVCLEKMEDIQLAMVIARLYESEFETSSTYISILNQKILGCQKDGSGFSCKRLHPDPFLRSLAYWVMKDYTRALDTLLEQTPKEDDEHQVIIKSCNPVAFSFYNYLRTHPLLIRRNLASPEGTLATLGLKTEKNFVDKINLIERKLFFTTANAHFKVGCPVLALEVLSKIPKVTKTSALSAKKDQPDFISHRMDDVPSHSKALSDGNGSSGIEWSNVTSSQYDWSQPIVKVDEEPLNLDWGEDHDSALDEEEDDAVGLVMKSTDAREKDKQSDQKASDPNMLLTPQEEDDPEGDTEVDVIAEQLKFRACLKILMTELRTLATGYEVDGGKLRFQLYNWLEKEIAALHEICNHESVIKEYSSKTYSKVESDLLDQEEMVDKPDIGSYERHQIERRRLQAKREHAERRKSWLQKNQDLLRVFLSYCSLHGAQGGGLASVRMELKFLLQESQQETTVKQLQSPLPLPTTLPLLSASIASTKTVIANPVLYLNNHIHDILYTIVQMKTPPHPSIEDVKVHTLHSLAASLSASIYQALCDSHSYSQTEGNQFTGMAYQGLLLSDRRRLRTESIEEHATPNSSPAQWPGVSSLINLLSSAQDEDQPKLNILLCEAVVAVYLSLLIHALATNSSSELFRLAAHPLNNRMWAAVFGGGVKLVVKPRRQSENISAPPVLSEDIDKHRRRFNMRMLVPGRPVKDATPPPVPAERPSYKEKFIPPELSMWDYFVAKPFLPLSDSGVIYDSDESIHSDEEDDAFFSDTQIQEHQDPNSYSWALLHLTMVKLALHNVKNFFPIAGLEFSELPVTSPLGIAVIKNLENWEQILQEKMDQFEGPPPNYINTYPTDLSVGAGPAILRNKAMLEPENTPFKSRDSSAFPVKRLWHFLVKQEVLQETFIRYIFTKKRKQSEVEADLGYPGGKAKVIHKESDMIMAFSVNKANCNEIVLASTHDVQELDVTSLLACQSYIWIGEEYDRESKSSDDVDYRGSTTTLYQPSATSYSASQVHPPSSLPWLGTGQTSTGASVLMKRNLHNVKRMTSHPVHQYYLTGAQDGSVRMFEWTRPQQLVCFRQAGNARVTRLYFNSQGNKCGVADGEGFLSIWQVNQTASNPKPYMSWQCHSKATSDFAFITSSSLVATSGHSNDNRNVCLWDTLISPGNSLIHGFTCHDHGATVLQYAPKQQLLISGGRKGHVCIFDIRQRQLIHTFQAHDSAIKALALDPYEEYFTTGSAEGNIKVWRLTGHGLIHSFKSEHAKQSIFRNIGAGVMQIDIIQGNRLFSCGADGTLKTRVLPNAFNIPNRILDIL

SEQ ID NO: 1279 - protein, 4427 aa, unidentified
MSSKAEKKQRLSGRGSSQASWSGRATRAAVATQEQGNAPAVSEPELQAELPKEEPEPRLEGPQAQSEESVEPEADVKPLFLSRAALTGLADAVWTQEHDAILEHFAQDPTESILTIFIDPCFGLKLELGMPVQTQNQLVYFIRQAPVPITWENFEATVQFGTVRGPYIPALLRLLGGVFAPQIFANTGWPESIRNHFASHLHKFLACLTDTRYKLEGHTVLYIPAEAMNMKPEMVIKDKELVQRLETSMIHWTRQIKEMLSAQETVETGENLGPLEEIEFWRNRCMDLSGISKQLVKKGVKHVESILHLAKSSYLAPFMKLAQQIQDGSRQAQSNLTFLSILKEPYQELAFMKPKDISSKLPKLISLIRIIWVNSPHYNTRERLTSLFRKVCDCQYHFARWEDGKQGPLPCFFGAQGPQITRNLLEIEDIFHKNLHTLRAVRGGILDVKNTCWHEDYNKFRAGIKDLEVMTQNLITSAFELVRDVPHGVLLLDTFHRLASREAIKRTYDKKAVDLYMLFNSELALVNRERNKKWPDLEPYVAQYSGKARWVHILRRRIDRVMTCLAGAHFLPRIGTGKESVHTYQQMVQAIDELVRKTFQEWTSSLDKDCIRRLDTPLLRISQEKAGMLDVNFDKSLLILFAEIDYWERLLFETPHYVVNVAERAEDLRILRENLLLVARDYNRIIAMLSPDEQALFKERIRLLDKKIHPGLKKLHWALKGASAFFITECRIHASKVQMIVNEFKASTLTIGWRAQEMSEKLLVRISGKRVYRDLEFEEDQREHRAAVQQKLMNLHQDVVTIMTNSYEVFKNDGPEIQQQWMLYMIRLDRMMEDALRLNVKWSLLELSKAINGDGKTSPNPLFQVLVILKNDLQGSVAQVEFSPTLQTLAGVVNDIGNHLFSTISVFCHLPDILTKRKLHREPIQTVVEQDEDIKKIQTQISSGMTNNASLLQNYLKTWDMYREIWEINKDSFIHRYQRLNPPVSSFVADIARYTEVANNVQKEETVTNIQFVLLDCSHLKFSLVQHCNEWQNKFATLLREMAAGRLLELHTYLKENAEKISRPPQTLEELGVSLQLVDALKHDLANVETQIPPIHEQFAILEKYEVPVEDSVLEMLDSLNGEWVVFQQTLLDSKQMLKKHKEKFKTGLIHSADDFKKKAHTLLEDFEFKGHFTSNVGYMSALDQITQVRAMLMAMREEENSLRANLGIFKIEQPPSKDLQNLEKELDALQQIWEIARDWEENWNEWKTGRFLILQTETMETTAHGLFRRLTKLAKEYKDRNWEIIETTRSKIEQFKRTMPLISDLRNPALRERHWDQVRDEIQREFDQESESFTLEQIVELGMDQHVEKIGEISASATKELAIEVALQNIAKTWDVTQLDIVPYKDKGHHRLRGTEEVFQALEDNQVALSTMKASRFVKAFEKDVDHWERCLSLILEVIEMILTVQRQWMYLENIFLGEDIRKQLPNESTLFDQVNSNWKAIMDRMNKDNNALRSTHHPGLLDTLIEMNTILEDIQKSLDMYLETKRHIFPRFYFLSNDDLLEILGQSRNPEAVQPHLKKCFDNIKLLRIQKVGGPSSKWEAVGMFSGDGEYIDFLHSVFLEGPVESWLGDVEQTMRVTLRDLLRNCHLALRKFLNKRDKWVKEWAGQVVITASQIQWTADVTKCLLTAKERADKKILKVMKKNQVSILNKYSEAIRGNLTKIMRLKIVALVTIEIHARDVLEKLYKSGLMDVNSFDWLSQLRFYWEKDLDDCVIRQTNTQFQYNYEYLGNSGRLVITPLTDRCYMTLTTALHLHRGGSPKGPAGTGKTETVKDLGKALGIYVIVVNCSEGLDYKSMGRMYSGLAQTGAWGCFDEFNRINIEVLSVVAHQILCILSALAAGLTHFHFDGFEINLVWSCGIFITMNPGYAGRTELPENLKSMFRPIAMVVPDSTLIAEIILFGEGFGNCKILAKKVYTLYSLAVQQLSRQDHYDFGLRALTSLLRYAGKKRRLQPDLTDEEVLLLSMRDMNIAKLTSVDAPLFNAIVQDLFPNIELPVIDYGKLRETVEQEIRDMGLQSTPFTLTKVFQLYETKNSRHSTMIVGCTGSGKTASWRILQASLSSLCRAGDPNFNIVREFPLNPKALSLGELYGEYDLSTNEWTDGILSSVMRTACADEKPDEKWILFDGPVDTLWIENMNSVMDDNKVLTLINGERIAMPEQVSLLFEVEDLAMASPATVSRCGMVYTDYADLGWKPYVQSWLEKRPKAEVEPLQRMFEKLINKMLAFKKDNCKELVPLPEYSGITSLCKLYSALATPENGVNPADGENYVTMVEMTFVFSMIWSVCASVDEEGRKRIDSYLREIEGSFPNKDTVYEYFVDPKIRSWTSFEDKLPKSWRYPPNAPFYKIMVPTVDTVRYNYLVSSLVANQNPILLVGPVGTGKTSIAQSVLQSLPSSQWSVLVVNMSAQTTSNNVQSIIESRVEKRTKGVYVPFGGKSMITFMDDLNMPAKDMFGSQPPLELIRLWIDYGFWYDRTKQTIKYIREMFLMAAMGPPGGGRTVISPRLRSRFNIINMTFPTKSQIIRIFGTMINQKLQDFEEEVKPIGNVVTEATLDMYNTVVQRFLPTPTKMHYLFNLRDISKVFQGMLRANKDFHDTKSSITRLWIHECFRVFSDRLVDAADTEAFMGIISDKLGSFFDLTFHHLCPSKRPPIFGDFLKEPKVYEDLTDLTVLKTVMETALNEYNLSPSVVPMQLVLFREAIEHITRIVRVIGQPRGNMLLVGIGGSGRQSLARLASSICDYTTFQIEVTKHYRKQEFRDDIKRLYRQAGVELKTTSFIFVDTQIADESFLEDINNILSSGEVPNLYKPDEFEEIQSHIIDQARVEQVPESSDSLFAYLIERVQNNLHIVLCLSPMGDPFRNWIRQYPALVNCTTINWFSEWPQEALLEVAEKCLIGVDLGTQENIHRKVAQIFVTMHWSVAQYSQKMLLELRRHNYVTPTKYLELLSGYKKLLGEKRQELLAQANKLRTGLFKIDETREKVQVMSLELEDAKKKVAEFQKQCEEYLVIIVQQKREADEQQKAVTANSEKIAVEEIKCQALADNAQKDLEEALPALEEAMRALESLNKKDIGEIKSYGRPPAQVEIVMQAVMILRGNEPTWAEAKRQLGEQNFIKSLINFDKDNISDKVLKKIGAYCAQPDFQPDIIGRVSLAAKSLCMWVRAMELYGRLYRVVEPKRIRMNAALAQLREKQAALAEAQEKLREVAEKLEMLKKQYDEKLAQKEELRKKSEEMELKLERAGMLVSGLAGEKARWEETVQGLEEDLGYLVGDCLLAAAFLSYMGPFLTNYRDEIVNQIWIGKIWELQVPCSPSFAIDNFLCNPTKVRDWNIQGLPSDAFSTENGIIVTRGNRWALMIDPQAQALKWIKNMEGGQGLKIIDLQMSDYLRILEHAIHFGYPVLLQNVQEYLDPTLNPMLNKSVARIGGRLLMRIGDKEVEYNTNFRFYITTKLSNPHYSPETSAKTTIVNFAVKEQGLEAQLLGIVVRKERPELEEQKDSLVINIAAGKRKLKELEDEILRLLNEATGSLLDDVQLVNTLHTSKITATEVTEQLETSETTEINTDLAREAYRPCAQRASILFFVLNDMGCIDPMYQFSLDAYISLFILSIDKSHRSNKLEDRIDYLNDYHTYAVYRYTCRTLFERHKLLFSFHMCAKILETSGKLNMDEYNFFLRGGVVLDREGQMDNPCSSWLADAYWDNITELDKLTNFHGLMNSFEQYPRDWHLWYTNAAPEKAMLPGEWENACNEMQRMLIVRSLRQDRVAFCVTSFIITNLGSRFIEPPVLNMKSVLEDSTPRSPLVFILSPGVDPTSALLQLAEHMGMAQRFHALSLGQGQAPIAARLLREGVTQGHWVFLANCHLSLSWMPNLDKLVEQLQVEDPHPSFRLWLSSIPHPDFPISILQVSIKMTTEPPKGLKANMTRLYQLMSEPQFSRCSKPAKYKKLLFSLCFFHSVLLERKKFLQLGWNIIYGFNDSDFEVSENLLSLYLDEYEETPWDALKYLIAGINYGGHVTDDWDRRLLTTYINDYFCDQSLSTPFHRLSALETYFIPKDGSLASYKEYISLLPGMDPPEAFGQHPNADVASQITEAQTLFDTLLSLQPQITPTRAGGQTREEKVLELAADVKQKIPEMIDYEGTQKLLALDPSPLNVVLLQEIQRYNTLMQTILFSLTDLEKGIQGLIVMSTSLEEIFNCIFDAHVPPLWGKAYPSQKPLAAWTRDLAMRVEQFELWASRARPPVIFWLSGFTFPTGFLTAVLQSSARQNNVSVDSLSWEFIVSTVDDSNLVYPPKDGVWVRGLYLEGAGWDRKNSCLVEAEPMQLVCLMPTIHFRPAESRKKSAKGMYSCPCYYYPNRAGSSDRASFVIGIDLRSGAMTPDHWIKRGTALLMSLDS

SEQ ID NO: 1280 - protein, 409 aa, unidentified
MSSLRARLPATRRRVAQPFARPASPSLVPRSGSAMESNKDEAERCISIALKAIQSNQPDRALRFLEKAQRLYPTPRVRALIESLNQKPQTAGDQPPPTDTTHATHRKAGGTDAPSANGEAGGESTKGYTAEQVAAVKRVKQCKDYYEILGVSRGASDEDLKKAYRRLALKFHPDKNHAPGATEAFKAIGTAYAVLSNPEKRKQYDQFGDDKSQAARHGHGHGDFHRGFEADISPEDLFNMFFGGGFPSSNVHVYSNGRMRYTYQQRQDRRDNQGDGGLGVFVQLMPILILILVSALSQLMVSSPPYSLSPRPSVGHIHRRVTDHLGVVYYVGDTFSEEYTGSSLKTVERNVEDDYIANLRNNCWKEKQQKEGLLYRARYFGDTDMYHRAQKMGTPSCSRLSEVQASLHG

SEQ ID NO: 1281 - protein, 379 aa, unidentified
MEGNRDEAEKCVEIAREALNAGNREKAQRFLQKAEKLYPLPSARALLEIIMKNGSTAGNSPHCRKPSGSGDQSKPNCTKDSTSGSGEGGKGYTKDQVDGVLSINKCKNYYEVLGVTKDAGDEDLKKAYRKLALKFHPDKNHAPGATDAFKKIGNAYAVLSNPEKRKQYDLTGNEEQACNHQNNGRFNFHRGCEADITPEDLFNIFFGGGFPSGSVHSFSNGRAGYSQQHQHRHSGHEREEERGDGGFSVFIQLMPIIVLILVSLLSQLMVSNPPYSLYPRSGTGQTIKMQTENLGVVYYVNKDFKNEYKGMLLQKVEKSVEEDYVTNIRNNCWKERQQKTDMQYAAKVYRDDRLRRKADALSMDNCKELERLTSLYKGG

SEQ ID NO: 1282 - protein, 554 aa, unidentified
MTAPCSQPAQLPGRRQLGLVPFPPPPPRTPLLWLLLLLLAAVAPARGWESGDLELFDLVEEVQLNFYQFLGVQQDASSADIRKAYRKLSLTLHPDKNKDENAETQFRQLVAIYEVLKDDERRQRYDDILINGLPDWRQPVFYYRRVRKMSNAELALLLFIILTVGHYAVVWSIYLEKQLDELLSRKKREKKKKTGSKSVDVSKLGASEKNERLLMKPQWHDLLPCKLGIWFCLTLKALPHLIQDAGQFYAKYKETRLKEKEDALTRTELETLQKQKKVKKPKPEFPVYTPLETTYIQSYDHGTSIEEIEEQMDDWLENRNRTQKKQAPEWTEEDLSQLTRSMVKFPGGTPGRWEKIAHELGRSVTDVTTKAKQLKDSVTCSPGMVRLSELKSTVQNSRPIKTATTLPDDMITQREDAEGVAAEEEQEGDSGEQETGATDARPRRRKPARLLEATAKPEPEEKSRAKRQKDFDIAEQNESSDEESLRKERARSAEEPWTQNQQKLLELALQQYPRGSSDRWDKIARCVPSKSKEDCIARYKLLVELVQKKKQAKS

SEQ ID NO: 1283 - protein, 793 aa, unidentified
MGVWLNKDDYIRDLKRIILCFLIVYMAILVGTDQDFYSLLGVSKTASSREIRQAFKKLALKLHPDKNPNNPNAHGDFLKINRAYEVLKDEDLRKKYDKYGEKGLEDNQGGQYESWNYYRYDFGIYDDDPEIITLERREFDAAVNSGELWFVNFYSPGCSHCHDLAPTWRDFAKEVDGLLRIGAVNCGDDRMLCRMKGVNSYPSLFIFRSGMAPVKYHGDRSKESLVSFAMQHVRSTVTELWTGNFVNSIQTAFAAGIGWLITFCSKGGDCLTSQTRLRLSGMLDGLVNVGWMDCATQDNLCKSLDITTSTTAYFPPGATLNNKEKNSILFLNSLDAKEIYLEVIHNLPDFELLSANTLEDRLAHHRWLLFFHFGKNENSNDPELKKLKTLLKNDHIQVGRFDCSSAPDICSNLYVFQPSLAVFKGQGTKEYEIHHGKKILYDILAFAKESVNSHVTTLGPQNFPANDKEPWLVDFFAPWCPPCRALLPELRRASNLLYGQLKFGTLDCTVHEGLCNMYNIQAYPTTVVFNQSNIHEYEGHHSAEQILEFIEDLMNPSVVSLTPTTFNELVTQRKHNEVWMVDFYSPWCHPCQVLMPEWKRMARTLTGLINVGSIDCQQYHSFCAQENVQRYPEIRFFPPKSNKAYHYHSYNGWNRDAYSLRIWGLGFLPQVSTDLTPQTFSEKVLQGKNHWVIDFYAPWCGPCQNFAPEFELLARMIKGKVKAGKVDCQAYAQTCQKAGIRAYPTVKFYFYERAKRNFQEEQINTRDAKAIAALISEKLETLRNQGKRNKDEL

SEQ ID NO: 1284 - protein, 559 aa, unidentified
MATALSEEELDNEDYYSLLNVRREASSEELKAAYRRLCMLYHPDKHRDPELKSQAERLFNLVHQAYEVLSDPQTRAIYDIYGKRGLEMEGWEVVERRRTPAEIREEFERLQREREERRLQQRTNPKGTISVGVDATDLFDRYDEEYEDVSGSSFPQIEINKMHISQSIEAPLTATDTAILSGSLSTQNGNGGGSINFALRRVTSAKGWGELEFGAGDLQGPLFGLKLFRNLTPRCFVTTNCALQFSSRGIRPGLTTVLARNLDKNTVGYLQWRWGIQSAMNTSIVRDTKTSHFTVALQLGIPHSFALISYQHKFQDDDQTRVKGSLKAGFFGTVVEYGAERKISRHSVLGAAVSVGVPQGVSLKVKLNRASQTYFFPIHLTDQLLPSAMFYATVGPLVVYFAMHRLIIKPYLRAQKEKELEKQRESAATDVLQKKQEAESAVRLMQESVRRIIEAEESRMGLIIVNAWYGKFVNDKSRKSEKVKVIDVTVPLQCLVKDSKLILTEASKAGLPGFYDPCVGEEKNLKVLYQFRGVLHQVMVLDSEALRIPKQSHRIDTDG

SEQ ID NO: 1285 - protein, 2243 aa, unidentified
MNIIRENKDLACFYTTKHSWRGKYKRVFSVGTHAITTYNPNTLEVTNQWPYGDICSISPVGKGQGTEFNLTFRKGSGKKSETLKFSTEHRTELLTEALRFRTDFSEGKITGRRYNCYKHHWSDSRKPVILEVTPGGFDQINPATNRVLCSYDYRNIEGFVDLSDYQGGFCILYGGFSRLHLFASEQREEIIKSAIDHAGNYIGISLRIRKEPLEFEQYLNLRFGKYSTDESITSLAEFVVQKISPRHSEPVKRVLALTETCLVERDPATYNIATLKPLGEVFALVCDSENPQLFTIEFIKGQVRKYSSTERDSLLASLLDGVRASGNRDVCVKMTPTHKGQRWGLLSMPVDEEVESLHLRFLATPPNGNFADAVFRFNANISYSGVLHAVTQDGLFSENKEKLINNAITALLSQEGDVVASNAELESQFQAVRRLVASKAGFLAFTQLPKFRERLGVKVVKALKRSNNGIIHAAVDMLCALMCPMHDDYDLRQEQLNKASLLSSKKFLENLLEKFNSHVDHGTGALVISSLLDFLTFALCAPYSETTEGQQFDMLLEMVASNGRTLFKLFQHPSMAIIKGAGLVMKAIIEEGDKEIATKMQELALSEGALPRHLHTAMFTISSDQRMLTNRQLSRHLVGLWTADNATATNLLKRILPPGLLAYLESSDLVPEKDADRMHVRDNVKIAMDQYGKFNKVPEWQRLAGKAAKEVEKFAKEKVDLVLMHWRDRMGIAQKENINQKPVVLRKRRQRIKIEANWDLFYYRFGQDHARSNLIWNFKTREELKDTLESEMRAFNIDRELGSANVISWNHHEFEVKYECLAEEIKIGDYYLRLLLEEDENEESGSIKRSYEFFNELYHRFLLTPKVNMKCLCLQALAIVYGRCHEEIGPFTDTRYIIGMLERCTDKLERDRLILFLNKLILNKKNVKDLMDSNGIRILVDLLTLAHLHVSRATVPLQSNVIEAAPDMKRESEKEWYFGNADKERSGPYGFHEMQELWTKGMLNAKTRCWAQGMDGWRPLQSIPQLKWCLLASGQAVLNETDLATLILNMLITMCGYFPSRDQDNAIIRPLPKVKRLLSDSTCLPHIIQLLLTFDPILVEKVAILLYHIMQDNPQLPRLYLSGVFFFIMMYTGSNVLPVARFLKYTHTKQAFKSEETKGQDIFQRSILGHILPEAMVCYLENYEPEKFSEIFLGEFDTPEAIWSSEMRRLMIEKIAAHLADFTPRLQSNTRALYQYCPIPIINYPQLENELFCNIYYLKQLCDTLRFPDWPIKDPVKLLKDTLDAWKKEVEKKPPMMSIDDAYEVLNLPQGQGPHDESKIRKAYFRLAQKYHPDKNPEGRDMFEKVNKAYEFLCTKSAKIVDGPDPENIILILKTQSILFNRHKEDLQPYKYAGYPMLIRTITMETSDDLLFSKESPLLPAATELAFHTVNCSALNAEELRRENGLEVLQEAFSRCVAVLTRASKPSDMSVQVCGYISKCYSVAAQFEECREKITEMPSIIKDLCRVLYFGKSIPRVAALGVECVSSFAVDFWLQTHLFQAGILWYLLGFLFNYDYTLEESGIQKSEETNQQEVANSLAKLSVHALSRLGGYLAEEQATPENPTIRKSLAGMLTPYVARKLAVASVTEILKMLNSNTESPYLIWNNSTRAELLEFLESQQENMIKKGDCDKTYGSEFVYSDHAKELIVGEIFVRVYNEVPTFQLEVPKAFAASLLDYIGSQAQYLHTFMAITHAAKVESEQHGDRLPRVEMALEALRNVIKYNPGSESECIGHFKLIFSLLRVHGAGQVQQLALEVVNIVTSNQDCVNNIAESMVLSSLLALLHSLPSSRQLVLETLYALTSSTKIIKEAMAKGALIYLLDMFCNSTHPQVRAQTAELFAKMTADKLIGPKVRITLMKFLPSVFMDAMRDNPEAAVHIFEGTHENPELIWNDNSRDKVSTTVREMMLEHFKNQQDNPEANWKLPEDFAVVFGEAEGELAVGGVFLRIFIAQPAWVLRKPREFLIALLEKLTELLEKNNPHGETLETLTMATVCLFSAQPQLADQVPPLGHLPKVIQAMNHRNNAIPKSAIRVIHALSENELCVRAMASLETIGPLMNGMKKRADTVGLACEAINRMFQKEQSELVAQALKADLVPYLLKLLEGIGLENLDSPAATKAQIVKALKAMTRSLQYGEQVNEILCRSSVWSAFKDQKHDLFISESQTAGYLTGPGVAGYLTAGTSTSVMSNLPPPVDHEAGDLGYQT

SEQ ID NO: 1286 - protein, 702 aa, unidentified
MAQKHPGERGLYGAHHSGGASLRTLGPSVDPEIPSFSGLRDSAGTAPNGTRCLTEHSGPKHTQHPNPAHWLDPSHGPPGGPGPPRDAEDPDQSETSSEEESGVDQELSKENETGNQKDGNSFLSIPSACNCQGTPGIPEGPYSEGGNGSSSNFCHHCTSPALGEDELEEEYDDEESLKFPSDFSRVSSGKKPPSRRQRHRFPTKEDTREGGRRDPRSPGRHRLGRKRSQADKRKGLGLWGAEELCQLGQAGFWWLIELLVLVGEYVETCGHLIYACRQLKSSDLDLFRVWMGVWTGRLGGWAQVMFQFLSQGFYCGVGLFTRFLKLLGALLLLALALFLGFLQLGWRFLVGLGDRLGWRDKATWLFSWLDSPALQRCLTLLRDSRPWQRLVRIVQWGWLELPWVKQNINRQGNAPVASGRYCQPEEEVARLLTMAGVPEDELNPFHVLGVEATASDVELKKAYRQLAVMVHPDKNHHPRAEEAFKVLRAAWDIVSNAEKRKEYEMKRMAENELSRSVNEFLSKLQDDLKEAMNTMMCSRCQGKHRRFEMDREPKSARYCAECNRLHPAEEGDFWAESSMLGLKITYFALMDGKVYDITEWAGCQRVGISPDTHRVPYHISFGSRIPGTRGRQRATPDAPPADLQDFLSRIFQVPPGQMPNGNFFAAPQPAPGAAAASKPNSTVPKGEAKPKRRKKVRRPFQR

SEQ ID NO: 1287 - protein, 150 aa, unidentified
MAARGVIAPVGESLRYAEYLQPSAKRPDADVDQQRLVRSLIAVGLGVAALAFAGRYAFRIWKPLEQVITETAKKISTPSFSSYYKGGFEQKMSRREAGLILGVSPSAGKAKIRTAHRRVMILNHPDKGGSPYVAAKINEAKDLLETTTKH

SEQ ID NO: 1288 - protein, 782 aa, unidentified
MEVRKLSISWQFLIVLVLILQILSALDFDPYRVLGVSRTASQADIKKAYKKLAREWHPDKNKDPGAEDKFIQISKAYEILSNEEKRSNYDQYGDAGENQGYQKQQQQREYRFRHFHENFYFDESFFHFPFNSERRDSIDEKYLLHFSHYVNEVVPDSFKKPYLIKITSDWCFSCIHIEPVWKEVIQELEELGVGIGVVHAGYERRLAHHLGAHSTPSILGIINGKISFFHNAVVRENLRQFVESLLPGNLVEKVTNKNYVRFLSGWQQENKPHVLLFDQTPIVPLLYKLTAFAYKDYLSFGYVYVGLRGTEEMTRRYNINIYAPTLLVFKEHINRPADVIQARGMKKQIIDDFITRNKYLLAARLTSQKLFHELCPVKRSHRQRKYCVVLLTAETTKLSKPFEAFLSFALANTQDTVRFVHVYSNRQQEFADTLLPDSEAFQGKSAVSILERRNTAGRVVYKTLEDPWIGSESDKFILLGYLDQLRKDPALLSSEAVLPDLTDELAPVFLLRWFYSASDYISDCWDSIFHNNWREMMPLLSLIFSALFILFGTVIVQAFSDSNDERESSPPEKEEAQEKTGKTEPSFTKENSSKIPKKGFVEVTELTDVTYTSNLVRLRPGHMNVVLILSNSTKTSLLQKFALEVYTFTGSSCLHFSFLSLDKHREWLEYLLEFAQDAAPIPNQYDKHFMERDYTGYVLALNGHKKYFCLFKPQKTVEEEEAIGSCSDVDSSLYLGESRGKPSCGLGSRPIKGKLSKLSLWMERLLEGSLQRFYIPSWPELD

SEQ ID NO: 1289 - protein, 358 aa, unidentified
MAATLGSGERWTEAYIDAVRRNKYPEDTPPESHDPCGCCNCMKAQKEKKSENEWTQTRQGEGNSTYSEEQLLGVQRIKKCRNYYEILGVSRDASDEELKKAYRKLALKFHPDKNCAPGATDAFKAIGNAFAVLSNPDKRLRYDEYGDEQVTFTAPRARPYNYYRDFEADITPEELFNVFFGGHFPTGNIHMFSNVTDDTYYYRRRHRHERTQTQKEEEEEKPQTTYSAFIQLLPVLVIVIISVITQLLATNPPYSLFYKSTLGYTISRETQNLQVPYFVDKNFDKAYRGASLHDLEKTIEKDYIDYIQTSCWKEKQQKSELTNLAGLYRDERLKQKAESLKLENCEKLSKLIGLRRGG

SEQ ID NO: 1290 - protein, 341 aa, unidentified
MAKGLLVTYALWAVGGPAGLHHLYLGRDSHALLWMLTLGGGGLGWLWEFWKLPSFVAQANRAQGQRQSPRGVTPPLSPIRFAAQVIVGIYFGLVALISLSSMVNFYIVALPLAVGLGVLLVAAVGNQTSDFKNTLGSAFLTSPIFYGRPIAILPISVAASITAQRHRRYKALVASEPLSVRLYRLGLAYLAFTGPLAYSALCNTAATLSYVAETFGSFLNWFSFFPLLGRLMEFVLLLPYRIWRLLMGETGFNSSCFQEWAKLYEFVHSFQDEKRQLAYQVLGLSEGATNEEIHRSYQELVKVWHPDHNLDQTEEAQRHFLEIQAAYEVLSQPRKPWGSRR

SEQ ID NO: 1291 - protein, 360 aa, unidentified
MGAPLLSPGWGAGAAGRRWWMLLAPLLPALLLVRPAGALVEGLYCGTRDCYEVLGVSRSAGKAEIARAYRQLARRYHPDRYRPQPGDEGPGRTPQSAEEAFLLVATAYETLKDEETRKDYDYMLDHPEEYYSHYYHYYSRRLAPKVDVRVVILVSVCAISVFQFFSWWNSYNKAISYLATVPKYRIQATEIAKQQGLLKKAKEKGKNKKSKEEIRDEEENIIKNIIKSKIDIKGGYQKPQICDLLLFQIILAPFHLCSYIVWYCRWIYNFNIKGKEYGEEERLYIIRKSMKMSKSQFDSLEDHQKETFLKRELWIKENYEVYKQEQEEELKKKLANDPRWKRYRRWMKNEGPGRLTFVDD

SEQ ID NO: 1292 - protein, 226 aa, unidentified
MAAMRWRWWQRLLPWRLLQARGFPQNSAPSLGLGARTYSQGDCSYSRTALYDLLGVPSTATQAQIKAAYYRQCFLYHPDRNSGSAEAAERFTRISQAYVVLGSATLRRKYDRGLLSDEDLRGPGVRPSRTPAPDPGSPRTPPPTSRTHDGSRASPGANRTMFNFDAFYQAHYGEQLERERRLRARREALRKRQEYRSMKGLRWEDTRDTAAIFLIFSIFIIIGFYI

SEQ ID NO: 1293 - protein, 241 aa, unidentified
MPPLLPLRLCRLWPRNPPSRLLGAAAGQRSRPSTYYELLGVHPGASTEEVKRAFFSKSKELHPDRDPGNPSLHSRFVELSEAYRVLSREQSRRSYDDQLRSGSPPKSPRTTVHDKSAHQTHSSWTPPNAQYWSQFHSVRPQGPQLRQQQHKQNKQVLGYCLLLMLAGMGLHYIAFRKVKQMHLNFMDEKDRIITAFYNEARARARANRGILQQERQRLGQRQPPPSEPTQGPEIVPRGAGP

SEQ ID NO: 1294 - protein, 198 aa, unidentified
MADQRQRSLSTSGESLYHVLGLDKNATSDDIKKSYRKLALKYHPDKNPDNPEAADKFKEINNAHAILTDATKRNIYDKYGSLGLYVAEQFGEENVNTYFVLSSWWAKALFVFCGLLTCCYCCCCLCCCFNCCCGKCKPKAPEGEETEFYVSPEDLEAQLQSDEREATDTPIVIQPASATETTQLTADSHPSYHTDGFN

SEQ ID NO: 1295 - protein, 199 aa, unidentified
MACNIPNQRQRTLSTTGEALYEILGLHKGASNEEIKKTYRKLALKHHPDKNPDDPAATEKFKEINNAHAILTDISKRSIYDKYGSLGLYVAEQFGDENVNTYFMLSSWWAKALFVIVGLLTGCYFCCCLCCCCNCCCGHCRPESSVPEEDFYVSPEDLEEQIKSDMEKDVDFPVFLQPTNANEKTQLIKEGSRSYCTDS

SEQ ID NO: 1296 - protein, 189 aa, unidentified
MSTVKEAAHRLSKSEMSLYAVLDLKKGASPEDFKKSYSHSALLPHPPFEYHLGRKLALRYHPDKNPGNAQAAEIFKEINAAHAILSDSKKRKIYDQHGSLGIYLYDHFGEEGVRYYFILNSCWFKTLVILCTLLTCCCFCCCCCFCCGALKPPPEQDSGRKYQQNVQSQPPRSGAKCDFRSEENSEDDF

SEQ ID NO: 1297 - protein, 737 aa, unidentified
MQPRRAQAPGAQLLPALALLLLLLGAGPRGSSLANPVPAAPLSAPGPCAAQPCRNGGVCTSRPEPDPQHPAPAGEPGYSCTCPAGISGANCQLVADPCASNPCHHGNCSSSSSSSSDGYLCICNEGYEGPNCEQALPSLPATGWTESMAPRQLQPVPATQEPDKILPRSQATVTLPTWQPKTGQKVVEMKWDQVEVIPDIACGNASSNSSAGGRLVSFEVPQNTSVKIRQDATASLILLWKVTATGFQQCSLIDGRSVTPLQASGGLVLLEEMLALGNNHFIGFVNDSVTKSIVALRLTLVVKVSTCVPGESHANDLECSGKGKCTTKPSEATFSCTCEEQYVGTFCEEYDACQRKPCQNNASCIDANEKQDGSNFTCVCLPGYTGELCQSKIDYCILDPCRNGATCISSLSGFTCQCPEGYFGSACEEKVDPCASSPCQNNGTCYVDGVHFTCNCSPGFTGPTCAQLIDFCALSPCAHGTCRSVGTSYKCLCDPGYHGLYCEEEYNECLSAPCLNAATCRDLVNGYECVCLAEYKGTHCELYKDPCANVSCLNGATCDSDGLNGTCICAPGFTGEECDIDINECDSNPCHHGGSCLDQPNGYNCHCPHGWVGANCEIHLQWKSGHMAESLTNMPRHSLYIIIGALCVAFILMLIILIVGICRISRIEYQGSSRPAYEEFYNCRSIDSEFSNAIASIRHARFGKKSRPAMYDVSPIAYEDYSPDDKPLVTLIKTKDL

SEQ ID NO: 1298 - protein, 475 aa, unidentified
MQVAMNGKARKEAVQTAAKELLKFVNRSPSPFHAVAECRNRLLQAGFSELKETEKWNIKPESKYFMTRNSSTIIAFAVGGQYVPGNGFSLIGAHTDSPCLRVKRRSRRSQVGFQQVGVETYGGGIWSTWFDRDLTLAGRVIVKCPTSGRLEQQLVHVERPILRIPHLAIHLQRNINENFGPNTEMHLVPILATAIQEELEKGTPEPGPLNAVDERHHSVLMSLLCAHLGLSPKDIVEMELCLADTQPAVLGGAYDEFIFAPRLDNLHSCFCALQALIDSCAGPGSLATEPHVRMVTLYDNEEVGSESAQGAQSLLTELVLRRISASCQHPTAFEEAIPKSFMISADMAHAVHPNYLDKHEENHRPLFHKGPVIKVNSKQRYASNAVSEALIREVANKVKVPLQDLMVRNDTPCGTTIGPILASRLGLRVLDLGSPQLAMHSIREMACTTGVLQTLTLFKGFFELFPSLSHNLLVD

SEQ ID NO: 1299 - protein, 504 aa, unidentified
MTEAALVEGQVKLRDGKKWKSRWLVLRKPSPVADCLLMLVYKDKSERIKGLRERSSLTLEDICGLEPGLPYEGLVHTLAIVCLSQAIMLGFDSHEAMCAWDARIRYALGEVHRFHVTVAPGTKLESGPATLHLCNDVLVLARDIPPAVTGQWKLSDLRRYGAVPSGFIFEGGTRCGYWAGVFFLSSAEGEQISFLFDCIVRGISPTKGPFGLRPVLPDPSPPGPSTVEERVAQEALETLQLEKRLSLLSHAGRPGSGGDDRSLSSSSSEASHLDVSASSRLTAWPEQSSSSASTSQEGPRPAAAQAAGEAMVGASRPPPKPLRPRQLQEVGRQSSSDSGIATGSHSSYSSSLSSYAGSSLDVWRATDELGSLLSLPAAGAPEPSLCTCLPGTVEYQVPTSLRAHYDTPRSLCLAPRDHSPPSQGSPGNSAARDSGGQTSAGCPSGWLGTRRRGLVMEAPQGSEATLPGPAPGEPWEAGGPHAGPPPAFFSACPVCGGLKVNPPP

SEQ ID NO: 1300 - protein, 538 aa, unidentified
MTRECPSPAPGPGAPLSGSVLAEAAVVFAVVLSIHATVWDRYSWCAVALAVQAFYVQYKWDRLLQQGSAVFQFRMSANSGLLPASMVMPLLGLVMKERCQTAGNPFFERFGIVVAATGMAVALFSSVLALGITRPVPTNTCVILGLAGGVIIYIMKHSLSVGEVIEVLEVLLIFVYLNMILLYLLPRCFTPGEALLVLGGISFVLNQLIKRSLTLVESQGDPVDFFLLVVVVGMVLMGIFFSTLFVFMDSGTWASSIFFHLMTCVLSLGVVLPWLHRLIRRNPLLWLLQFLFQTDTRIYLLAYWSLLATLACLVVLYQNAKRSSSESKKHQAPTIARKYFHLIVVATYIPGIIFDRPLLYVAATVCLAVFIFLEYVRYFRIKPLGHTLRSFLSLFLDERDSGPLILTHIYLLLGMSLPIWLIPRPCTQKGSLGGARALVPYAGVLAVGVGDTVASIFGSTMGEIRWPGTKKTFEGTMTSIFAQIISVALILIFDSGVDLNYSYAWILGSISTVSLLEAYTTQIDNLLLPLYLLILLMA

SEQ ID NO: 1301 - protein, 238 aa, unidentified
MAADGQCSLPASWRPVTLTHVEYPAGDLSGHLLAYLSLSPVFVIVGFVTLIIFKRELHTISFLGGLALNEGVNWLIKNVIQEPRPCGGPHTAVGTKYGMPSSHSQFMWFFSVYSFLFLYLRMHQTNNARFLDLLWRHVLSLGLLAVAFLVSYSRVYLLYHTWSQVLYGGIAGGLMAIAWFIFTQEVLTPLFPRIAAWPVSEFFLIRDTSLIPNVLWFEYTVTRAEARNRQRKLGTKLQ

SEQ ID NO: 1302 - protein, 566 aa, unidentified
MALSVPGYSPGFRKPPEVVRLRRKRARSRGAAASPPRELTEPAARRAALVAGLPLRPFPAAGGRGGGSGGGPAAARRNPFARLDNRPRVAAEPPDGPAREQPEAPVPFLDSNQENDLLWEEKFPERTTVTELPQTSHVSFSEPDIPSSKSTELPVDWSIKTRLLFTSSQPFTWADHLKAQEEAQGLVQHCRATEVTLPKSIQDPKLSSELRCTFQQSLIYWLHPALSWLPLFPRIGADRKMAGKTSPWSNDATLQHVLMSDWSVSFTSLYNLLKTKLCPYFYVCTYQFTVLFRAAGLAGSDLITALISPTTRGLREAMRNEGIEFSLPLIKESGHKKETASGTSLGYGEEQAISDEDEEESFSWLEEMGVQDKIKKPDILSIKLRKEKHEVQMDHRPESVVLVKGINTFTLLNFLINSKSLVATSGPQAGLPPTLLSPVAFRGATMQMLKARSVNVKTQALSGYRDQFSLEITGPIMPHSLHSLTMLLKSSQSGSFSAVLYPHEPTAVFNICLQMDKVLDMEVVHKELTNCGLHPNTLEQLSQIPLLGKSSLRNVVLRDYIYNWRS

SEQ ID NO: 1303 - protein, 2465 aa, unidentified
MNTEELELLSDSKYRNYVAAIDKALKNFEYSSEWADLISALGKLNKVLQNNAKYQVVPKKLTIGKRLAQCLHPALPGGVHRKALETYEIIFKIIGPKRLAKDLFLYSSGLFPLLANAAMSVKPTLLSLYEIYYLPLGKTLKPGLQGLLTGILPGLEEGSEYYERTNMLLEKVAAAVDQSAFYSALWGSLLTSPAVRLPGITYVLAHLNRKLSMEDQLYIIGSDIELMVEAVSTSVQDSSVLVQRSTLDLILFCFPFHMSQATRPDMIRILSAALHVVLRRDMSLNRRLYAWLLGFDNNGAIIGPRSTRHSNPEEHATYYFTTFSKELLVQAMVGILQVNGFGEENTLMQDLKPFRILISLLDKPELGPVILEDVLIEVFRTLYSQCKAELDLQTEPPFSKDHAQLSSKLRENKKTAELIKTANLLFNSFEPYYMWDYVARWFEECCRRTLHVRLQIGPGDSNDSSELQLTNFCLLVDFLLDIVSLPTRSMRVLCQETYIEIQTEHLPQLLLRMISALTSHLQTLHLSELTDSLRLCSKILSKVQPPLLSASTGGVLQFPSGQNNSVKEWEDKKVSSVSHENPTEVFEDGENPPSSRSSESGFTEFIQYQADRTDDIDRELSEGQGAAAIPIGSTSSETETASTVGSEETIIQTPSVVTQGTATRSRKTAQKTAMQCCLEYVQQFLTRLINLYIIQNNSFSQSLATEHQGDLGREQGETSKWDRNSQGDVKEKNISKQKTSKEYLSAFLAACQLFLECSSFPVYIAEGNHTSELRSEKLETDCEHVQPPQWLQTLMNACSQASDFSVQSVAISLVMDLVGLTQSVAMVTGENINSVEPAQPLSPNQGRVAVVIRPPLTQGNLRYIAEKTEFFKHVALTLWDQLGDGTPQHHQKSVELFYQLHNLVPSSSICEDVISQQLTHKDKKIRMEAHAKFAVLWHLTRDLHINKSSSFVRSFDRSLFIMLDSLNSLDGSTSSVGQAWLNQVLQRHDIARVLEPLLLLLLHPKTQRVSVQRVQAERYWNKSPCYPGEESDKHFMQNFACSNVSQVQLITSKGNGEKPLTMDEIENFSLTVNPLSDRLSLLSTSSETIPMVVSDFDLPDQQIEILQSSDSGCSQSSAGDNLSYEVDPETVNAQEDSQMPKESSPDDDVQQVVFDLICKVVSGLEVESASVTSQLEIEAMPPKCSDIDPDEETIKIEDDSIQQSQNALLSNESSQFLSVSAEGGHECVANGISRNSSSPCISGTTHTLHDSSVASIETKSRQRSHSSIQFSFKEKLSEKVSEKETIVKESGKQPGAKPKVKLARKKDDDKKKSSNEKLKQTSVFFSDGLDLENWYSCGEGDISEIESDMGSPGSRKSPNFNIHPLYQHVLLYLQLYDSSRTLYAFSAIKAILKTNPIAFVNAISTTSVNNAYTPQLSLLQNLLARHRISVMGKDFYSHIPVDSNHNFRSSMYIEILISLCLYYMRSHYPTHVKVTAQDLIGNRNMQMMSIEILTLLFTELAKVIESSAKGFPSFISDMLSKCKVQKVILHCLLSSIFSAQKWHSEKMAGKNLVAVEEGFSEDSLINFSEDEFDNGSTLQSQLLKVLQRLIVLEHRVMTIPEENETGFDFVVSDLEHISPHQPMTSLQYLHAQPITCQGMFLCAVIRALHQHCACKMHPQWIGLITSTLPYMGKVLQRVVVSVTLQLCRNLDNLIQQYKYETGLSDSRPLWMASIIPPDMILTLLEGITAIIHYCLLDPTTQYHQLLVSVDQKHLFEARSGILSILHMIMSSVTLLWSILHQADSSEKMTIAASASLTTINLGATKNLRQQILELLGPISMNHGVHFMAAIAFVWNERRQNKTTTRTKVIPAASEEQLLLVELVRSISVMRAETVIQTVKEVLKQPPAIAKDKKHLSLEVCMLQFFYAYIQRIPVPNLVDSWASLLILLKDSIQLSLPAPGQFLILGVLNEFIMKNPSLENKKDQRDLQDVTHKIVDAIGAIAGSSLEQTTWLRRNLEVKPSPKIMVDGTNLESDVEDMLSPAMETANITPSVYSVHALTLLSEVLAHLLDMVFYSDEKERVIPLLVNIMHYVVPYLRNHSAHNAPSYRACVQLLSSLSGYQYTRRAWKKEAFDLFMDPSFFQMDASCVNHWRAIMDNLMTHDKTTFRDLMTRVAVAQSSSLNLFANRDVELEQRAMLLKRLAFAIFSSEIDQYQKYLPDIQERLVESLRLPQVPTLHSQVFLFFRVLLLRMSPQHLTSLWPTMITELVQVFLLMEQELTADEDISRTSGPSVAGLETTYTGGNGFSTSYNSQRWLNLYLSACKFLDLALALPSENLPQFQMYRWAFIPEASDDSGLEVRRQGIHQREFKPYVVRLAKLLRKRAKKNPEEDNSGRTLGWEPGHLLLTICTVRSMEQLLPFFNVLSQVFNSKVTSRCGGHSGSPILYSNAFPNKDMKLENHKPCSSKARQKIEEMVEKDFLEGMIKT

SEQ ID NO: 1304 - protein, 408 aa, unidentified
MWAFSELPMPLLINLIVSLLGFVATVTLIPAFRGHFIAARLCGQDLNKTSRQQIPESQGVISGAVFLIILFCFIPFPFLNCFVKEQCKAFPHHEFVALIGALLAICCMIFLGFADDVLNLRWRHKLLLPTAASLPLLMVYFTNFGNTTIVVPKPFRPILGLHLDLGILYYVYMGLLAVFCTNAINILAGINGLEAGQSLVISASIIVFNLVELEGDCRDDHVFSLYFMIPFFFTTLGLLYHNWYPSRVFVGDTFCYFAGMTFAVVGILGHFSKTMLLFFMPQVFNFLYSLPQLLHIIPCPRHRIPRLNIKTGKLEMSYSKFKTKSLSFLGTFILKVAESLQLVTVHQSETEDGEFTECNNMTLINLLLKVLGPIHERNLTLLLLLLQILGSAITFSIRYQLVRLFYDV

SEQ ID NO: 1305 - protein, 517 aa, unidentified
MAQPVHSLCSAFGLQCCLLFLLASWGAGATTFQEYQKTGELSTSDHIFPLTPGLVYSIPFDHIVLHSGQRPPELPKSTEIHEQKRHCNTTRHSKPTDKPTGNSKTIDHKSSTDNHEAPPTSEENSSNQGKDPMIRNQRSVDPADSTTTHKESAGKKHITPAPKSKINCRKSTTGKSTVTRKSDKTGRPLEKSMSTLDKTSTSSHKTTTSFHNSGNSQTKQKSTSFPEKITAASKTTYKTTGTPEESEKTEDSRTTVASDKLLTKTTKNIQETISANELTQSLAEPTEHGGRTANENNTPSPAEPTENRERTANENKKTICTKGKNTPVPEKPTENLGNTTLTTETIKAPVKSTENPEKTAAVTKTIKPSVKVTGDKSLTTTSSHLNKTEVTHQVPTGSFTLITSRTKLSSITSEATGNESHPYLNKDGSQKGIHAGQMGENDSFPAWAIVIVVLVAVILLLVFLGLIFLVSYMMRTRRTLTQNTQYNDAEDEGGPNSYPVYLMEQQNLGMGQIPSPR

SEQ ID NO: 1306 - protein, 486 aa, unidentified
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGMMVDLSHVSDAVARRALEVSQAPVIFSHSAARGVCNSARNVPDDILQLLKKNGGVVMVSLSMGVIQCNPSANVSTVADHFDHIKAVIGSKFIGIGGDYDGAGKFPQGLEDVSTYPVLIEELLSRGWSEEELQGVLRGNLLRVFRQVEKVQEENKWQSPLEDKFPDEQLSSSCHSDLSRLRQRQSLTSGQELTEIPIHWTAKLPAKWSVSESSPHMAPVLAVVATFPVLILWL

SEQ ID NO: 1307 - protein, 84 aa, unidentified
MATGTDQVVGLGLVAVSLIIFTYYTAWVILLPFIDSQHVIHKYFLPRAYAVAIPLAAGLLLLLFVGLFISYVMLKTKRVTKKAQ

SEQ ID NO: 1308 - protein, 92 aa, unidentified
MTKLAQWLWGLAILGSTWVALTTGALGLELPLSCQEVLWPLPAYLLVSAGCYALGTVGYRVATFHDCEDAARELQSQIQEARADLARRGLRF

SEQ ID NO: 1309 - protein, 796 aa, unidentified
MNQTASVSHHIKCQPSKTIKELGSNSPPQRNWKGIAIALLVILVVCSLITMSVILLTPDELTNSSETRLSLEDLFRKDFVLHDPEARWINDTDVVYKSENGHVIKLNIETNATTLLLENTTFVTFKASRHSVSPDLKYVLLAYDVKQIFHYSYTASYVIYNIHTREVWELNPPEVEDSVLQYAAWGVQGQQLIYIFENNIYYQPDIKSSSLRLTSSGKEEIIFNGIADWLYEEELLHSHIAHWWSPDGERLAFLMINDSLVPTMVIPRFTGALYPKGKQYPYPKAGQVNPTIKLYVVNLYGPTHTLELMPPDSFKSREYYITMVKWVSNTKTVVRWLNRAQNISILTVCETTTGACSKKYEMTSDTWLSQQNEEPVFSRDGSKFFMTVPVKQGGRGEFHHVAMFLIQSKSEQITVRHLTSGNWEVIKILAYDETTQKIYFLSTESSPRGRQLYSASTEGLLNRQCISCNFMKEQCTYFDASFSPMNQHFLLFCEGPRVPVVSLHSTDNPAKYFILESNSMLKEAILKKKIGKPEIKILHIDDYELPLQLSLPKDFMDRNQYALLLIMDEEPGGQLVTDKFHIDWDSVLIDMDNVIVARFDGRGSGFQGLKILQEIHRRLGSVEVKDQITAVKFLLKLPYIDSKRLSIFGKGYGGYIASMILKSDEKLFKCGSVVAPITDLKLYASAFSERYLGMPSKEESTYQAASVLHNVHGLKEENILIIHGTADTKVHFQHSAELIKHLIKAGVNYTMQVYPDEGHNVSEKSKYHLYSTILKFFSDCLKEEISVLPQEPEEDE

SEQ ID NO: 1310 - protein, 766 aa, unidentified
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVPYPKAGAVNPTVKFFVVNTDSLSSVTNATSIQITAPASMLIGDHYLCDVTWATQERISLQWLRRIQNYSVMDICDYDESSGRWNCLVARQHIEMSTTGWVGRFRPSEPHFTLDGNSFYKIISNEEGYRHICYFQIDKKDCTFITKGTWEVIGIEALTSDYLYYISNEYKGMPGGRNLYKIQLSDYTKVTCLSCELNPERCQYYSVSFSKEAKYYQLRCSGPGLPLYTLHSSVNDKGLRVLEDNSALDKMLQNVQMPSKKLDFIILNETKFWYQMILPPHFDKSKKYPLLLDVYAGPCSQKADTVFRLNWATYLASTENIIVASFDGRGSGYQGDKIMHAINRRLGTFEVEDQIEAARQFSKMGFVDNKRIAIWGWSYGGYVTSMVLGSGSGVFKCGIAVAPVSRWEYYDSVYTERYMGLPTPEDNLDHYRNSTVMSRAENFKQVEYLLIHGTADDNVHFQQSAQISKALVDVGVDFQAMWYTDEDHGIASSTAHQHIYTHMSHFIKQCFSLP

SEQ ID NO: 1311 - protein, 865 aa, unidentified
MASLYQRFTGKINTSRSFPAPPEASHLLGGQGPEEDGGAGAKPLGPRAQAAAPRERGGGGGGAGGRPRFQYQARSDGDEEDELVGSNPPQRNWKGIAIALLVILVICSLIVTSVILLTPAEDNSLSQKKKVTVEDLFSEDFKIHDPEAKWISDTEFIYREQKGTVRLWNVETNTSTVLIEGKKIESLRAIRYEISPDREYALFSYNVEPIYQHSYTGYYVLSKIPHGDPQSLDPPEVSNAKLQYAGWGPKGQQLIFIFENNIYYCAHVGKQAIRVVSTGKEGVIYNGLSDWLYEEEILKTHIAHWWSPDGTRLAYAAINDSRVPIMELPTYTGSIYPTVKPYHYPKAGSENPSISLHVIGLNGPTHDLEMMPPDDPRMREYYITMVKWATSTKVAVTWLNRAQNVSILTLCDATTGVCTKKHEDESEAWLHRQNEEPVFSKDGRKFFFIRAIPQGGRGKFYHITVSSSQPNSSNDNIQSITSGDWDVTKILAYDEKGNKIYFLSTEDLPRRRQLYSANTVGNFNRQCLSCDLVENCTYFSASFSHSMDFFLLKCEGPGVPMVTVHNTTDKKKMFDLETNEHVKKAINDRQMPKVEYRDIEIDDYNLPMQILKPATFTDTTHYPLLLVVDGTPGSQSVAEKFEVSWETVMVSSHGAVVVKCDGRGSGFQGTKLLHEVRRRLGLLEEKDQMEAVRTMLKEQYIDRTRVAVFGKDYGGYLSTYILPAKGENQGQTFTCGSALSPITDFKLYASAFSERYLGLHGLDNRAYEMTKVAHRVSALEEQQFLIIHPTADEKIHFQHTAELITQLIRGKANYSLQIYPDESHYFTSSSLKQHLYRSIINFFVECFRIQDKLLTVTAKEDEEED

SEQ ID NO: 1312 - protein, 675 aa, unidentified
MEGRPPPEGRPPPRPRTGRAPRGRRRAVFAAVLHWSHITHLFENDRHFSHLSTLEREMAFRTEMGLYYSYFKTIVEAPSFLNGVWMIMNDKLTEYPLVINTLKRFNLYPEVILASWYRIYTKIMDLIGIQTKICWTVTRGEGLSPIESCEGLGDPACFYVAVIFILNGLMMALFFIYGTYLSGSRLGGLVTVLCFFFNHGECTRVMWTPPLRESFSYPFLVLQMLLVTHILRATKLYRGSLIALCISNVFFMLPWQFAQFVLLTQIASLFAVYVVGYIDICKLRKIIYIHMISLALCFVLMFGNSMLLTSYYASSLVIIWGILAMKPHFLKINVSELSLWVIQGCFWLFGTVILKYLTSKIFGIADDAHIGNLLTSKFFSYKDFDTLLYTCAAEFDFMEKETPLRYTKTLLLPVVLVVFVAIVRKIISDMWGVLAKQQTHVRKHQFDHGELVYHALQLLAYTALGILIMRLKLFLTPHMCVMASLICSRQLFGWLFCKVHPGAIVFAILAAMSIQGSANLQTQWNIVGEFSNLPQEELIEWIKYSTKPDAVFAGAMPTMASVKLSALRPIVNHPHYEDAGLRARTKIVYSMYSRKAAEEVKRELIKLKVNYYILEESWCVRRSKPGCSMPEIWDVEDPANAGKTPLCNLLVKDSKPHFTTVFQNSVYKVLEVVKE

SEQ ID NO: 1313 - protein, 758 aa, unidentified
MRKQGVSSKRLQSSGRSQSKGRRGASLAREPEVEEEMEKSALGGGKLPRGSWRSSPGRIQSLKERKGLELEVVAKTFLLGPFQFVRNSLAQLREKVQELQARRFSSRTTLGIAVFVAILHWLHLVTLFENDRHFSHLSSLEREMTFRTEMGLYYSYFKTIIEAPSFLEGLWMIMNDRLTEYPLIINAIKRFHLYPEVIIASWYCTFMGIMNLFGLETKTCWNVTRIEPLNEVQSCEGLGDPACFYVGVIFILNGLMMGLFFMYGAYLSGTQLGGLITVLCFFFNHGEATRVMWTPPLRESFSYPFLVLQMCILTLILRTSSNDRRPFIALCLSNVAFMLPWQFAQFILFTQIASLFPMYVVGYIEPSKFQKIIYMNMISVTLSFILMFGNSMYLSSYYSSSLLMTWAIILKRNEIQKLGVSKLNFWLIQGSAWWCGTIILKFLTSKILGVSDHIRLSDLIAARILRYTDFDTLIYTCAPEFDFMEKATPLRYTKTLLLPVVMVITCFIFKKTVRDISYVLATNIYLRKQLLEHSELAFHTLQLLVFTALAILIMRLKMFLTPHMCVMASLICSRQLFGWLFRRVRFEKVIFGILTVMSIQGYANLRNQWSIIGEFNNLPQEELLQWIKYSTTSDAVFAGAMPTMASIKLSTLHPIVNHPHYEDADLRARTKIVYSTYSRKSAKEVRDKLLELHVNYYVLEEAWCVVRTKPGCSMLEIWDVEDPSNAANPPLCSVLLEDARPYFTTVFQNSVYRVLKVN

SEQ ID NO: 1314 - protein, 716 aa, unidentified
MMSIRQRREIRATEVSEDFPAQEENVKLENKLPSGCTSRRLWKILSLTIGGTIALCIGLLTSVYLATLHENDLWFSNIKEVEREISFRTECGLYYSYYKQMLQAPTLVQGFHGLIYDNKTESMKTINLLQRMNIYQEVFLSILYRVLPIQKYLEPVYFYIYTLFGLQAIYVTALYITSWLLSGTWLSGLLAAFWYVTNRIDTTRVEFTIPLRENWALPFFAIQIAAITYFLRPNLQPLSERLTLLAIFISTFLFSLTWQFNQFMMLMQALVLFTLDSLDMLPAVKATWLYGIQITSLLLVCILQFFNSMILGSLLISFNLSVFIARKLQKNLKTGSFLNRLGKLLLHLFMVLCLTLFLNNIIKKILNLKSDEHIFKFLKAKFGLGATRDFDANLYLCEEAFGLLPFNTFGRLSDTLLFYAYIFVLSITVIVAFVVAFHNLSDSTNQQSVGKMEKGTVDLKPETAYNLIHTILFGFLALSTMRMKYLWTSHMCVFASFGLCSPEIWELLLKSVHLYNPKRICIMRYSVPILILLYLCYKFWPGMMDELSELREFYDPDTVELMNWINSNTPRKAVFAGSMQLLAGVKLCTGRTLTNHPHYEDSSLRERTRAVYQIYAKRAPEEVHALLRSFGTDYVILEDSICYERRHRRGCRLRDLLDIANGHMMDGPGENDPDLKPADHPRFCEEIKRNLPPYVAYFTRVFQNKTFHVYKLSRNK

SEQ ID NO: 1315 - protein, 723 aa, unidentified
MAEEEGPPVELRQRKKPKSSENKESAKEEKISDIPIPERAPKHVLFQRFAKIFIGCLAAVTSGMMYALYLSAYHERKFWFSNRQELEREITFQGDSAIYYSYYKDMLKAPSFERGVYELTHNNKTVSLKTINAVQQMSLYPELIASILYQATGSNEIIEPVYFYIGIVFGLQGIYVTALFVTSWLMSGTWLAGMLTVAWFVINRVDTTRIEYSIPLRENWALPYFACQIAALTGYLKSNLNTYGERFCYLLMSASTYTFMMMWEYSHYLLFLQAISLFLLDTFSVEQSDKVYEVYKIYIFSLFLGYLLQFENPALLVSPLLSLVAALMLAKCLQLNVKKGSFVAKIIKVINFYLVCTLTITLNIIMKMFVPHKENGHMLKFLEVKFGLNMTKNFTMNWLLCQESLQAPSQDFFLRLTQSSLLPFYILVLIICFLSMLQVIFRRINGKSLKETVTLEDGRIGERPEIIYHVIHTILLGSLAMVIEGLKYIWIPYVCMLAAFGVCSPELWMTLFKWLRLRTVHPILLALILSMAVPTIIGLSLWKEFFPRLMTELMELQEFYDPDTVELMTWIKRQAPVAAVFAGSPQLMGAIKLCTGWMVTSLPLYNDDDLLKRNENIYQIYSKRSAEDIYKILTSYKANYLIVEDAICNEVGPMRGCRVKDLLDIANGHMVCEEGDKLTYSKYGRFCHEVKINYSPYVNYFTRVYWNRSYFVYKINTVISFQS

SEQ ID NO: 1316 - protein, 238 aa, unidentified
MLCFLRGMAFVPFLLVTWSSAAFIISYVVAVLSGHVNPFLPYISDTGTTPPESGIFGFMINFSAFLGAATMYTRYKIVQKQNQTCYFSTPVFNLVSLVLGLVGCFGMGIVANFQELAVPVVHDGGALLAFVCGVVYTLLQSIISYKSCPQWNSLSTCHIRMVISAVSCAAVIPMIVCASLISITKLEWNPREKDYVYHVVSAICEWTVAFGFIFYFLTFIQDFQSVTLRISTEINGDI

SEQ ID NO: 1317 - protein, 266 aa, unidentified
MWWFQQGLSFLPSALVIWTSAAFIFSYITAVTLHHIDPALPYISDTGTVAPEKCLFGAMLNIAAVLCIATIYVRYKQVHALSPEENVIIKLNKAGLVLGILSCLGLSIVANFQKTTLFAAHVSGAVLTFGMGSLYMFVQTILSYQMQPKIHGKQVFWIRLLLVIWCGVSALSMLTCSSVLHSGNFGTDLEQKLHWNPEDKGYVLHMITTAAEWSMSFSFFGFFLTYIRDFQKISLRVEANLHGLTLYDTAPCPINNERTRLLSRDI

SEQ ID NO: 1318 - protein, 446 aa, unidentified
MRTLNTSAMDGTGLVVERDFSVRILTACFLSLLILSTLLGNTLVCAAVIRFRHLRSKVTNFFVISLAVSDLLVAVLVMPWKAVAEIAGFWPFGSFCNIWVAFDIMCSTASILNLCVISVDRYWAISSPFRYERKMTPKAAFILISVAWTLSVLISFIPVQLSWHKAKPTSPSDGNATSLAETIDNCDSSLSRTYAISSSVISFYIPVAIMIVTYTRIYRIAQKQIRRIAALERAAVHAKNCQTTTGNGKPVECSQPESSFKMSFKRETKVLKTLSVIMGVFVCCWLPFFILNCILPFCGSGETQPFCIDSNTFDVFVWFGWANSSLNPIIYAFNADFRKAFSTLLGCYRLCPATNNAIETVSINNNGAAMFSSHHEPRGSISKECNLVYLIPHAVGSSEDLKKEEAAGIARPLEKLSPALSVILDYDTDVSLEKIQPITQNGQHPT

SEQ ID NO: 1319 - protein, 443 aa, unidentified
MDPLNLSWYDDDLERQNWSRPFNGSDGKADRPHYNYYATLLTLLIAVIVFGNVLVCMAVSREKALQTTTNYLIVSLAVADLLVATLVMPWVVYLEVVGEWKFSRIHCDIFVTLDVMMCTASILNLCAISIDRYTAVAMPMLYNTRYSSKRRVTVMISIVWVLSFTISCPLLFGLNNADQNECIIANPAFVVYSSIVSFYVPFIVTLLVYIKIYIVLRRRRKRVNTKRSSRAFRAHLRAPLKGNCTHPEDMKLCTVIMKSNGSFPVNRRRVEAARRAQELEMEMLSSTSPPERTRYSPIPPSHHQLTLPDPSHHGLHSTPDSPAKPEKNGHAKDHPKIAKIFEIQTMPNGKTRTSLKTMSRRKLSQQKEKKATQMLAIVLGVFIICWLPFFITHILNIHCDCNIPPVLYSAFTWLGYVNSAVNPIIYTTFNIEFRKAFLKILHC

SEQ ID NO: 1320 - protein, 400 aa, unidentified
MASLSQLSSHLNYTCGAENSTGASQARPHAYYALSYCALILAIVFGNGLVCMAVLKERALQTTTNYLVVSLAVADLLVATLVMPWVVYLEVTGGVWNFSRICCDVFVTLDVMMCTASILNLCAISIDRYTAVVMPVHYQHGTGQSSCRRVALMITAVWVLAFAVSCPLLFGFNTTGDPTVCSISNPDFVIYSSVVSFYLPFGVTVLVYARIYVVLKQRRRKRILTRQNSQCNSVRPGFPQQTLSPDPAHLELKRYYSICQDTALGGPGFQERGGELKREEKTRNSLSPTIAPKLSLEVRKLSNGRLSTSLKLGPLQPRGVPLREKKATQMVAIVLGAFIVCWLPFFLTHVLNTHCQTCHVSPELYSATTWLGYVNSALNPVIYTTFNIEFRKAFLKILSC

SEQ ID NO: 1321 - protein, 419 aa, unidentified
MGNRSTADADGLLAGRGPAAGASAGASAGLAGQGAAALVGGVLLIGAVLAGNSLVCVSVATERALQTPTNSFIVSLAAADLLLALLVLPLFVYSEVQGGAWLLSPRLCDALMAMDVMLCTASIFNLCAISVDRFVAVAVPLRYNRQGGSRRQLLLIGATWLLSAAVAAPVLCGLNDVRGRDPAVCRLEDRDYVVYSSVCSFFLPCPLMLLLYWATFRGLQRWEVARRAKLHGRAPRRPSGPGPPSPTPPAPRLPQDPCGPDCAPPAPGLPRGPCGPDCAPAAPSLPQDPCGPDCAPPAPGLPPDPCGSNCAPPDAVRAAALPPQTPPQTRRRRRAKITGRERKAMRVLPVVVGAFLLCWTPFFVVHITQALCPACSVPPRLVSAVTWLGYVNSALNPVIYTVFNAEFRNVFRKALRACC

SEQ ID NO: 1322 - protein, 477 aa, unidentified
MLPPGSNGTAYPGQFALYQQLAQGNAVGGSAGAPPLGPSQVVTACLLTLLIIWTLLGNVLVCAAIVRSRHLRANMTNVFIVSLAVSDLFVALLVMPWKAVAEVAGYWPFGAFCDVWVAFDIMCSTASILNLCVISVDRYWAISRPFRYKRKMTQRMALVMVGLAWTLSILISFIPVQLNWHRDQAASWGGLDLPNNLANWTPWEEDFWEPDVNAENCDSSLNRTYAISSSLISFYIPVAIMIVTYTRIYRIAQVQIRRISSLERAAEHAQSCRSSAACAPDTSLRASIKKETKVLKTLSVIMGVFVCCWLPFFILNCMVPFCSGHPEGPPAGFPCVSETTFDVFVWFGWANSSLNPVIYAFNADFQKVFAQLLGCSHFCSRTPVETVNISNELISYNQDIVFHKEIAAAYIHMMPNAVTPGNREVDNDEEEGPFDRMFQIYQTSPDGDPVAESVWELDCEGEISLDKITPFTPNGFH

SEQ ID NO: 1323 - protein, 894 aa, unidentified
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENCRSGTSVGKVTATDLDEPDTLHTRLKYKILQQIPDHPKHFSIHPDTGVITTTTPFLDREKCDTYQLIMEVRDMGGQPFGLFNTGTITISLEDENDNPPSFTETSYVTEVEENRIDVEILRMKVQDQDLPNTPHSKAVYKILQGNENGNFIISTDPNTNEGVLCVVKPLNYEVNRQVILQVGVINEAQFSKAASSQTPTMCTTTVTVKIIDSDEGPECHPPVKVIQSQDGFPAGQELLGYKALDPEISSGEGLRYQKLGDEDNWFEINQHTGDLRTLKVLDRESKFVKNNQYNISVVAVDAVGRSCTGTLVVHLDDYNDHAPQIDKEVTICQNNEDFAVLKPVDPDGPENGPPFQFFLDNSASKNWNIEEKDGKTAILRQRQNLDYNYYSVPIQIKDRHGLVATHMLTVRVCDCSTPSECRMKDKSTRDVRPNVILGRWAILAMVLGSVLLLCILFTCFCVTAKRTVKKCFPEDIAQQNLIVSNTEGPGEEVTEANIRLPMQTSNICDTSMSVGTVGGQGIKTQQSFEMVKGGYTLDSNKGGGHQTLESVKGVGQGDTGRYAYTDWQSFTQPRLGEKVYLCGQDEEHKHCEDYVCSYNYEGKGSLAGSVGCCSDRQEEEGLEFLDHLEPKFRTLAKTCIKK

SEQ ID NO: 1324 - protein, 901 aa, unidentified
MEAARPSGSWNGALCRLLLLTLAILIFASDACKNVTLHVPSKLDAEKLVGRVNLKECFTAANLIHSSDPDFQILEDGSVYTTNTILLSSEKRSFTILLSNTENQEKKKIFVFLEHQTKVLKKRHTKEKVLRRAKRRWAPIPCSMLENSLGPFPLFLQQVQSDTAQNYTIYYSIRGPGVDQEPRNLFYVERDTGNLYCTRPVDREQYESFEIIAFATTPDGYTPELPLPLIIKIEDENDNYPIFTEETYTFTIFENCRVGTTVGQVCATDKDEPDTMHTRLKYSIIGQVPPSPTLFSMHPTTGVITTTSSQLDRELIDKYQLKIKVQDMDGQYFGLQTTSTCIINIDDVNDHLPTFTRTSYVTSVEENTVDVEILRVTVEDKDLVNTANWRANYTILKGNENGNFKIVTDAKTNEGVLCVVKPLNYEEKQQMILQIGVVNEAPFSREASPRSAMSTATVTVNVEDQDEGPECNPPIQTVRMKENAEVGTTSNGYKAYDPETRSSSGIRYKKLTDPTGWVTIDENTGSIKVFRSLDREAETIKNGIYNITVLASDQGGRTCTGTLGIILQDVNDNSPFIPKKTVIICKPTMSSAEIVAVDPDEPIHGPPFDFSLESSTSEVQRMWRLKAINDTAARLSYQNDPPFGSYVVPITVRDRLGMSSVTSLDVTLCDCITENDCTHRVDPRIGGGGVQLGKWAILAILLGIALLFCILFTLVCGASGTSKQPKVIPDDLAQQNLIVSNTEAPGDDKVYSANGFTTQTVGASAQGVCGTVGSGIKNGGQETIEMVKGGHQTSESCRGAGHHHTLDSCRGGHTEVDNCRYTYSEWHSFTQPRLGEKVYLCNQDENHKHAQDYVLTYNYEGRGSVAGSVGCCSERQEEDGLEFLDNLEPKFRTLAEACMKR

SEQ ID NO: 1325 - protein, 896 aa, unidentified
MAAAGPRRSVRGAVCLHLLLTLVIFSRAGEACKKVILNVPSKLEADKIIGRVNLEECFRSADLIRSSDPDFRVLNDGSVYTARAVALSDKKRSFTIWLSDKRKQTQKEVTVLLEHQKKVSKTRHTRETVLRRAKRRWAPIPCSMQENSLGPFPLFLQQVESDAAQNYTVFYSISGRGVDKEPLNLFYIERDTGNLFCTRPVDREEYDVFDLIAYASTADGYSADLPLPLPIRVEDENDNHPVFTEAIYNFEVLESSRPGTTVGVVCATDRDEPDTMHTRLKYSILQQTPRSPGLFSVHPSTGVITTVSHYLDREVVDKYSLIMKVQDMDGQFFGLIGTSTCIITVTDSNDNAPTFRQNAYEAFVEENAFNVEILRIPIEDKDLINTANWRVNFTILKGNENGHFKISTDKETNEGVLSVVKPLNYEENRQVNLEIGVNNEAPFARDIPRVTALNRALVTVHVRDLDEGPECTPAAQYVRIKENLAVGSKINGYKAYDPENRNGNGLRYKKLHDPKGWITIDEISGSIITSKILDREVETPKNELYNITVLAIDKDDRSCTGTLAVNIEDVNDNPPEILQEYVVICKPKMGYTDILAVDPDEPVHGAPFYFSLPNTSPEISRLWSLTKVNDTAARLSYQKNAGFQEYTIPITVKDRAGQAATKLLRVNLCECTHPTQCRATSRSTGVILGKWAILAILLGIALLFSVLLTLVCGVFGATKGKRFPEDLAQQNLIISNTEAPGDDRVCSANGFMTQTTNNSSQGFCGTMGSGMKNGGQETIEMMKGGNQTLESCRGAGHHHTLDSCRGGHTEVDNCRYTYSEWHSFTQPRLGEKLHRCNQNEDRMPSQDYVLTYNYEGRGSPAGSVGCCSEKQEEDGLDFLNNLEPKFITLAEACTKR

SEQ ID NO: 1326 - protein, 2012 aa, unidentified
MWILALSLFQSFANVFSEDLHSSLYFVNASLQEVVFASTTGTLVPCPAAGIPPVTLRWYLATGEEIYDVPGIRHVHPNGTLQIFPFPPSSFSTLIHDNTYYCTAENPSGKIRSQDVHIKAVLREPYTVRVEDQKTMRGNVAVFKCIIPSSVEAYITVVSWEKDTVSLVSGSRFLITSTGALYIKDVQNEDGLYNYRCITRHRYTGETRQSNSARLFVSDPANSAPSILDGFDHRKAMAGQRVELPCKALGHPEPDYRWLKDNMPLELSGRFQKTVTGLLIENIRPSDSGSYVCEVSNRYGTAKVIGRLYVKQPLKATISPRKVKSSVGSQVSLSCSVTGTEDQELSWYRNGEILNPGKNVRITGINHENLIMDHMVKSDGGAYQCFVRKDKLSAQDYVQVVLEDGTPKIISAFSEKVVSPAEPVSLMCNVKGTPLPTITWTLDDDPILKGGSHRISQMITSEGNVVSYLNISSSQVRDGGVYRCTANNSAGVVLYQARINVRGPASIRPMKNITAIAGRDTYIHCRVIGYPYYSIKWYKNSNLLPFNHRQVAFENNGTLKLSDVQKEVDEGEYTCNVLVQPQLSTSQSVHVTVKVPPFIQPFEFPRFSIGQRVFIPCVVVSGDLPITITWQKDGRPIPGSLGVTIDNIDFTSSLRISNLSLMHNGNYTCIARNEAAAVEHQSQLIVRVPPKFVVQPRDQDGIYGKAVILNCSAEGYPVPTIVWKFSKGAGVPQFQPIALNGRIQVLSNGSLLIKHVVEEDSGYYLCKVSNDVGADVSKSMYLTVKIPAMITSYPNTTLATQGQKKEMSCTAHGEKPIIVRWEKEDRIINPEMARYLVSTKEVGEEVISTLQILPTVREDSGFFSCHAINSYGEDRGIIQLTVQEPPDPPEIEIKDVKARTITLRWTMGFDGNSPITGYDIECKNKSDSWDSAQRTKDVSPQLNSATIIDIHPSSTYSIRMYAKNRIGKSEPSNELTITADEAAPDGPPQEVHLEPISSQSIRVTWKAPKKHLQNGIIRGYQIGYREYSTGGNFQFNIISVDTSGDSEVYTLDNLNKFTQYGLVVQACNRAGTGPSSQEIITTTLEDVPSYPPENVQAIATSPESISISWSTLSKEALNGILQGFRVIYWANLMDGELGEIKNITTTQPSLELDGLEKYTNYSIQVLAFTRAGDGVRSEQIFTRTKEDVPGPPAGVKAAAASASMVFVSWLPPLKLNGIIRKYTVFCSHPYPTVISEFEASPDSFSYRIPNLSRNRQYSVWVVAVTSAGRGNSSEIITVEPLAKAPARILTFSGTVTTPWMKDIVLPCKAVGDPSPAVKWMKDSNGTPSLVTIDGRRSIFSNGSFIIRTVKAEDSGYYSCIANNNWGSDEIILNLQVQVPPDQPRLTVSKTTSSSITLSWLPGDNGGSSIRGYILQYSEDNSEQWGSFPISPSERSYRLENLKCGTWYKFTLTAQNGVGPGRISEIIEAKTLGKEPQFSKEQELFASINTTRVRLNLIGWNDGGCPITSFTLEYRPFGTTVWTTAQRTSLSKSYILYDLQEATWYELQMRVCNSAGCAEKQANFATLNYDGSTIPPLIKSVVQNEEGLTTNEGLKMLVTISCILVGVLLLFVLLLVVRRRRREQRLKRLRDAKSLAEMLMSKNTRTSDTLSKQQQTLRMHIDIPRAQLLIEERDTMETIDDRSTVLLTDADFGEAAKQKSLTVTHTVHYQSVSQATGPLVDVSDARPGTNPTTRRNAKAGPTARNRYASQWTLNRPHPTISAHTLTTDWRLPTPRAAGSVDKESDSYSVSPSQDTDRARSSMVSTESASSTYEELARAYEHAKMEEQLRHAKFTITECFISDTSSEQLTAGTNEYTDSLTSSTPSESGICRFTASPPKPQDGGRVMNMAVPKAHRPGDLIHLPPYLRMDFLLNRGGPGTSRDLSLGQACLEPQKSRTLKRPTVLEPIPMEAASSASSTREGQSWQPGAVATLPQREGAELGQAAKMSSSQESLLDSRGHLKGNNPYAKSYTLV

SEQ ID NO: 1327 - protein, 2053 aa, unidentified
MWLVTFLLLLDSLHKARPEDVGTSLYFVNDSLQQVTFSSSVGVVVPCPAAGSPSAALRWYLATGDDIYDVPHIRHVHANGTLQLYPFSPSAFNSFIHDNDYFCTAENAAGKIRSPNIRVKAVFREPYTVRVEDQRSMRGNVAVFKCLIPSSVQEYVSVVSWEKDTVSIIPEHRFFITYHGGLYISDVQKEDALSTYRCITKHKYSGETRQSNGARLSVTDPAESIPTILDGFHSQEVWAGHTVELPCTASGYPIPAIRWLKDGRPLPADSRWTKRITGLTISDLRTEDSGTYICEVTNTFGSAEATGILMVIDPLHVTLTPKKLKTGIGSTVILSCALTGSPEFTIRWYRNTELVLPDEAISIRGLSNETLLITSAQKSHSGAYQCFATRKAQTAQDFAIIALEDGTPRIVSSFSEKVVNPGEQFSLMCAAKGAPPPTVTWALDDEPIVRDGSHRTNQYTMSDGTTISHMNVTGPQIRDGGVYRCTARNLVGSAEYQARINVRGPPSIRAMRNITAVAGRDTLINCRVIGYPYYSIKWYKDALLLPDNHRQVVFENGTLKLTDVQKGMDEGEYLCSVLIQPQLSISQSVHVAVKVPPLIQPFEFPPASIGQLLYIPCVVSSGDMPIRITWRKDGQVIISGSGVTIESKEFMSSLQISSVSLKHNGNYTCIASNAAATVSRERQLIVRVPPRFVVQPNNQDGIYGKAGVLNCSVDGYPPPKVMWKHAKGSGNPQQYHPVPLTGRIQILPNSSLLIRHVLEEDIGYYLCQASNGVGTDISKSMFLTVKIPAMITSHPNTTIAIKGHAKELNCTARGERPIIIRWEKGDTVIDPDRVMRYAIATKDNGDEVVSTLKLKPADRGDSVFFSCHAINSYGEDRGLIQLTVQEPPDPPELEIREVKARSMNLRWTQRFDGNSIITGFDIEYKNKSDSWDFKQSTRNISPTINQANIVDLHPASVYSIRMYSFNKIGRSEPSKELTISTEEAAPDGPPMDVTLQPVTSQSIQVTWKAPKKELQNGVIRGYQIGYRENSPGSNGQYSIVEMKATGDSEVYTLDNLKKFAQYGVVVQAFNRAGTGPSSSEINATTLEDVPSQPPENVRALSITSDVAVISWSEPPRSTLNGVLKGYRVIFWSLYVDGEWGEMQNITTTRERVELRGMEKFTNYSVQVLAYTQAGDGVRSSVLYIQTKEDVPGPPAGIKAVPSSASSVVVSWLPPTKPNGVIRKYTIFCSSPGSGQPAPSEYETSPEQLFYRIAHLNRGQQYLLWVAAVTSAGRGNSSEKVTIEPAGKAPAKIISFGGTVTTPWMKDVRLPCNSVGDPAPAVKWTKDSEDSAIPVSMDGHRLIHTNGTLLLRAVKAEDSGYYTCTATNTGGFDTIIVNLLVQVPPDQPRLTVSKTSASSITLTWIPGDNGGSSIRGFVLQYSVDNSEEWKDVFISSSERSFKLDSLKCGTWYKVKLAAKNSVGSGRISEIIEAKTHGREPSFSKDQHLFTHINSTHARLNLQGWNNGGCPITAIVLEYRPKGTWAWQGLRANSSGEVFLTELREATWYELRMRACNSAGCGNETAQFATLDYDGSTIPPIKSAQGEGDDVKKLFTIGCPVILATLGVALLFIVRKKRKEKRLKRLRDAKSLAEMLISKNNRSFDTPVKGPPQGPRLHIDIPRVQLLIEDKEGIKQLGDDKATIPVTDAEFSQAVNPQSFCTGVSLHHPTLIQSTGPLIDMSDIRPGTNPVSRKNVKSAHSTRNRYSSQWTLTKCQASTPARTLTSDWRTVGSQHGVTVTESDSYSASLSQDTDKGRNSMVSTESASSTYEELARAYEHAKLEEQLQHAKFEITECFISDSSSDQMTTGTNENADSMTSMSTPSEPGICRFTASPPKPQDADRGKNVAVPIPHRANKSDYCNLPLYAKSEAFFRKADGREPCPVVPPREASIRNLARTYHTQARHLTLDPASKSLGLPHPGAPAAASTATLPQRTLAMPAPPAGTAPPAPGPTPAEPPTAPSAAPPAPSTEPPRAGGPHTKMGGSRDSLLEMSTSGVGRSQKQGAGAYSKSYTLV

SEQ ID NO: 1328 - protein, 958 aa, unidentified [sequence omitted]

SEQ ID NO: 1329 - protein, 1212 aa, unidentified
MALMFTGHLLFLALLMFAFSTFEESVSNYSEWAVFTDDIDQFKTQKVQDFRPNQKLKKSMLHPSLYFDAGEIQAMRQKSRASHLHLFRAIRSAVTVMLSNPTYYLPPPKHADFAAKWNEIYGNNLPPLALYCLLCPEDKVAFEFVLEYMDRMVGYKDWLVENAPGDEVPIGHSLTGFATAFDFLYNLLDNHRRQKYLEKIWVITEEMYEYSKVRSWGKQLLHNHQATNMIALLTGALVTGVDKGSKANIWKQAVVDVMEKTMFLLNHIVDGSLDEGVAYGSYTAKSVTQYVFLAQRHFNINNLDNNWLKMHFWFYYATLLPGFQRTVGIADSNYNWFYGPESQLVFLDKFILKNGAGNWLAQQIRKHRPKDGPMVPSTAQRWSTLHTEYIWYDPQLTPQPPADYGTAKIHTFPNWGVVTYGAGLPNTQTNTFVSFKSGKLGGRAVYDIVHFQPYSWIDGWRSFNPGHEHPDQNSFTFAPNGQVFVSEALYGPKLSHLNNVLVFAPSPSSQCNKPWEGQLGECAQWLKWTGEEVGDAAGEIITASQHGEMVFVSGEAVSAYSSAMRLKSVYRALLLLNSQTLLVVDHIERQEDSPINSVSAFFHNLDIDFKYIPYKFMNRYNGAMMDVWDAHYKMFWFDHHGNSPMASIQEAEQAAEFKKRWTQFVNVTFQMEPTITRIAYVFYGPYINVSSCRFIDSSNPGLQISLNVNNTEHVVSIVTDYHNLKTRFNYLGFGGFASVADQGQITRFGLGTQAIVKPVRHDRIIFPFGFKFNIAVGLILCISLVILTFQWRFYLSFRKLMRWILILVIALWFIELLDVWSTCSQPICAKWTRTEAEGSKKSLSSEGHHMDLPDVVITSLPGSGAEILKQLFFNSSDFLYIRVPTAYIDIPETELEIDSFVDACEWKVSDIRSGHFRLLRGWLQSLVQDTKLHLQNIHLHEPNRGKLAQYFAMNKDKKRKFKRRESLPEQRSQMKGAFDRDAEYIRALRRHLVYYPSARPVLSLSSGSWTLKLHFFQEVLGASMRALYIVRDPRAWIYSMLYNSKPSLYSLKNVPEHLAKLFKIEGGKGKCNLNSGYAFEYEPLRKELSKSKSNAVSLLSHLWLANTAAALRINTDLLPTSYQLVKFEDIVHFPQKTTERIFAFLGIPLSPASLNQILFATSTNLFYLPYEGEISPTNTNVWKQNLPRDEIKLIENICWTLMDRLGYPKFMD

SEQ ID NO: 1330 - protein, 1049 aa, unidentified
MDWSFFRVVAMLFIFLVVVEVNSEFRIQVRDYNTKNGTIKWHSIRRQKREWIKFAAACREGEDNSKRNPIAKIHSDCAANQQVTYRISGVGIDQPPYGIFVINQKTGEINITSIVDREVTPFFIIYCRALNSMGQDLERPLELRVRVLDINDNPPVFSMATFAGQIEENSNANTLVMILNATDADEPNNLNSKIAFKIIRQEPSDSPMFIINRNTGEIRTMNNFLDREQYGQYALAVRGSDRDGGADGMSAECECNIKILDVNDNIPYMEQSSYTIEIQENTLNSNLLEIRVIDLDEEFSANWMAVIFFISGNEGNWFEIEMNERTNVGILKVVKPLDYEAMQSLQLSIGVRNKAEFHHSIMSQYKLKASAISVTVLNVIEGPVFRPGSKTYVVTGNMGSNDKVGDFVATDLDTGRPSTTVRYVMGNNPADLLAVDSRTGKLTLKNKVTKEQYNMLGGKYQGTILSIDDNLQRTCTGTININIQSFGNDDRTNTEPNTKITTNTGRQESTSSTNYDTSTTSTDSSQVYSSEPGNGAKDLLSDNVHFGPAGIGLLIMGFLVLGLVPFLMICCDCGGAPRSAAGFEPVPECSDGAIHSWAVEGPQPEPRDITTVIPQIPPDNANIIECIDNSGVYTNEYGGREMQDLGGGERMTGFELTEGVKTSGMPEICQEYSGTLRRNSMRECREGGLNMNFMESYFCQKAYAYADEDEGRPSNDCLLIYDIEGVGSPAGSVGCCSFIGEDLDDSFLDTLGPKFKKLADISLGKESYPDLDPSWPPQSTEPVCLPQETEPVVSGHPPISPHFGTTTVISESTYPSGPGVLHPKPILDPLGYGNVTVTESYTTSDTLKPSVHVHDNRPASNVVVTERVVGPISGADLHGMLEMPDLRDGSNVIVTERVIAPSSSLPTSLTIHHPRESSNVVVTERVIQPTSGMIGSLSMHPELANAHNVIVTERVVSGAGVTGISGTTGISGGIGSSGLVGTSMGAGSGALSGAGISGGGIGLSSLGGTASIGHMRSSSDHHFNQTIGSASPSTARSRITKYSTVQYSK

SEQ ID NO: 1331 - protein, 1118 aa, unidentified
MARSPGRAYALLLLLICFNVGSGLHLQVLSTRNENKLLPKHPHLVRQKRAWITAPVALREGEDLSKKNPIAKIHSDLAEERGLKITYKYTGKGITEPPFGIFVFNKDTGELNVTSILDREETPFFLLTGYALDARGNNVEKPLELRIKVLDINDNEPVFTQDVFVGSVEELSAAHTLVMKINATDADEPNTLNSKISYRIVSLEPAYPPVFYLNKDTGEIYTTSVTLDREEHSSYTLTVEARDGNGEVTDKPVKQAQVQIRILDVNDNIPVVENKVLEGMVEENQVNVEVTRIKVFDADEIGSDNWLANFTFASGNEGGYFHIETDAQTNEGIVTLIKEVDYEEMKNLDFSVIVANKAAFHKSIRSKYKPTPIPIKVKVKNVKEGIHFKSSVISIYVSESMDRSSKGQIIGNFQAFDEDTGLPAHARYVKLEDRDNWISVDSVTSEIKLAKLPDFESRYVQNGTYTVKIVAISEDYPRKTITGTVLINVEDINDNCPTLIEPVQTICHDAEYVNVTAEDLDGHPNSGPFSFSVIDKPPGMAEKWKIARQESTSVLLQQSEKKLGRSEIQFLISDNQGFSCPEKQVLTLTVCECLHGSGCREAQHDSYVGLGPAAIALMILAFLLLLLVPLLLLMCHCGKGAKGFTPIPGTIEMLHPWNNEGAPPEDKVVPSFLPVDQGGSLVGRNGVGGMAKEATMKGSSSASIVKGQHEMSEMDGRWEEHRSLLSGRATQFTGATGAIMTTETTKTARATGASRDMAGAQAAAVALNEEFLRNYFTDKAASYTEEDENHTAKDCLLVYSQEETESLNASIGCCSFIEGELDDRFLDDLGLKFKTLAEVCLGQKIDINKEIEQRQKPATETSMNTASHSLCEQTMVNSENTYSSGSSFPVPKSLQEANAEKVTQEIVTERSVSSRQAQKVATPLPDPMASRNVIATETSYVTGSTMPPTTVILGPSQPQSLIVTERVYAPASTLVDQPYANEGTVVVTERVIQPHGGGSNPLEGTQHLQDVPYVMVRERESFLAPSSGVQPTLAMPNIAVGQNVTVTERVLAPASTLQSSYQIPTENSMTARNTTVSGAGVPGPLPDFGLEESGHSNSTITTSSTRVTKHSTVQHSYS

SEQ ID NO: 1332 - protein, 999 aa, unidentified
MMGLFPRTTGALAIFVVVILVHGELRIETKGQYDEEEMTMQQAKRRQKREWVKFAKPCREGEDNSKRNPIAKITSDYQATQKITYRISGVGIDQPPFGIFVVDKNTGDINITAIVDREETPSFLITCRALNAQGLDVEKPLILTVKILDINDNPPVFSQQIFMGEIEENSASNSLVMILNATDADEPNHLNSKIAFKIVSQEPAGTPMFLLSRNTGEVRTLTNSLDREQASSYRLVVSGADKDGEGLSTQCECNIKVKDVNDNFPMFRDSQYSARIEENILSSELLRFQVTDLDEEYTDNWLAVYFFTSGNEGNWFEIQTDPRTNEGILKVVKALDYEQLQSVKLSIAVKNKAEFHQSVISRYRVQSTPVTIQVINVREGIAFRPASKTFTVQKGISSKKLVDYILGTYQAIDEDTNKAASNVKYVMGRNDGGYLMIDSKTAEIKFVKNMNRDSTFIVNKTITAEVLAIDEYTGKTSTGTVYVRVPDFNDNCPTAVLEKDAVCSSSPSVVVSARTLNNRYTGPYTFALEDQPVKLPAVWSITTLNATSALLRAQEQIPPGVYHISLVLTDSQNNRCEMPRSLTLEVCQCDNRGICGTSYPTTSPGTRYGRPHSGRLGPAAIGLLLLGLLLLLLAPLLLLTCDCGAGSTGGVTGGFIPVPDGSEGTIHQWGIEGAHPEDKEITNICVPPVTANGADFMESSEVCTNTYARGTAVEGTSGMEMTTKLGAATESGGAAGFATGTVSGAASGFGAATGVGICSSGQSGTMRTRHSTGGTNKDYADGAISMNFLDSYFSQKAFACAEEDDGQEANDCLLIYDNEGADATGSPVGSVGCCSFIADDLDDSFLDSLGPKFKKLAEISLGVDGEGKEVQPPSKDSGYGIESCGHPIEVQQTGFVKCQTLSGSQGASALSTSGSVQPAVSIPDPLQHGNYLVTETYSASGSLVQPSTAGFDPLLTQNVIVTERVICPISSVPGNLAGPTQLRGSHTMLCTEDPCSRLI

SEQ ID NO: 1333 - protein, 1040 aa, unidentified
MDWLFFRNICLLIILMVVMEVNSEFIVEVKEFDIENGTTKWQTVRRQKREWIKFAAACREGEDNSKRNPIAKIRSDCESNQKITYRISGVGIDRPPYGVFTINPRTGEINITSVVDREITPLFLIYCRALNSRGEDLERPLELRVKVMDINDNAPVFSQSVYTASIEENSDANTLVVKLCATDADEENHLNSKIAYKIVSQEPSGAPMFILNRYTGEVCTMSSFLDREQHSMYNLVVRGSDRDGAADGLSSECDCRIKVLDVNDNFPTLEKTSYSASIEENCLSSELIRLQAIDLDEEGTDNWLAQYLILSGNDGNWFDIQTDPQTNEGILKVVKMLDYEQAPNIQLSIGVKNQADFHYSVASQFQMHPTPVRIQVVDVREGPAFHPSTMAFSVREGIKGSSLLNYVLGTYTAIDLDTGNPATDVRYIIGHDAGSWLKIDSRTGEIQFSREFDKKSKYIINGIYTAEILAIDDGSGKTATGTICIEVPDINDYCPNIFPERRTICIDSPSVLISVNEHSYGSPFTFCVVDEPPGIADMWDVRSTNATSAILTAKQVLSPGFYEIPILVKDSYNRACELAQMVQLYACDCDDNHMCLDSGAAGIYTEDITGDTYGPVTEDQAGVSNVGLGPAGIGMMVLGILLLILAPLLLLLCCCKQRQPEGLGTRFAPVPEGGEGVMQSWRIEGAHPEDRDVSNICAPMTASNTQDRMDSSEIYTNTYAAGGTVEGGVSGVELNTGMGTAVGLMAAGAAGASGAARKRSSTMGTLRDYADADINMAFLDSYFSEKAYAYADEDEGRPANDCLLIYDHEGVGSPVGSIGCCSWIVDDLDESCMETLDPKFRTLAEICLNTEIEPFPSHQACIPISTDLPLLGPNYFVNESSGLTPSEVEFQEEMAASEPVVHGDIIVTETYGNADPCVQPTTIIFDPQLAPNVVVTEAVMAPVYDIQGNICVPAELADYNNVIYAERVLASPGVPDMSNSSTTEGCMGPVMSGNILVGPEIQVMQMMSPDLPIGQTVGSTSPMTSRHRVTRYSNIHYTQQ

SEQ ID NO: 1334 - protein, 743 aa, unidentified
MIEDSGKRGNTMAERRQLFAEMRAQDLDRIRLSTYRTACKLRFVQKKCNLHLVDIWNVIEALRENALNNLDPNTELNVSRLEAVLSTIFYQLNKRMPTTHQIHVEQSISLLLNFLLAAFDPEGHGKISVFAVKMALATLCGGKIMDKLRYIFSMISDSSGVMVYGRYDQFLREVLKLPTAVFEGPSFGYTEQSARSCFSQQKKVTLNGFLDTLMSDPPPQCLVWLPLLHRLANVENVFHPVECSYCHSESMMGFRYRCQQCHNYQLCQDCFWRGHAGGSHSNQHQMKEYTSWKSPAKKLTNALSKSLSCASSREPLHPMFPDQPEKPLNLAHIVDTWPPRPVTSMNDTLFSHSVPSSGSPFITRSSPPKDSEVEQNKLLARAAPAFLKGKGIQYSLNVADRLADEHVLIGLYVNMLRNNPSCMLESSNRLDEEHRLIARYAARLAAESSSSQPPQQRSAPDISFTIDANKQQRQLIAELENKNREILQEIQRLRLEHEQASQPTPEKAQQNPTLLAELRLLRQRKDELEQRMSALQESRRELMVQLEGLMKLLKTQGAGSPRSSPSHTISRPIPMPIRSASACSTPTHTPQDSLTGVGGDVQEAFAQSSRRNLRNDLLVAADSITNTMSSLVKELNSEVGSETESNVDSEFARTQFEDLVPSPTSEKAFLAQIHARKPGYIHSGATTSTMRGDMVTEDADPYVQPEDENYENDSVRQLENELQMEEYLKQKLQDEAYQVSLQG

SEQ ID NO: 1335 - protein, 1551 aa, unidentified
MGFCLALAWTLLVGAWTPLGAQNPISWEVQRFDGWYNNLMEHRWGSKGSRLQRLVPASYADGVYQPLGEPHLPNPRDLSNTISRGPAGLASLRNRTVLGVFFGYHVLSDLVSVETPGCPAEFLNIRIPPGDPMFDPDQRGDVVLPFQRSRWDPETGRSPSNPRDPANQVTGWLDGSAIYGSSHSWSDALRSFSRGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISSEFVAASEQFLSTMVPPGVYMRNASCHFQGVINRNSSVSRALRVCNSYWSREHPSLQSAEDVDALLLGMASQIAEREDHVLVEDVRDFWPGPLKFSRTDHLASCLQRGRDLGLPSYTKARAALGLSPITRWQDINPALSRSNDTVLEATAALYNQDLSWLELLPGGLLESHRDPGPLFSTIVLEQFVRLRDGDRYWFENTRNGLFSKKEIEEIRNTTLQDVLVAVINIDPSALQPNVFVWHKGDPCPQPRQLSTEGLPACAPSVVRDYFEGSGFGFGVTIGTLCCFPLVSLLSAWIVARLRMRNFKRLQGQDRQSIVSEKLVGGMEALEWQGHKEPCRPVLVYLQPGQIRVVDGRLTVLRTIQLQPPQKVNFVLSSNRGRRTLLLKIPKEYDLVLLFNLEEERQALVENLRGALKESGLSIQEWELREQELMRAAVTREQRRHLLETFFRHLFSQVLDINQADAGTLPLDSSQKVREALTCELSRAEFAESLGLKPQDMFVESMFSLADKDGNGYLSFREFLDILVVFMKGSPEEKSRLMFRMYDFDGNGLISKDEFIRMLRSFIEISNNCLSKAQLAEVVESMFRESGFQDKEELTWEDFHFMLRDHNSELRFTQLCVKGVEVPEVIKDLCRRASYISQDMICPSPRVSARCSRSDIETELTPQRLQCPMDTDPPQEIRRRFGKKVTSFQPLLFTEAHREKFQRSCLHQTVQQFKRFIENYRRHIGCVAVFYAIAGGLFLERAYYYAFAAHHTGITDTTRVGIILSRGTAASISFMFSYILLTMCRNLITFLRETFLNRYVPFDAAVDFHRLIASTAIVLTVLHSVGHVVNVYLFSISPLSVLSCLFPGLFHDDGSELPQKYYWWFFQTVPGLTGVVLLLILAIMYVFASHHFRRRSFRGFWLTHHLYILLYVLLIIHGSFALIQLPRFHIFFLVPAIIYGGDKLVSLSRKKVEISVVKAELLPSGVTHLRFQRPQGFEYKSGQWVRIACLALGTTEYHPFTLTSAPHEDTLSLHIRAAGPWTTRLREIYSAPTGDRCARYPKLYLDGPFGEGHQEWHKFEVSVLVGGGIGVTPFASILKDLVFKSSVSCQVFCKKIYFIWVTRTQRQFEWLADIIREVEENDHQDLVSVHIYITQLAEKFDLRTTMLYICERHFQKVLNRSLFTGLRSITHFGRPPFEPFFNSLQEVHPQVRKIGVFSCGPPGMTKNVEKACQLINRQDRTHFSHHYENF

SEQ ID NO: 1336 - protein, 1548 aa, unidentified
MLRARPEALMLLGALLTGSLGPSGNQDALSLPWEVQRYDGWFNNLRHHERGAVGCRLQRRVPANYADGVYQALEEPQLPNPRRLSNAATRGIAGLPSLHNRTVLGVFFGYHVLSDVVSVETPGCPAEFLNIRIPPGDPVFDPDQRGDVVLPFQRSRWDPETGRSPSNPRDLANQVTGWLDGSAIYGSSHSWSDALRSFSGGQLASGPDPAFPRDSQNPLLMWAAPDPATGQNGPRGLYAFGAERGNREPFLQALGLLWFRYHNLWAQRLARQHPDWEDEELFQHARKRVIATYQNIAVYEWLPSFLQKTLPEYTGYRPFLDPSISPEFVVASEQFFSTMVPPGVYMRNASCHFRKVLNKGFQSSQALRVCNNYWIRENPNLNSTQEVNELLLGMASQISELEDNIVVEDLRDYWPGPGKFSRTDYVASSIQRGRDMGLPSYSQALLAFGLDIPRNWSDLNPNVDPQVLEATAALYNQDLSQLELLLGGLLESHGDPGPLFSAIVLDQFVRLRDGDRYWFENTRNGLFSKKEIEDIRNTTLRDVLVAVINIDPSALQPNVFVWHKGAPCPQPKQLTTDGLPQCAPLTVLDFFEGSSPGFAITIIALCCLPLVSLLLSGVVAYFRGREHKKLQKKLKESVKKEAAKDGVPAMEWPGPKERSSPIIIQLLSDRCLQVLNRHLTVLRVVQLQPLQQVNLILSNNRGCRTLLLKIPKEYDLVLLFSSEEERGAFVQQLWDFCVRWALGLHVAEMSEKELFRKAVTKQQRERILEIFFRHLFAQVLDINQADAGTLPLDSSQKVREALTCELSRAEFAESLGLKPQDMFVESMFSLADKDGNGYLSFREFLDILVVFMKGSPEDKSRLMFTMYDLDENGFLSKDEFFTMMRSFIEISNNCLSKAQLAEVVESMFRESGFQDKEELTWEDFHFMLRDHDSELRFTQLCVKGGGGGGNGIRDIFKQNISCRVSFITRTPGERSHPQGLGPPAPEAPELGGPGLKKRFGKKAAVPTPRLYTEALQEKMQRGFLAQKLQQYKRFVENYRRHIVCVAIFSAICVGVFADRAYYYGFASPPSDIAQTTLVGIILSRGTAASVSFMFSYILLTMCRNLITFLRETFLNRYVPFDAAVDFHRWIAMAAVVLAILHSAGHAVNVYIFSVSPLSLLACIFPNVFVNDGSKLPQKFYWWFFQTVPGMTGVLLLLVLAIMYVFASHHFRRRSFRGFWLTHHLYILLYALLIIHGSYALIQLPTFHIYFLVPAIIYGGDKLVSLSRKKVEISVVKAELLPSGVTYLQFQRPQGFEYKSGQWVRIACLALGTTEYHPFTLTSAPHEDTLSLHIRAVGPWTTRLREIYSSPKGNGCAGYPKLYLDGPFGEGHQEWHKFEVSVLVGGGIGVTPFASILKDLVFKSSLGSQMLCKKIYFIWVTRTQRQFEWLADIIQEVEENDHQDLVSVHIYVTQLAEKFDLRTTMLYICERHFQKVLNRSLFTGLRSITHFGRPPFEPFFNSLQEVHPQVRKIGVFSCGPPGMTKNVEKACQLVNRQDRAHFMHHYENF

SEQ ID NO: 1337 - protein, 343 aa, unidentified
MATLGHTFPFYAGPKPTFPMDTTLASIIMIFLTALATFIVILPGIRGKTRLFWLLRVVTSLFIGAAILAVNFSSEWSVGQVSTNTSYKAFSSEWISADIGLQVGLGGVNITLTGTPVQQLNETINYNEEFTWRLGENYAEEYAKALEKGLPDPVLYLAEKFTPRSPCGLYRQYRLAGHYTSAMLWVAFLCWLLANVMLSMPVLVYGGYMLLATGIFQLLALLFFSMATSLTSPCPLHLGASVLHTHHGPAFWITLTTGLLCVLLGLAMAVAHRMQPHRLKAFFNQSVDEDPMLEWSPEEGGLLSPRYRSMADSPKSQDIPLSEASSTKAYCKEAHPKDPDCAL

SEQ ID NO: 1338 - protein, 320 aa, unidentified
MTLWNGVLPFYPQPRHAAGFSVPLLIVILVFLALAASFLLILPGIRGHSRWFWLVRVLLSLFIGAEIVAVHFSAEWFVGTVNTNTSYKAFSAARVTARVRLLVGLEGINITLTGTPVHQLNETIDYNEQFTWRLKENYAAEYANALEKGLPDPVLYLAEKFTPSSPCGLYHQYHLAGHYASATLWVAFCFWLLSNVLLSTPAPLYGGLALLTTGAFALFGVFALASISSVPLCPLRLGSSALTTQYGAAFWVTLATGVLCLFLGGAVVSLQYVRPSALRTLLDQSAKDCSQERGGSPLILGDPLHKQAALPDLKCITTNL

SEQ ID NO: 1339 - protein, 188 aa, unidentified
MAETSLPELGGEDKATPCPSILELEELLRAGKSSCSRVDEVWPNLFIGDAATANNRFELWKLGITHVLNAAHKGLYCQGGPDFYGSSVSYLGVPAHDLPDFDISAYFSSAADFIHRALNTPGAKVLVHCVVGVSRSATLVLAYLMLHQRLSLRQAVITVRQHRWVFPNRGFLHQLCRLDQQLRGAGQS

SEQ ID NO: 1340 - protein, 669 aa, unidentified
MGSNSSRIGDLPKNEYLKKLSGTESISENDPFWNQLLSFSFPAPTSSSELKLLEEATISVCRSLVENNPRTGNLGALIKVFLSRTKELKLSAECQNHIFIWQTHNALFIICCLLKVFICQMSEEELQLHFTYEEKSPGNYSSDSEDLLEELLCCLMQLITDIPLLDITYEISVEAISTMVVFLSCQLFHKEVLRQSISHKYLMRGPCLPYTSKLVKTLLYNFIRQEKPPPPGAHVFPQQSDGGGLLYGLASGVATGLWTVFTLGGVGSKAAASPELSSPLANQSLLLLLVLANLTDASDAPNPYRQAIMSFKNTQDSSPFPSSIPHAFQINFNSLYTALCEQQTSDQATLLLYTLLHQNSNIRTYMLARTDMENLVLPILEILYHVEERNSHHVYMALIILLILTEDDGFNRSIHEVILKNITWYSERVLTEISLGSLLILVVIRTIQYNMTRTRDKYLHTNCLAALANMSAQFRSLHQYAAQRIISLFSLLSKKHNKVLEQATQSLRGSLSSNDVPLPDYAQDLNVIEEVIRMMLEIINSCLTNSLHHNPNLVYALLYKRDLFEQFRTHPSFQDIMQNIDLVISFFSSRLLQAGAELSVERVLEIIKQGVVALPKDRLKKFPELKFKYVEEEQPEEFFIPYVWSLVYNSAVGLYWNPQDIQLFTMDSD

SEQ ID NO: 1341 - protein, 210 aa, unidentified
MVADIKGNEQIEKYSWREACDTGSSRMDRKHGKYILNVEHSENQPPITHPNDQEAHSSICWCLPSNDITSDVSPNLTGVCVNPGILAHSRCLQSESCNTQVKEYCRNDWSMWKVFLACLLACVIMTAIGVLIICLVNNKGSANSSIVIQLSTNDGECVTVKPGTPSPACPPTMTTTSTVPASTATESTTSTATAATTSTEPITVAPTDHL

SEQ ID NO: 1342 - protein, 601 aa, unidentified
MLTRKPSAAAPAAYPTGRGGDSAVRQLQASPGLGAGATRSGVGTGPPSPIALPPLRASNAAAAAHTIGGSKHTMNDHLHVGSHAHGQIQVQQLFEDNSNKRTVLTTQPNGLTTVGKTGLPVVPERQLDSIHRRQGSSTSLKSMEGMGKVKATPMTPEQAMKQYMQKLTAFEHHEIFSYPEIYFLGLNAKKRQGMTGGPNNGGYDDDQGSYVQVPHDHVAYRYEVLKVIGKGSFGQVVKAYDHKVHQHVALKMVRNEKRFHRQAAEEIRILEHLRKQDKDNTMNVIHMLENFTFRNHICMTFELLSMNLYELIKKNKFQGFSLPLVRKFAHSILQCLDALHKNRIIHCDLKPENILLKQQGRSGIKVIDFGSSCYEHQRVYTYIQSRFYRAPEVILGARYGMPIDMWSLGCILAELLTGYPLLPGEDEGDQLACMIELLGMPSQKLLDASKRAKNFVSSKGYPRYCTVTTLSDGSVVLNGGRSRRGKLRGPPESREWGNALKGCDDPLFLDFLKQCLEWDPAVRMTPGQALRHPWLRRRLPKPPTGEKTSVKRITESTGAITSISKLPPPSSSASKLRTNLAQMTDANGNIQQRTVLPKLVS

SEQ ID NO: 1343 - protein, 2080 aa, unidentified
MLRVFILYAENVHTPDTDISDAYCSAVFAGVKKRTKVIKNSVNPVWNEGFEWDLKGIPLDQGSELHVVVKDHETMGRNRFLGEAKVPLREVLATPSLSASFNAPLLDTKKQPTGASLVLQVSYTPLPGAVPLFPPPTPLEPSPTLPDLDVVADTGGEEDTEDQGLTGDEAEPFLDQSGGPGAPTTPRKLPSRPPPHYPGIKRKRSAPTSRKLLSDKPQDFQIRVQVIEGRQLPGVNIKPVVKVTAAGQTKRTRIHKGNSPLFNETLFFNLFDSPGELFDEPIFITVVDSRSLRTDALLGEFRMDVGTIYREPRHAYLRKWLLLSDPDDFSAGARGYLKTSLCVLGPGDEAPLERKDPSEDKEDIESNLLRPTGVALRGAHFCLKVFRAEDLPQMDDAVMDNVKQIFGFESNKKNLVDPFVEVSFAGKMLCSKILEKTANPQWNQNITLPAMFPSMCEKMRIRIIDWDRLTHNDIVATTYLSMSKISAPGGEIEEEPAGAVKPSKASDLDDYLGFLPTFGPCYINLYGSPREFTGFPDPYTELNTGKGEGVAYRGRLLLSLETKLVEHSEQKVEDLPADDILRVEKYLRRRKYSLFAAFYSATMLQDVDDAIQFEVSIGNYGNKFDMTCLPLASTTQYSRAVFDGCHYYYLPWGNVKPVVVLSSYWEDISHRIETQNQLLGIADRLEAGLEQVHLALKAQCSTEDVDSLVAQLTDELIAGCSQPLGDIHETPSATHLDQYLYQLRTHHLSQITEAALALKLGHSELPAALEQAEDWLLRLRALAEEPQNSLPDIVIWMLQGDKRVAYQRVPAHQVLFSRRGANYCGKNCGKLQTIFLKYPMEKVPGARMPVQIRVKLWFGLSVDEKEFNQFAEGKLSVFAETYENETKLALVGNWGTTGLTYPKFSDVTGKIKLPKDSFRPSAGWTWAGDWFVCPEKTLLHDMDAGHLSFVEEVFENQTRLPGGQWIYMSDNYTDVNGEKVLPKDDIECPLGWKWEDEEWSTDLNRAVDEQGWEYSITIPPERKPKHWVPAEKMYYTHRRRRWVRLRRRDLSQMEALKRHRQAEAEGEGWEYASLFGWKFHLEYRKTDAFRRRRWRRRMEPLEKTGPAAVFALEGALGGVMDDKSEDSMSVSTLSFGVNRPTISCIFDYGNRYHLRCYMYQARDLAAMDKDSFSDPYAIVSFLHQSQKTVVVKNTLNPTWDQTLIFYEIEIFGEPATVAEQPPSIVVELYDHDTYGADEFMGRCICQPSLERMPRLAWFPLTRGSQPSGELLASFELIQREKPAIHHIPGFEVQETSRILDESEDTDLPYPPPQREANIYMVPQNIKPALQRTAIEILAWGLRNMKSYQLANISSPSLVVECGGQTVQSCVIRNLRKNPNFDICTLFMEVMLPREELYCPPITVKVIDNRQFGRRPVVGQCTIRSLESFLCDPYSAESPSPQGGPDDVSLLSPGEDVLIDIDDKEPLIPIQEEEFIDWWSKFFASIGEREKCGSYLEKDFDTLKVYDTQLENVEAFEGLSDFCNTFKLYRGKTQEETEDPSVIGEFKGLFKIYPLPEDPAIPMPPRQFHQLAAQGPQECLVRIYIVRAFGLQPKDPNGKCDPYIKISIGKKSVSDQDNYIPCTLEPVFGKMFELTCTLPLEKDLKITLYDYDLLSKDEKIGETVVDLENRLLSKFGARCGLPQTYCVSGPNQWRDQLRPSQLLHLFCQQHRVKAPVYRTDRVMFQDKEYSIEEIEAGRIPNPHLGPVEERLALHVLQQQGLVPEHVESRPLYSPLQPDIEQGKLQMWVDLFPKALGRPGPPFNITPRRARRFFLRCIIWNTRDVILDDLSLTGEKMSDIYVKGWMIGFEEHKQKTDVHYRSLGGEGNFNWRFIFPFDYLPAEQVCTIAKKDAFWRLDKTESKIPARVVFQIWDNDKFSFDDFLGSLQLDLNRMPKPAKTAKKCSLDQLDDAFHPEWFVSLFEQKTVKGWWPCVAEEGEKKILAGKLEMTLEIVAESEHEERPAGQGRDEPNMNPKLEDPRRPDTSFLWFTSPYKTMKFILWRRFRWAIILFIILFILLLFLAIFIYAFPNYAAMKLVKPFS

SEQ ID NO: 1344 - protein, 1208 aa, unidentified
MDSLPDEFFVRHPAVEDQRKEETENKLEKSSGQLNKQENDIPTDLVPVNLLLEVKKLLNAINTLPKGVVPHIKKFLQEDFSFQTMQREVAANSQNGEEIVPALTLRFLITQLEAALRNIQAGNYTAHQINIGYYLTLLFLYGVALTERGKKEDYTEAENKFLVMKMMIQENEICENFMSLVYFGRGLLRCAQKRYNGGLLEFHKSLQEIGDKNDHWFDIDPTEDEDLPTTFKDLLNNFIKTTESNIMKQTICSYLDCERSCEADILKNTSYKGFFQLMCSKSCCVYFHKICWKKFKNLKYPGENDQSFSGKKCLKEGCTGDMVRMLQCDVPGIVKILFEVVRKDEYITIENLGASYRKLISLKITDTDIRPKISLKFNTKDEMPIFKLDYNYFYHLLHIIIISGTDIVRQIFDEAMPPPLLKKELLIHKNVLESYYNHLWTNHPLGGSWHLLYPPNKELPQSKQFDLCLLLALIKHLNVFPAPKKGWNMEPPSSDISKSADILRLCKYRDILLSEILMNGLTESQFNSIWKKVSDILLRLGMMQEDIDKVKENPIENISLDYHQLSVYLGIPVPEIIQRMLSCYQQGIALQSITGSQRIEIEELQNEEEELSPPLMEYNINVKSHPEIQFAEINKDGTSIPSESSTESLKDLQEVKSKQRKKKKTKNKKNKDSKEDQVPYVVEKEEQLRKEQANPHSVSRLIKDDASDVQEDSAMEDKFYSLDELHILDMIEQGSAGKVTTDYGETEKERLARQRQLYKLHYQCEDFKRQLRTVTFRWQENQMQIKKKDKIIASLNQQVAFGINKVSKLQRQIHAKDNEIKNLKEQLSMKRSQWEMEKHNLESTMKTYVSKLNAETSRALTAEVYFLQCRRDFGLLHLEQTEKECLNQLARVTHMAASNLESLQLKAAVDSWNAIVADVRNKIAFLRTQYNEQINKVKQGFALSTLPPVQLPPPPPSPEILMQQFLGRPLVKESFFRPILTVPQMPAVCPGVVSATGQPRAPLMTGIAWALPAPVGDAVPPSAGLRSDPSIMNWERITDRLKTAFPQQTRKELTDFLRKLKDAYGKSLSELTFDEIVCKISQFIDPKKSQSQGKSVSNVNCVSPSHSPSQPDAAQPPKPAWRPLTSQGPATWEGASNPDEEEEEEEPCVICHENLSPENLSVLPCAHKFHAQCIRPWLMQQGTCPTCRLHVLLPEEFPGHPSRQLPKI

SEQ ID NO: 1345 - protein, 346 aa, unidentified
MAAAEPASSGQQAPAGQGQGQRPPPQPPQAQAPQPPPPPQLGGAGGGSSRHEKSLGLLTTKFVSLLQEAKDGVLDLKAAADTLAVRQKRRIYDITNVLEGIDLIEKKSKNSIQWKGVGAGCNTKEVIDRLRYLKAEIEDLELKERELDQQKLWLQQSIKNVMDDSINNRFSYVTHEDICNCFNGDTLLAIQAPSGTQLEVPIPEMGQNGQKKYQINLKSHSGPIHVLLINKESSSSKPVVFPVPPPDDLTQPSSQSLTPVTPQKSSMATQNLPEQHVSERSQALQQTSATDISSAGSISGDIIDELMSSDVFPLLRLSPTPADDYNFNLDDNEGVCDLFDVQILNY

SEQ ID NO: 1346 - protein, 230 aa, unidentified [sequence omitted]

SEQ ID NO: 1347 - protein, 206 aa, unidentified
MGAEWELGAEAGGSLLLCAALLAAGCALGLRLGRGQGAADRGALIWLCYDALVHFALEGPFVYLSLVGNVANSDGLIASLWKEYGKADARWVYFDPTIVSVEILTVALDGSLALFLIYAIVKEKYYRHFLQITLCVCELYGCWMTFLPEWLTRSPNLNTSNWLYCWLYLFFFNGVWVLIPGLLLWQSWLELKKMHQKETSSVKKFQ

SEQ ID NO: 1348 - protein, 770 aa, unidentified
MRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 1349 - protein, 775 aa, unidentified
MEPPYSLTAHYDEFQEVKYVSRCGAGGARGASLPPGFPLGAARSATGARSGLPRWNRREVCLLSGLVFAAGLCAILAAMLALKYLGPVAAGGGACPEGCPERKAFARAARFLAANLDASIDPCQDFYSFACGGWLRRHAIPDDKLTYGTIAAIGEQNEERLRRLLARPGGGPGGAAQRKVRAFFRSCLDMREIERLGPRPMLEVIEDCGGWDLGGAEERPGVAARWDLNRLLYKAQGVYSAAALFSLTVSLDDRNSSRYVIRIDQDGLTLPERTLYLAQDEDSEKILAAYRVFMERVLSLLGADAVEQKAQEILQVEQQLANITVSEHDDLRRDVSSMYNKVTLGQLQKITPHLRWKWLLDQIFQEDFSEEEEVVLLATDYMQQVSQLIRSTPHRVLHNYLVWRVVVVLSEHLSPPFREALHELAQEMEGSDKPQELARVCLGQANRHFGMALGALFVHEHFSAASKAKVQQLVEDIKYILGQRLEELDWMDAETRAAARAKLQYMMVMVGYPDFLLKPDAVDKEYEFEVHEKTYFKNILNSIRFSIQLSVKKIRQEVDKSTWLLPPQALNAYYLPNKNQMVFPAGILQPTLYDPDFPQSLNYGGIGTIIGHELTHGYDDWGGQYDRSGNLLHWWTEASYSRFLRKAECIVRLYDNFTVYNQRVNGKHTLGENIADMGGLKLAYHAYQKWVREHGPEHPLPRLKYTHDQLFFIAFAQNWCIKRRSQSIYLQVLTDKHAPEHYRVLGSVSQFEEFGRAFHCPKDSPMNPAHKCSVW

SEQ ID NO: 1350 - protein, 205 aa, unidentified
MGTAGAMQLCWVILGFLLFRGHNSQPTMTQTSSSQGGLGGLSLTTEPVSSNPGYIPSSEANRPSHLSSTGTPGAGVPSSGRDGGTSRDTFQTVPPNSTTMSLSMREDATILPSPTSETVLTVAAFGVISFIVILVVVVIILVGVVSLRFKCRKSKESEDPQKPGSSGLSESCSTANGEKDSITLISMKNINMNNGKQSLSAEKVL

SEQ ID NO: 1351 - protein, 391 aa, unidentified
MGYPEVERRELLPAAAPRERGSQGCGCGGAPARAGEGNSCLLFLGFFGLSLALHLLTLCCYLELRSELRRERGAESRLGGSGTPGTSGTLSSLGGLDPDSPITSHLGQPSPKQQPLEPGEAALHSDSQDGHQMALLNFFFPDEKPYSEEESRRVRRNKRSKSNEGADGPVKNKKKGKKAGPPGPNGPPGPPGPPGPQGPPGIPGIPGIPGTTVMGPPGPPGPPGPQGPPGLQGPSGAADKAGTRENQPAVVHLQGQGSAIQVKNDLSGGVLNDWSRITMNPKVFKLHPRSGELEVLVDGTYFIYSQVEVYYINFTDFASYEVVVDEKPFLQCTRSIETGKTNYNTCYTAGVCLLKARQKIAVKMVHADISINMSKHTTFFGAIRLGEAPAS

SEQ ID NO: 1352 - protein, 297 aa, unidentified
MDCQENEYWDQWGRCVTCQRCGPGQELSKDCGYGEGGDAYCTACPPRRYKSSWGHHRCQSCITCAVINRVQKVNCTATSNAVCGDCLPRFYRKTRIGGLQDQECIPCTKQTPTSEVQCAFQLSLVEADTPTVPPQEATLVALVSSLLVVFTLAFLGLFFLYCKQFFNRHCQRGGLLQFEADKTAKEESLFPVPPSKETSAESQVSENIFQTQPLNPILEDDCSSTSGFPTQESFTMASCTSESHSHWVHSPIECTELDLQKFSSSASYTGAETLGGNTVESTGDRLELNVPFEVPSP

SEQ ID NO: 1353 - protein, 448 aa, unidentified
MAHVGDCTQTPWLPVLVVSLMCSARAEYSNCGENEYYNQTTGLCQECPPCGPGEEPYLSCGYGTKDEDYGCVPCPAEKFSKGGYQICRRHKDCEGFFRATVLTPGDMENDAECGPCLPGYYMLENRPRNIYGMVCYSCLLAPPNTKECVGATSGASANFPGTSGSSTLSPFQHAHKELSGQGHLATALIIAMSTIFIMAIAIVLIIMFYILKTKPSAPACCTSHPGKSVEAQVSKDEEKKEAPDNVVMFSEKDEFEKLTATPAKPTKSENDASSENEQLLSRSVDSDEEPAPDKQGSPELCLLSLVHLAREKSATSNKSAGIQSRRKKILDVYANVCGVVEGLSPTELPFDCLEKTSRMLSSTYNSEKAVVKTWRHLAESFGLKRDEIGGMTDGMQLFDRISTAGYSIPELLTKLVQIERLDAVESLCADILEWAGVVPPASQPHAAS

SEQ ID NO: 1354 - protein, 427 aa, unidentified
METLCLRASFWLALVGCVISDNPERYSTNLSNHVDDFTTFRGTELSFLVTTHQPTNLVLPSNGSMHNYCPQQTKITSAFKYINTVISCTIFIVGMVGNATLLRIIYQNKCMRNGPNALIASLALGDLIYVVIDLPINVFKLLAGRWPFDHNDFGVFLCKLFPFLQKSSVGITVLNLCALSVDRYRAVASWSRVQGIGIPLVTAIEIVSIWILSFILAIPEAIGFVMVPFEYRGEQHKTCMLNATSKFMEFYQDVKDWWLFGFYFCMPLVCTAIFYTLMTCEMLNRRNGSLRIALSEHLKQRREVAKTVFCLVVIFALCWFPLHLSRILKKTVYNEMDKNRCELLSFLLLMDYIGINLATMNSCINPIALYFVSKKFKNCFQSCLCCCCYQSKSLMTSVPMNGTSIQWKNHDQNNHNTDRSSHKDSMN

SEQ ID NO: 1355 - protein, 442 aa, unidentified
MQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAEDWPFGAEMCKLVPFIQKASVGITVLSLCALSIDRYRAVASWSRIKGIGVPKWTAVEIVLIWVVSVVLAVPEAIGFDIITMDYKGSYLRICLLHPVQKTAFMQFYKTAKDWWLFSFYFCLPLAITAFFYTLMTCEMLRKKSGMQIALNDHLKQRREVAKTVFCLVLVFALCWLPLHLSRILKLTLYNQNDPNRCELLSFLLVLDYIGINMASLNSCINPIALYLVSKRFKNCFKSCLCCWCQSFEEKQSLEEKQSCLKFKANDHGYDNFRSSNKYSSS

SEQ ID NO: 1356 - protein, 1238 aa, unidentified
MGDAKEAGAEGPPAGAAARGGLSLLSQGESEESSAQGSALFLGGNEVKSRAVVKYSSAPPRTAFARLEEKTDLKLPPANWLRESAKLGPAGTTILGNSKKSKPFSSFGMAYDFIDSVGNDVDVVSDSENIKKLLKIPYSKSHVSMAVHRIGRTLLLDELDIQELFMRSSQTGDWTWLKEFYQRLIDQKWQRKKKSKEHWYQKAILSKFLYYSINGDGAAQPVSSTAEQQESSSSDQTNDSEGASWPAPFEMPSSVSEDPSASSQGSEPLEPSYIVGHVASAPKEQNLITLFNDGEHSQGLKNDFVRNILWTFEDIHMLVGSNMPIFGGGRYPAVSLRLRDNNKPINVLTGIDYWLDNLICNVPELVMCFHVNGIVQKYEMIKTEEIPNLENSNFSTKVIKDIAQNILSFLKSNCTKEGHTYWLFKASGSDIVKLYDLTTLCEETEDKYQNPFTMPVAILLYKVACNMMMKKNQNKKHYGTIRTLLLNCLKLLDKSRHPQIIASANYMLSELFQLDEPKKEENSESPLNENSDESYSEEEEEMPDSDENGSYSTSSDPSDDSKAVAIIKSVGELSVPEKYKSIHQIRPSCAFPVCHDTEERCRLVLSYVLEGLKSVDSSIKKESDLPAADPSTPIPLKYEDESSRGGPEGLEKQMALFLDKMGSLQKGNYSSQSGMIPGSWQHKMKLQLILKSSKAYYVLSDAAMSLQKYGRALRYIKLALQSHDTYCCLCTNMLSEVLLFLSQYLTLCGDIQLMLAQNANNRAAHLEEFHYQTKEDQEILHSLHRESSCQGFAWATDLSTDLESQLSVSCKCYEAANEILQFSDLKSQNPEHYVQVLKRMGNIRNEIGVFYMNQAAALQSERLVSKSVSAAEQQLWKKSFSCFEKGIHNFESIEDATNAALLLCNTGRLMRICAQAHCGAGDELKREFSPEEGLYYNKAIDYYLKALRSLGTRDIHPAVWDSVNWELSTTYFTMATLQQDYAPLSRKAQEQIEKEVSEAMMKSLKYCDVDSVSARQPLCQYRAATIHHRLASMYHSCLRNQVGDEHLRKQHRVLADLHYSKAAKLFQLLKDAPCELLRVQLERVAFAEFQMTSQNSNVGKLKTLSGALDIMVRTEHAFQLIQKELIEEFGQPKSGDAAAAADASPSLNREEVMKLLSIFESRLSFLLLQSIKLLSSTKKKTSNNIEDDTILKTNKHIYSQLLRATANKTATLLERINVIVHLLGQLAAGSAASSNAVQ

SEQ ID NO: 1357 - protein, 174 aa, unidentified
MAAAAELSLLEKSLGLSKGNKYSAQGERQIPVLQTNNGPSLTGLTTIAAHLVKQANKEYLLGSTAEEKAIVQQWLEYRVTQVDGHSSKNDIHTLLKDLNSYLEDKVYLTGYNFTLADILLYYGLHRFIVDLTVQEKEKYLNVSRWFCHIQHYPGIRQHLSSVVFIKNRLYTNSH

SEQ ID NO: 1358 - protein, 495 aa, unidentified
MKKRKELNALIGLAGDSRRKKPKKGPSSHRLLRTEPPDSDSESSSEEEEEFGVVGNRSRFAKGDYLRCCKICYPLCGFVILAACVVACVGLVWMQVALKEDLDALKEKFRTMESNQKSSFQEIPKLNEELLSKQKQLEKIESGEMGLNKVWINITEMNKQISLLTSAVNHLKANVKSAADLISLPTTVEGLQKSVASIGNTLNSVHLAVEALQKTVDEHKKTMELLQSDMNQHFLKETPGSNQIIPSPSATSELDNKTHSENLKQDILYLHNSLEEVNSALVGYQRQNDLKLEGMNETVSNLTQRVNLIESDVVAMSKVEKKANLSFSMMGDRSATLKRQSLDQVTNRTDTVKIQSIKKEDSSNSQVSKLREKLQLISALTNKPESNRPPETADEEQVESFTSKPSALPKFSQFLGDPVEKAAQLRPISLPGVSSTEDLQDLFRKTGQDVDGKLTYQEIWTSLGSAMPEPESLRAFDSDGDGRYSFLELRVALGI

SEQ ID NO: 1359 - protein, 238 aa, unidentified
MAAAPLLLLLLLVPVPLLPLLAQGPGGALGNRHAVYWNSSNQHLRREGYTVQVNVNDYLDIYCPHYNSSGVGPGAGPGPGGGAEQYVLYMVSRNGYRTCNASQGFKRWECNRPHAPHSPIKFSEKFQRYSAFSLGYEFHAGHEYYYISTPTHNLHWKCLRMKVFVCCASTSHSGEKPVPTLPQFTMGPNVKINVLEDFEGENPQVPKLEKSISGTSPKREHLPLAVGIAFFLMTFLAS

SEQ ID NO: 1360 - protein, 201 aa, unidentified
MRLLPLLRTVLWAAFLGSPLRGGSSLRHVVYWNSSNPRLLRGDAVVELGLNDYLDIVCPHYEGPGPPEGPETFALYMVDWPGYESCQAEGPRAYKRWVCSLPFGHVQFSEKIQRFTPFSLGFEFLPGETYYYISVPTPESSGQCLRLQVSVCCKERKSESAHPVGSPGESGTSGWRGGDTPSPLCLLLLLLLLILRLLRIL

SEQ ID NO: 1361 - protein, 228 aa, unidentified
MLHVEMLTLVFLVLWMCVFSQDPGSKAVADRYAVYWNSSNPRFQRGDYHIDVCINDYLDVFCPHYEDSVPEDKTERYVLYMVNFDGYSACDHTSKGFKRWECNRPHSPNGPLKFSEKFQLFTPFSLGFEFRPGREYFYISSAIPDNGRRSCLKLKVFVRPTNSCMKTIGVHDRVFDVNDKVENSLEPADDTVHESAEPSRGENAAQTPRIPSRLLAILLFLLAMLLTL

SEQ ID NO: 1362 - protein, 346 aa, unidentified
MARPGQRWLGKWLVAMVVWALCRLATPLAKNLEPVSWSSLNPKFLSGKGLVIYPKIGDKLDIICPRAEAGRPYEYYKLYLVRPEQAAACSTVLDPNVLVTCNRPEQEIRFTIKFQEFSPNYMGLEFKKHHDYYITSTSNGSLEGLENREGGVCRTRTMKIIMKVGQDPNAVTPEQLTTSRPSKEADNTVKMATQAPGSRGSLGDSDGKHETVNQEEKSGPGASGGSSGDPDGFFNSKVALFAAVGAGCVIFLLIIIFLTVLLLKLRKRHRKHTQQRAAALSLSTLASPKGGSGTAGTEPSDIIIPLRTTENNYCPHYEKVSGDYGHPVYIVQEMPPQSPANIYYKV

SEQ ID NO: 1363 - protein, 333 aa, unidentified
MAVRRDSVWKYCWGVLMVLCRTAISKSIVLEPIYWNSSNSKFLPGQGLVLYPQIGDKLDIICPKVDSKTVGQYEYYKVYMVDKDQADRCTIKKENTPLLNCAKPDQDIKFTIKFQEFSPNLWGLEFQKNKDYYIISTSNGSLEGLDNQEGGVCQTRAMKILMKVGQDASSAGSTRNKDPTRRPELEAGTNGRSSTTSPFVKPNPGSSTDGNSAGHSGNNILGSEVALFAGIASGCIIFIVIIITLVVLLLKYRRRHRKHSPQHTTTLSLSTLATPKRSGNNNGSEPSDIIIPLRTADSVFCPHYEKVSGDYGHPVYIVQEMPPQSPANIYYKV

SEQ ID NO: 1364 - protein, 340 aa, unidentified
MGPPHSGPGGVRVGALLLLGVLGLVSGLSLEPVYWNSANKRFQAEGGYVLYPQIGDRLDLLCPRARPPGPHSSPNYEFYKLYLVGGAQGRRCEAPPAPNLLLTCDRPDLDLRFTIKFQEYSPNLWGHEFRSHHDYYIIATSDGTREGLESLQGGVCLTRGMKVLLRVGQSPRGGAVPRKPVSEMPMERDRGAAHSLEPGKENLPGDPTSNATSRGAEGPLPPPSMPAVAGAAGGLALLLLGVAGAGGAMCWRRRRAKPSESRHPGPGSFGRGGSLGLGGGGGMGPREAEPGELGIALRGGGAADPPFCPHYEKVSGDYGHPVYIVQDGPPQSPPNIYYKV

SEQ ID NO: 1365 - protein, 1207 aa, unidentified
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLFGDRIFYSTWKMKTIWIANKHTGKDMVRINLHSSFVPLGELKVVHPLAQPKAEDDTWEPEQKLCKLRKGNCSSTVCGQDLQSHLCMCAEGYALSRDRKYCEDVNECAFWNHGCTLGCKNTPGSYYCTCPVGFVLLPDGKRCHQLVSCPRNVSECSHDCVLTSEGPLCFCPEGSVLERDGKTCSGCSSPDNGGCSQLCVPLSPVSWECDCFPGYDLQLDEKSCAASGPQPFLLFANSQDIRHMHFDGTDYGTLLSQQMGMVYALDHDPVENKIYFAHTALKWIERANMDGSQRERLIEEGVDVPEGLAVDWIGRRFYWTDRGKSLIGRSDLNGKRSKIITKENISQPRGIAVHPMAKRLFWTDTGINPRIESSSLQGLGRLVIASSDLIWPSGITIDFLTDKLYWCDAKQSVIEMANLDGSKRRRLTQNDVGHPFAVAVFEDYVWFSDWAMPSVMRVNKRTGKDRVRLQGSMLKPSSLVVVHPLAKPGADPCLYQNGGCEHICKKRLGTAWCSCREGFMKASDGKTCLALDGHQLLAGGEVDLKNQVTPLDILSKTRVSEDNITESQHMLVAEIMVSDQDDCAPVGCSMYARCISEGEDATCQCLKGFAGDGKLCSDIDECEMGVPVCPPASSKCINTEGGYVCRCSEGYQGDGIHCLDIDECQLGEHSCGENASCTNTEGGYTCMCAGRLSEPGLICPDSTPPPHLREDDHHYSVRNSDSECPLSHDGYCLHDGVCMYIEALDKYACNCVVGYIGERCQYRDLKWWELRHAGHGQQQKVIVVAVCVVVLVMLLLLSLWGAHYYRTQKLLSKNPKNPYEESSRDVRSRRPADTEDGMSSCPQPWFVVIKEHQDLKNGGQPVAGEDGQAADGSMQPTSWRQEPQLCGMGTEQGCWIPVSSDKGSCPQVMERSFHMPSYGTQTLEGGVEKPHSLLSANPLWQQRALDPPHQMELTQ

SEQ ID NO: 1366 - protein, 1210 aa, unidentified [sequence omitted]

SEQ ID NO: 1367 - protein, 340 aa, unidentified
MADSVKTFLQDLARGIKDSIWGICTISKLDARIQQKREEQRRRRASSVLAQRRAQSIERKQESEPRIVSRIFQCCAWNGGVFWFSLLLFYRVFIPVLQSVTARIIGDPSLHGDVWSWLEFFLTSIFSALWVLPLFVLSKVVNAIWFQDIADLAFEVSGRKPHPFPSVSKIIADMLFNLLLQALFLIQGMFVSLFPIHLVGQLVSLLHMSLLYSLYCFEYRWFNKGIEMHQRLSNIERNWPYYFGFGLPLAFLTAMQSSYIISGCLFSILFPLFIISANEAKTPGKAYLFQLRLFSLVVFLSNRLFHKTVYLQSALSSSTSAEKFPSPHPSPAKLKATAGH

SEQ ID NO: 1368 - protein, 1116 aa, unidentified
MERAISPGLLVRALLLLLLLLGLAARTVAAGRARGLPAPTAEAAFGLGAAAAPTSATRVPAAGAVAAAEVTVEDAEALPAAAGEQEPRGPEPDDETELRPRGRSLVIISTLDGRIAALDPENHGKKQWDLDVGSGSLVSSSLSKPEVFGNKMIIPSLDGALFQWDQDRESMETVPFTVESLLESSYKFGDDVVLVGGKSLTTYGLSAYSGKVRYICSALGCRQWDSDEMEQEEDILLLQRTQKTVRAVGPRSGNEKWNFSVGHFELRYIPDMETRAGFIESTFKPNENTEESKIISDVEEQEAAIMDIVIKVSVADWKVMAFSKKGGHLEWEYQFCTPIASAWLLKDGKVIPISLFDDTSYTSNDDVLEDEEDIVEAARGATENSVYLGMYRGQLYLQSSVRISEKFPSSPKALESVTNENAIIPLPTIKWKPLIHSPSRTPVLVGSDEFDKCLSNDKFSHEEYSNGALSILQYPYDNGYYLPYYKRERNKRSTQITVRFLDNPHYNKNIRKKDPVLLLHWWKEIVATILFCIIATTFIVRRLFHPHPHRQRKESETQCQTENKYDSVSGEANDSSWNDIKNSGYISRYLTDFEPIQCLGRGGFGVVFEAKNKVDDCNYAIKRIRLPNRELAREKVMREVKALAKLEHPGIVRYFNAWLEAPPEKWQEKMDEIWLKDESTDWPLSSPSPMDAPSVKIRRMDPFATKEHIEIIAPSPQRSRSFSVGISCDQTSSSESQFSPLEFSGMDHEDISESVDAAYNLQDSCLTDCDVEDGTMDGNDEGHSFELCPSEASPYVRSRERTSSSIVFEDSGCDNASSKEEPKTNRLHIGNHCANKLTAFKPTSSKSSSEATLSISPPRPTTLSLDLTKNTTEKLQPSSPKVYLYIQMQLCRKENLKDWMNGRCTIEERERSVCLHIFLQIAEAVEFLHSKGLMHRDLKPSNIFFTMDDVVKVGDFGLVTAMDQDEEEQTVLTPMPAYARHTGQVGTKLYMSPEQIHGNSYSHKVDIFSLGLILFELLYPFSTQMERVRTLTDVRNLKFPPLFTQKYPCEYVMVQDMLSPSPMERPEAINIIENAVFEDLDFPGKTVLRQRSRSLSSSGTKHSRQSNNSHSPLPSN

SEQ ID NO: 1369 - protein, 564 aa, unidentified
MSYPADDYESEAAYDPYAYPSDYDMHTGDPKQDLAYERQYEQQTYQVIPEVIKNFIQYFHKTVSDLIDQKVYELQASRVSSDVIDQKVYEIQDIYENSWTKLTERFFKNTPWPEAEAIAPQVGNDAVFLILYKELYYRHIYAKVSGGPSLEQRFESYYNYCNLFNYILNADGPAPLELPNQWLWDIIDEFIYQFQSFSQYRCKTAKKSEEEIDFLRSNPKIWNVHSVLNVLHSLVDKSNINRQLEVYTSGGDPESVAGEYGRHSLYKMLGYFSLVGLLRLHSLLGDYYQAIKVLENIELNKKSMYSRVPECQVTTYYYVGFAYLMMRRYQDAIRVFANILLYIQRTKSMFQRTTYKYEMINKQNEQMHALLAIALTMYPMRIDESIHLQLREKYGDKMLRMQKGDPQVYEELFSYSCPKFLSPVVPNYDNVHPNYHKEPFLQQLKVFSDEVQQQAQLSTIRSFLKLYTTMPVAKLAGFLDLTEQEFRIQLLVFKHKMKNLVWTSGISALDGEFQSASEVDFYIDKDMIHIADTKVARRYGDFFIRQIHKFEELNRTLKKMGQRP

SEQ ID NO: 1370 - protein, 828 aa, unidentified
MAGRGWGALWVCVAAATLLHAGGLARADCWLIEGDKGFVWLAICSQNQPPYEAIPQQINSTIVDLRLNENRIRSVQYASLSRFGNLTYLNLTKNEIGYIEDGAFSGQFNLQVLQLGYNRLRNLTEGMLRGLGKLEYLYLQANLIEVVMASSFWECPNIVNIDLSMNRIQQLNSGTFAGLAKLSVCELYSNPFYCSCELLGFLRWLAAFTNATQTYDRMQCESPPVYSGYYLLGQGRRGHRSILSKLQSVCTEDSYAAEVVGPPRPASGRSQPGRSPPPPPPPEPSDMPCADDECFSGDGTTPLVALPTLATQAEARPLIKVKQLTQNSATITVQLPSPFHRMYTLEHFNNSKASTVSRLTKAQEEIRLTNLFTLTNYTYCVVSTSAGLRHNHTCLTICLPRLPSPPGPVPSPSTATHYIMTILGCLFGMVLVLGAVYYCLRRRRRQEEKHKKAASAAAAGSLKKTIIELKYGPELEAPGLAPLSQGPLLGPEAVTRIPYLPAAGEVEQYKLVESADTPKASKGSYMEVRTGDPPERRDCELGRPGPDSQSSVAEISTIAKEVDKVNQIINNCIDALKSESTSFQGVKSGPVSVAEPPLVLLSEPLAAKHGFLAPGYKDAFGHSLQRHHSVEAAGPPRASTSSSGSVRSPRAFRAEAVGVHKAAAAEAKYIEKGSPAADAILTVTPAAAVLRAEAEKGRQYGEHRHSYPGSHPAEPPAPPGPPPPPPHEGLGRKASILEPLTRPRPRDLAYSQLSPQYHSLSYSSSPEYTCRASQSIWERFRLSRRRHKEEEEFMAAGHALRKKVQFAKDEDLHDILDYWKGVSAQHKS

SEQ ID NO: 1371 - protein, 820 aa, unidentified
MLRLGLCAAALLCVCRPGAVRADCWLIEGDKGYVWLAICSQNQPPYETIPQHINSTVHDLRLNENKLKAVLYSSLNRFGNLTDLNLTKNEISYIEDGAFLGQSSLQVLQLGYNKLSNLTEGMLRGMSRLQFLFVQHNLIEVVTPTAFSECPSLISIDLSSNRLSRLDGATFASLASLMVCELAGNPFNCECDLFGFLAWLVVFNNVTKNYDRLQCESPREFAGYPLLVPRPYHSLNAITVLQAKCRNGSLPARPVSHPTPYSTDAQREPDENSGFNPDEILSVEPPASSTTDASAGPAIKLHHVTFTSATLVVIIPHPYSKMYILVQYNNSYFSDVMTLKNKKEIVTLDKLRAHTEYTFCVTSLRNSRRFNHTCLTFTTRDPVPGDLAPSTSTTTHYIMTILGCLFGMVIVLGAVYYCLRKRRMQEEKQKSVNVKKTILEMRYGADVDAGSIVHAAQKLGEPPVLPVSRMASIPSMIGEKLPTAKGLEAGLDTPKVATKGNYIEVRTGAGGDGLARPEDDLPDLENGQGSAAEISTIAKEVDKVNQIINNCIDALKLDSASFLGGGSSSGDPELAFECQSLPAAAAASSATGPGALERPSFLSPPYKESSHHPLQRQLSADAAVTRKTCSVSSSGSIKSAKVFSLDVPDHPAATGLAKGDSKYIEKGSPLNSPLDRLPLVPAGSGGGSGGGGGIHHLEVKPAYHCSEHRHSFPALYYEEGADSLSQRVSFLKPLTRSKRDSTYSQLSPRHYYSGYSSSPEYSSESTHKIWERFRPYKKHHREEVYMAAGHALRKKVQFAKDEDLHDILDYWKGVSAQQKL

SEQ ID NO: 1372 - protein, 334 aa, unidentified
MKHFLRMLIQVCLYFYCKFLWRCLKFVMRKLTGRCELQRICYNTKPGASRTMKIETSLRDSKSKLLQTSVSVHPDAIEKTIEDIMELKKINPDVNPQLGISLQACLLQIVGYRNLIADVEKLRREAYDSDNPQHEEMLLKLWKFLKPNTPLESRISKQWCEIGFQGDDPKTDFRGMGLLGLYNLQYFAERDATAAQQVLSDSLHPKCRDITKEEISKFSKAEWEKKRMDKAIGYSFAIVGINITDLAYNLLVSGALKTHFYNIAPEAPTLSHFQQTFCYLMHEFHKFWIEEDPMDIMEFNRVREKFRKRIIKQLQNPDMALCPHFAASEGLINM

SEQ ID NO: 1373 - protein, 279 aa, unidentified
MEAVVNLYQEVMKHADPRIQGYPLMGSPLLMTSILLTYVYFVLSLGPRIMANRKPFQLRGFMIVYNFSLVALSLYIVYEFLMSGWLSTYTWRCDPVDYSNSPEALRMVRVAWLFLFSKFIELMDTVIFILRKKDGQVTFLHVFHHSVLPWSWWWGVKIAPGGMGSFHAMINSSVHVIMYLYYGLSAFGPVAQPYLWWKKHMTAIQLIQFVLVSLHISQYYFMSSCNYQYPVIIHLIWMYGTIFFMLFSNFWYHSYTKGKRLPRALQQNGAPGIAKVKAN

SEQ ID NO: 1374 - protein, 296 aa, unidentified
MEHLKAFDDEINAFLDNMFGPRDSRVRGWFMLDSYLPTFFLTVMYLLSIWLGNKYMKNRPALSLRGILTLYNLGITLLSAYMLAELILSTWEGGYNLQCQDLTSAGEADIRVAKVLWWYYFSKSVEFLDTIFFVLRKKTSQITFLHVYHHASMFNIWWCVLNWIPCGQSFFGPTLNSFIHILMYSYYGLSVFPSMHKYLWWKKYLTQAQLVQFVLTITHTMSAVVKPCGFPFGCLIFQSSYMLTLVILFLNFYVQTYRKKPMKKDMQEPPAGKEVKNGFSKAYFTAANGVMNKKAQ

SEQ ID NO: 1375 - protein, 270 aa, unidentified
MVTAMNVSHEVNQLFQPYNFELSKDMRPFFEEYWATSFPIALIYLVLIAVGQNYMKERKGFNLQGPLILWSFCLAIFSILGAVRMWGIMGTVLLTGGLKQTVCFINFIDNSTVKFWSWVFLLSKVIELGDTAFIILRKRPLIFIHWYHHSTVLVYTSFGYKNKVPAGGWFVTMNFGVHAIMYTYYTLKAANVKPPKMLPMLITSLQILQMFVGAIVSILTYIWRQDQGCHTTMEHLFWSFILYMTYFILFAHFFCQTYIRPKVKAKTKSQ

SEQ ID NO: 1376 - protein, 314 aa, unidentified
MGLLDSEPGSVLNVVSTALNDTVEFYRWTWSIADKRVENWPLMQSPWPTLSISTLYLLFVWLGPKWMKDREPFQMRLVLIIYNFGMVLLNLFIFRELFMGSYNAGYSYICQSVDYSNNVHEVRIAAALWWYFVSKGVEYLDTVFFILRKKNNQVSFLHVYHHCTMFTLWWIGIKWVAGGQAFFGAQLNSFIHVIMYSYYGLTAFGPWIQKYLWWKRYLTMLQLIQFHVTIGHTALSLYTDCPFPKWMHWALIAYAISFIFLFLNFYIRTYKEPKKPKAGKTAMNGISANGVSKSEKQLMIENGKKQKNGKAKGD

SEQ ID NO: 1377 - protein, 299 aa, unidentified
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 1378 - protein, 265 aa, unidentified
MNMSVLTLQEYEFEKQFNENEAIQWMQENWKKSFLFSALYAAFIFGGRHLMNKRAKFELRKPLVLWSLTLAVFSIFGALRTGAYMVYILMTKGLKQSVCDQGFYNGPVSKFWAYAFVLSKAPELGDTIFIILRKQKLIFLHWYHHITVLLYSWYSYKDMVAGGGWFMTMNYGVHAVMYSYYALRAAGFRVSRKFAMFITLSQITQMLMGCVVNYLVFCWMQHDQCHSHFQNIFWSSLMYLSYLVLFCHFFFEAYIGKMRKTTKAE

SEQ ID NO: 1379 - protein, 281 aa, unidentified
MAFSDLTSRTVHLYDNWIKDADPRVEDWLLMSSPLPQTILLGFYVYFVTSLGPKLMENRKPFELKKAMITYNFFIVLFSVYMCYEFVMSGWGIGYSFRCDIVDYSRSPTALRMARTCWLYYFSKFIELLDTIFFVLRKKNSQVTFLHVFHHTIMPWTWWFGVKFAAGGLGTFHALLNTAVHVVMYSYYGLSALGPAYQKYLWWKKYLTSLQLVQFVIVAIHISQFFFMEDCKYQFPVFACIIMSYSFMFLLLFLHFWYRAYTKGQRLPKTVKNGTCKNKDN

SEQ ID NO: 1380 - protein, 266 aa, unidentified
MFVELNNLLNTTPDRAEQGKLTLLCDAKTDGSFLVHHFLSFYLKANCKVCFVALIQSFSHYSIVGQKLGVSLTMARERGQLVFLEGLKSAVDVVFQAQKEPHPLQFLREANAGNLKPLFEFVREALKPVDSGEARWTYPVLLVDDLSVLLSLGMGAVAVLDFIHYCRATVCWELKGNMVVLVHDSGDAEDEENDILLNGLSHQSHLILRAEGLATGFCRDVHGQLRILWRRPSQPAVHRDQSFTYQYKIQDKSVSFFAKGMSPAVL

SEQ ID NO: 1381 - protein, 993 aa, unidentified
MAAEWASRFWLWATLLIPAAAVYEDQVGKFDWRQQYVGKVKFASLEFSPGSKKLVVATEKNVIAALNSRTGEILWRHVDKGTAEGAVDAMLLHGQDVITVSNGGRIMRSWETNIGGLNWEITLDSGSFQALGLVGLQESVRYIAVLKKTTLALHHLSSGHLKWVEHLPESDSIHYQMVYSYGSGVVWALGVVPFSHVNIVKFNVEDGEIVQQVRVSTPWLQHLSGACGVVDEAVLVCPDPSSRSLQTLALETEWELRQIPLQSLDLEFGSGFQPRVLPTQPNPVDASRAQFFLHLSPSHYALLQYHYGTLSLLKNFPQTALVSFATTGEKTVAAVMACRNEVQKSSSSEDGSMGSFSEKSSSKDSLACFNQTYTINLYLVETGRRLLDTTITFSLEQSGTRPERLYIQVFLKKDDSVGYRALVQTEDHLLLFLQQLAGKVVLWSREESLAEVVCLEMVDLPLTGAQAELEGEFGKKADGLLGMFLKRLSSQLILLQAWTSHLWKMFYDARKPRSQIKNEINIDTLARDEFNLQKMMVMVTASGKLFGIESSSGTILWKQYLPNVKPDSSFKLMVQRTTAHFPHPPQCTLLVKDKESGMSSLYVFNPIFGKWSQVAPPVLKRPILQSLLLPVMDQDYAKVLLLIDDEYKVTAFPATRNVLRQLHELAPSIFFYLVDAEQGRLCGYRLRKDLTTELSWELTIPPEVQRIVKVKGKRSSEHVHSQGRVMGDRSVLYKSLNPNLLAVVTESTDAHHERTFIGIFLIDGVTGRIIHSSVQKKAKGPVHIVHSENWVVYQYWNTKARRNEFTVLELYEGTEQYNATAFSSLDRPQLPQVLQQSYIFPSSISAMEATITERGITSRHLLIGLPSGAILSLPKALLDPRRPEIPTEQSREENLIPYSPDVQIHAERFINYNQTVSRMRGIYTAPSGLESTCLVVAYGLDIYQTRVYPSKQFDVLKDDYDYVLISSVLFGLVFATMITKRLAQVKLLNRAWR

SEQ ID NO: 1382 - protein, 262 aa, unidentified
MAAASAGATRLLLLLLMAVAAPSRARGSGCRAGTGARGAGAEGREGEACGTVGLLLEHSFEIDDSANFRKRGSLLWNQQDGTLSLSQRQLSEEERGRLRDVAALNGLYRVRIPRRPGALDGLEAGGYVSSFVPACSLVESHLSDQLTLHVDVAGNVVGVSVVTHPGGCRGHEVEDVDLELFNTSVQLQPPTTAPGPETAAFIERLEMEQAQKAKNPQEQKSFFAKYWMYIIPVVLFLMMSGAPDTGGQGGGGGGGGGGGSGR

SEQ ID NO: 1383 - protein, 261 aa, unidentified
MAGPELLLDSNIRLWVVLPIVIITFFVGMIRHYVSILLQSDKKLTQEQVSDSQVLIRSRVLRENGKYIPKQSFLTRKYYFNNPEDGFFKKTKRKVVPPSPMTDPTMLTDMMKGNVTNVLPMILIGGWINMTFSGFVTTKVPFPLTLRFKPMLQQGIELLTLDASWVSSASWYFLNVFGLRSIYSLILGQDNAADQSRMMQEQMTGAAMAMPADTNKAFKTEWEALELTDHQWALDDVEEELMAKDLHFEGMFKKELQTSIF

SEQ ID NO: 1384 - protein, 183 aa, unidentified
MTAQGGLVANRGRRFKWAIELSGPGGGSRGRSDRGSGQGDSLYPVGYLDKQVPDTSVQETDRILVEKRCWDIALGPLKQIPMNLFIMYMAGNTISIFPTMMVCMMAWRPIQALMAISATFKMLESSSQKFLQGLVYLIGNLMGLALAVYKCQSMGLLPTHASDWLAFIEPPERMEFSGGGLLL

SEQ ID NO: 1385 - protein, 110 aa, unidentified
MAAVVAKREGPPFISEAAVRGNAAVLDYCRTSVSALSGATAGILGLTGLYGFIFYLLASVLLSLLLILKAGRRWNKYFKSRRPLFTGGLIGGLFTYVLFWTFLYGMVHVY

SEQ ID NO: 1386 - protein, 242 aa, unidentified
MAAALWGFFPVLLLLLLSGDVQSSEVPGAAAEGSGGSGVGIGDRFKIEGRAVVPGVKPQDWISAARVLVDGEEHVGFLKTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 1387 - protein, 261 aa, unidentified
MELLQVTILFLLPSICSSNSTGVLEAANNSLVVTTTKPSITTPNTESLQKNVVTPTTGTTPKGTITNELLKMSLMSTATFLTSKDEGLKATTTDVRKNDSIISNVTVTSVTLPNAVSTLQSSKPKTETQSSIKTTEIPGSVLQPDASPSKTGTLTSIPVTIPENTSQSQVIGTEGGKNASTSATSRSYSSIILPVVIALIVITLSVFVLVGLYRMCWKADPGTPENGNDQPQSDKESVKLLTVKTISHESGEHSAQGKTKN

SEQ ID NO: 1388 - protein, 254 aa, unidentified
MDNYADLSDTELTTLLRRYNIPHGPVVGSTRRLYEKKIFEYETQRRRLSPPSSSAASSYSFSDLNSTRGDADMYDLPKKEDALLYQSKGYNDDYYEESYFTTRTYGEPESAGPSRAVRQSVTSFPDADAFHHQVHDDDLLSSSEEECKDRERPMYGRDSAYQSITHYRPVSASRSSLDLSYYPTSSSTSFMSSSSSSSSWLTRRAIRPENRAPGAGLGQDRQVPLWGQLLLFLVFVIVLFFIYHFMQAEEGNPF

SEQ ID NO: 1389 - protein, 157 aa, unidentified
MLVLLAGIFVVHIATVIMLFVSTIANVWLVSNTVDASVGLWKNCTNISCSDSLSYASEDALKTVQAFMILSIIFCVIALLVFVFQLFTMEKGNRFFLSGATTLVCWLCILVGVSIYTSHYANRDGTQYHHGYSYILGWICFCFSFIIGVLYLVLRKK

SEQ ID NO: 1390 - protein, 167 aa, unidentified
MLVLLAFIIAFHITSAALLFIATVDNAWWVGDEFFADVWRICTNNTNCTVINDSFQEYSTLQAVQATMILSTILCCIAFFIFVLQLFRLKQGERFVLTSIIQLMSCLCVMIAASIYTDRREDIHDKNAKFYPVTREGSYGYSYILAWVAFACTFISGMMYLILRKRK

SEQ ID NO: 1391 - protein, 163 aa, unidentified
MSLLLLVVSALHILILILLFVATLDKSWWTLPGKESLNLWYDCTWNNDTKTWACSNVSENGWLKAVQVLMVLSLILCCLSFILFMFQLYTMRRGGLFYATGLCQLCTSVAVFTGALIYAIHAEEILEKHPRGGSFGYCFALAWVAFPLALVSGIIYIHLRKRE

SEQ ID NO: 1392 - protein, 500 aa, unidentified
MGTARWLALGSLFALAGLLEGRLVGEEEAGFGECDKFFYAGTPPAGLAADSHVKICQRAEGAERFATLYSTRDRIPVYSAFRAPRPAPGGAEQRWLVEPQIDDPNSNLEEAINEAEAITSVNSLGSKQALNTDYLDSDYQRGQLYPFSLSSDVQVATFTLTNSAPMTQSFQERWYVNLHSLMDRALTPQCGSGEDLYILTGTVPSDYRVKDKVAVPEFVWLAACCAVPGGGWAMGFVKHTRDSDIIEDVMVKDLQKLLPFNPQLFQNNCGETEQDTEKMKKILEVVNQIQDEERMVQSQKSSSPLSSTRSKRSTLLPPEASEGSSSFLGKLMGFIATPFIKLFQLIYYLVVAILKNIVYFLWCVTKQVINGIESCLYRLGSATISYFMAIGEELVSIPWKVLKVVAKVIRALLRILCCLLKAICRVLSIPVRVLVDVATFPVYTMGAIPIVCKDIALGLGGTVSLLFDTAFGTLGGLFQVVFSVCKRIGYKVTFDNSGEL

SEQ ID NO: 1393 - protein, 658 aa, unidentified
MDRGTLPLAVALLLASCSLSPTSLAETVHCDLQPVGPERGEVTYTTSQVSKGCVAQAPNAILEVHVLFLEFPTGPSQLELTLQASKQNGTWPREVLLVLSVNSSVFLHLQALGIPLHLAYNSSLVTFQEPPGVNTTELPSFPKTQILEWAAERGPITSAAELNDPQSILLRLGQAQGSLSFCMLEASQDMGRTLEWRPRTPALVRGCHLEGVAGHKEAHILRVLPGHSAGPRTVTVKVELSCAPGDLDAVLILQGPPYVSWLIDANHNMQIWTTGEYSFKIFPEKNIRGFKLPDTPQGLLGEARMLNASIVASFVELPLASIVSLHASSCGGRLQTSPAPIQTTPPKDTCSPELLMSLIQTKCADDAMTLVLKKELVAHLKCTITGLTFWDPSCEAEDRGDKFVLRSAYSSCGMQVSASMISNEAVVNILSSSSPQRKKVHCLNMDSLSFQLGLYLSPHFLQASNTIEPGQQSFVQVRVSPSVSEFLLQLDSCHLDLGPEGGTVELIQGRAAKGNCVSLLSPSPEGDPRFSFLLHFYTVPIPKTGTLSCTVALRPKTGSQDQEVHRTVFMRLNIISPDLSGCTSKGLVLPAVLGITFGAFLIGALLTAALWYIYSHTRSPSKREPVVAVAAPASSESSSTNHSIGSTQSTPCSTSSMA

SEQ ID NO: 1394 - protein, 957 aa, unidentified
MNFAEREGSKRYCIQTKHVAILCAVVVGVGLIVGLAVGLTRSCDSSGDGGPGTAPAPSHLPSSTASPSGPPAQDQDICPASEDESGQWKNFRLPDFVNPVHYDLHVKPLLEEDTYTGTVSISINLSAPTRYLWLHLRETRITRLPELKRPSGDQVQVRRCFEYKKQEYVVVEAEEELTPSSGDGLYLLTMEFAGWLNGSLVGFYRTTYTENGQVKSIVATDHEPTDARKSFPCFDEPNKKATYTISITHPKEYGALSNMPVAKEESVDDKWTRTTFEKSVPMSTYLVCFAVHQFDSVKRISNSGKPLTIYVQPEQKHTAEYAANITKSVFDYFEEYFAMNYSLPKLDKIAIPDFGTGAMENWGLITYRETNLLYDPKESASSNQQRVATVVAHELVHQWFGNIVTMDWWEDLWLNEGFASFFEFLGVNHAETDWQMRDQMLLEDVLPVQEDDSLMSSHPIIVTVTTPDEITSVFDGISYSKGSSILRMLEDWIKPENFQKGCQMYLEKYQFKNAKTSDFWAALEEASRLPVKEVMDTWTRQMGYPVLNVNGVKNITQKRFLLDPRANPSQPPSDLGYTWNIPVKWTEDNITSSVLFNRSEKEGITLNSSNPSGNAFLKINPDHIGFYRVNYEVATWDSIATALSLNHKTFSSADRASLIDDAFALARAQLLDYKVALNLTKYLKREENFLPWQRVISAVTYIISMFEDDKELYPMIEEYFQGQVKPIADSLGWNDAGDHVTKLLRSSVLGFACKMGDREALNNASSLFEQWLNGTVSLPVNLRLLVYRYGMQNSGNEISWNYTLEQYQKTSLAQEKEKLLYGLASVKNVTLLSRYLDLLKDTNLIKTQDVFTVIRYISYNSYGKNMAWNWIQLNWDYLVNRYTLNNRNLGRIVTIAEPFNTELQLWQMESFFAKYPQAGAGEKPREQVLETVKNNIEWLKQHRNTIREWFFNLLESG

SEQ ID NO: 1395 - protein, 925 aa, unidentified
MERDGCAGGGSRGGEGGRAPREGPAGNGRDRGRSHAAEAPGDPQAAASLLAPMDVGEEPLEKAARARTAKDPNTYKVLSLVLSVCVLTTILGCIFGLKPSCAKEVKSCKGRCFERTFGNCRCDAACVELGNCCLDYQETCIEPEHIWTCNKFRCGEKRLTRSLCACSDDCKDKGDCCINYSSVCQGEKSWVEEPCESINEPQCPAGFETPPTLLFSLDGFRAEYLHTWGGLLPVISKLKKCGTYTKNMRPVYPTKTFPNHYSIVTGLYPESHGIIDNKMYDPKMNASFSLKSKEKFNPEWYKGEPIWVTAKYQGLKSGTFFWPGSDVEINGIFPDIYKMYNGSVPFEERILAVLQWLQLPKDERPHFYTLYLEEPDSSGHSYGPVSSEVIKALQRVDGMVGMLMDGLKELNLHRCLNLILISDHGMEQGSCKKYIYLNKYLGDVKNIKVIYGPAARLRPSDVPDKYYSFNYEGIARNLSCREPNQHFKPYLKHFLPKRLHFAKSDRIEPLTFYLDPQWQLALNPSERKYCGSGFHGSDNVFSNMQALFVGYGPGFKHGIEADTFENIEVYNLMCDLLNLTPAPNNGTHGSLNHLLKNPVYTPKHPKEVHPLVQCPFTRNPRDNLGCSCNPSILPIEDFQTQFNLTVAEEKIIKHETLPYGRPRVLQKENTICLLSQHQFMSGYSQDILMPLWTSYTVDRNDSFSTEDFSNCLYQDFRIPLSPVHKCSFYKNNTKVSYGFLSPPQLNKNSSGIYSEALLTTNIVPMYQSFQVIWRYFHDTLLRKYAEERNGVNVVSGPVFDFDYDGRCDSLENLRQKRRVIRNQEILIPTHFFIVLTSCKDTSQTPLHCENLDTLAFILPHRTDNSESCVHGKHDSSWVEELLMLHRARITDVEHITGLSFYQQRKEPVSDILKLKTHLPTFSQED

SEQ ID NO: 1396 - protein, 863 aa, unidentified
MARRSSFQSCQIISLFTFAVGVNICLGFTAHRIKRAEGWEEGPPTVLSDSPWTNISGSCKGRCFELQEAGPPDCRCDNLCKSYTSCCHDFDELCLKTARGWECTKDRCGEVRNEENACHCSEDCLARGDCCTNYQVVCKGESHWVDDDCEEIKAAECPAGFVRPPLIIFSVDGFRASYMKKGSKVMPNIEKLRSCGTHSPYMRPVYPTKTFPNLYTLATGLYPESHGIVGNSMYDPVFDATFHLRGREKFNHRWWGGQPLWITATKQGVKAGTFFWSVVIPHERRILTILQWLTLPDHERPSVYAFYSEQPDFSGHKYGPFGPEMTNPLREIDKIVGQLMDGLKQLKLHRCVNVIFVGDHGMEDVTCDRTEFLSNYLTNVDDITLVPGTLGRIRSKFSNNAKYDPKAIIANLTCKKPDQHFKPYLKQHLPKRLHYANNRRIEDIHLLVERRWHVARKPLDVYKKPSGKCFFQGDHGFDNKVNSMQTVFVGYGSTFKYKTKVPPFENIELYNVMCDLLGLKPAPNNGTHGSLNHLLRTNTFRPTMPEEVTRPNYPGIMYLQSDFDLGCTCDDKVEPKNKLDELNKRLHTKGSTEERHLLYGRPAVLYRTRYDILYHTDFESGYSEIFLMPLWTSYTVSKQAEVSSVPDHLTSCVRPDVRVSPSFSQNCLAYKNDKQMSYGFLFPPYLSSSPEAKYDAFLVTNMVPMYPAFKRVWNYFQRVLVKKYASERNGVNVISGPIFDYDYDGLHDTEDKIKQYVEGSSIPVPTHYYSIITSCLDFTQPADKCDGPLSVSSFILPHRPDNEESCNSSEDESKWVEELMKMHTARVRDIEHLTSLDFFRKTSRSYPEILTLKTYLHTYESEI

SEQ ID NO: 1397 - protein, 453 aa, unidentified
MKLLVILLFSGLITGFRSDSSSSLPPKLLLVSFDGFRADYLKNYEFPHLQNFIKEGVLVEHVKNVFITKTFPNHYSIVTGLYEESHGIVANSMYDAVTKKHFSDSNDKDPFWWNEAVPIWVTNQLQENRSSAAAMWPGTDVPIHDTISSYFMNYNSSVSFEERLNNITMWLNNSNPPVTFATLYWEEPDASGHKYGPEDKENMSRVLKKIDDLIGDLVQRLKMLGLWENLNVIITSDHGMTQCSQDRLINLDSCIDHSYYTLIDLSPVAAILPKINRTEVYNKLKNCSPHMNVYLKEDIPNRFYYQHNDRIQPIILVADEGWTIVLNESSQKLGDHGYDNSLPSMHPFLAAHGPAFHKGYKHSTINIVDIYPMMCHILGLKPHPNNGTFGHTKCLLVDQWCINLPEAIAIVIGSLLVLTMLTCLIIIMQNRLSVPRPFSRLQLQEDDDDPLIG

SEQ ID NO: 1398 - protein, 477 aa, unidentified
MTSKFLLVSFILAALSLSTTFSLQPDQQKVLLVSFDGFRWDYLYKVPTPHFHYIMKYGVHVKQVTNVFITKTYPNHYTLVTGLFAENHGIVANDMFDPIRNKSFSLDHMNIYDSKFWEEATPIWITNQRAGHTSGAAMWPGTDVKIHKRFPTHYMPYNESVSFEDRVAKIIEWFTSKEPINLGLLYWEDPDDMGHHLGPDSPLMGPVISDIDKKLGYLIQMLKKAKLWNTLNLIITSDHGMTQCSEERLIELDQYLDKDHYTLIDQSPVAAILPKEGKFDEVYEALTHAHPNLTVYKKEDVPERWHYKYNSRIQPIIAVADEGWHILQNKSDDFLLGNHGYDNALADMHPIFLAHGPAFRKNFSKEAMNSTDLYPLLCHLLNITAMPHNGSFWNVQDLLNSAMPRVVPYTQSTILLPGSVKPAEYDQEGSYPYFIGVSLGSIIVIVFFVIFIKHLIHSQIPALQDMHAEIAQPLLQA

SEQ ID NO: 1399 - protein, 510 aa, unidentified
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 1400 - protein, 495 aa, unidentified
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 1401 - protein, 529 aa, unidentified
MFTVLTRQPCEQAGLKALYRTPTIIALVVLLVSIVVLVSITVIQIHKQEVLPPGLKYGIVLDAGSSRTTVYVYQWPAEKENNTGVVSQTFKCSVKGSGISSYGNNPQDVPRAFEECMQKVKGQVPSHLHGSTPIHLGATAGMRLLRLQNETAANEVLESIQSYFKSQPFDFRGAQIISGQEEGVYGWITANYLMGNFLEKNLWHMWVHPHGVETTGALDLGGASTQISFVAGEKMDLNTSDIMQVSLYGYVYTLYTHSFQCYGRNEAEKKFLAMLLQNSPTKNHLTNPCYPRDYSISFTMGHVFDSLCTVDQRPESYNPNDVITFEGTGDPSLCKEKVASIFDFKACHDQETCSFDGVYQPKIKGPFVAFAGFYYTASALNLSGSFSLDTFNSSTWNFCSQNWSQLPLLLPKFDEVYARSYCFSANYIYHLFVNGYKFTEETWPQIHFEKEVGNSSIAWSLGYMLSLTNQIPAESPLIRLPIEPPVFVGTLAFFTAAALLCLAFLAYLCSATRRKRHSEHAFDHAVDSD

SEQ ID NO: 1402 - protein, 616 aa, unidentified
MGRIGISCLFPASWHFSISPVGCPRILNTNLRQIMVISVLAAAVSLLYFSVVIIRNKYGRLTRDKKFQRYLARVTDIEATDTNNPNVNYGIVVDCGSSGSRVFVYCWPRHNGNPHDLLDIRQMRDKNRKPVVMKIKPGISEFATSPEKVSDYISPLLNFAAEHVPRAKHKETPLYILCTAGMRILPESQQKAILEDLLTDIPVHFDFLFSDSHAEVISGKQEGVYAWIGINFVLGRFEHIEDDDEAVVEVNIPGSESSEAIVRKRTAGILDMGGVSTQIAYEVPKTVSFASSQQEEVAKNLLAEFNLGCDVHQTEHVYRVYVATFLGFGGNAARQRYEDRIFANTIQKNRLLGKQTGLTPDMPYLDPCLPLDIKDEIQQNGQTIYLRGTGDFDLCRETIQPFMNKTNETQTSLNGVYQPPIHFQNSEFYGFSEFYYCTEDVLRMGGDYNAAKFTKAAKDYCATKWSILRERFDRGLYASHADLHRLKYQCFKSAWMFEVFHRGFSFPVNYKSLKTALQVYDKEVQWTLGAILYRTRFLPLRDIQQEAFRASHTHWRGVSFVYNHYLFSGCFLVVLLAILLYLLRLRRIHRRTPRSSSAAALWMEEGLPAQNAPGTL

SEQ ID NO: 1403 - protein, 484 aa, unidentified
MKKGIRYETSRKTSYIFQQPQHGPWQTRMRKISNHGSLRVAKVAYPLGLCVGVFIYVAYIKWHRATATQAFFSITRAAPGARWGQQAHSPLGTAADGHEVFYGIMFDAGSTGTRVHVFQFTRPPRETPTLTHETFKALKPGLSAYADDVEKSAQGIRELLDVAKQDIPFDFWKATPLVLKATAGLRLLPGEKAQKLLQKVKKVFKASPFLVGDDCVSIMNGTDEGVSAWITINFLTGSLKTPGGSSVGMLDLGGGSTQIAFLPRVEGTLQASPPGYLTALRMFNRTYKLYSYSYLGLGLMSARLAILGGVEGQPAKDGKELVSPCLSPSFKGEWEHAEVTYRVSGQKAAASLHELCAARVSEVLQNRVHRTEEVKHVDFYAFSYYYDLAAGVGLIDAEKGGSLVVGDFEIAAKYVCRTLETQPQSSPFSCMDLTYVSLLLQEFGFPRSKVLKLTRKIDNVETSWALGAIFHYIDSLNRQKSPAS

SEQ ID NO: 1404 - protein, 604 aa, unidentified
MARISFSYLCPASWYFTVPTVSPFLRQRVAFLGLFFISCLLLLMLIIDFRHWSASLPRDRQYERYLARVGELEATDTEDPNLNYGLVVDCGSSGSRIFVYFWPRHNGNPHDLLDIKQMRDRNSQPVVKKIKPGISAMADTPEHASDYLRPLLSFAAAHVPVKKHKETPLYILCTAGMRLLPERKQLAILADLVKDLPLEFDFLFSQSQAEVISGKQEGVYAWIGINFVLGRFDHEDESDAEATQELAAGRRRTVGILDMGGASLQIAYEVPTSTSVLPAKQEEAAKILLAEFNLGCDVQHTEHVYRVYVTTFLGFGGNFARQRYEDLVLNETLNKNRLLGQKTGLSPDNPFLDPCLPVGLTDVVERNSQVLHVRGRGDWVSCGAMLSPLLARSNTSQASLNGIYQSPIDFNNSEFYGFSEFFYCTEDVLRIGGRYHGPTFAKAAQDYCGMAWSVLTQRFKNGLFSSHADEHRLKYQCFKSAWMYQVLHEGFHFPYDYPNLRTAQLVYDREVQWTLGAILYKTRFLPLRDLRQEGVRQAHGSWFRLSFVYNHYLFFACILVVLLAIFLYLLRLRRIHHRQTRASAPLDLLWLEEVVPMMGVQVGP

SEQ ID NO: 1405 - protein, 495 aa, unidentified
MGLSRKEQVFLALLGASGVSGLTALILLLVEATSVLLPTDIKFGIVFDAGSSHTSLFLYQWLANKENGTGVVSQALACQVEGPGISSYTSNAAQAGESLQGCLEEALVLIPEAQHRKTPTFLGATAGMRLLSRKNSSQARDIFAAVTQVLGRSPVDFWGAELLAGQAEGAFGWITVNYGLGTLVKYSFTGEWIQPPEEMLVGALDMGGASTQITFVPGGPILDKSTQADFRLYGSDYSVYTHSYLCFGRDQMLSRLLVGLVQSRPAALLRHPCYLSGYQTTLALGPLYESPCVHATPPLSLPQNLTVEGTGNPGACVSAIRELFNFSSCQGQEDCAFDGVYQPPLRGQFYAFSNFYYTFHFLNLTSRQPLSTVNATIWEFCQRPWKLVEASYPGQDRWLRDYCASGLYILTLLHEGYGFSEETWPSLEFRKQAGGVDIGWTLGYMLNLTGMIPADAPAQWRAESYGVWVAKVVFMVLALVAVVGAALVQLFWLQD

SEQ ID NO: 1406 - protein, 527 aa, unidentified
MLMLFVFGVLLHEVSLSGQNEAPPNTHSIPGEPLYNYASIRLPEEHIPFFLHNNRHIATVCRKDSLCPYKKHLEKLKYCWGYEKSCKPEFRFGYPVCSYVDMGWTDTLESAEDIFWKQADFGYARERLEEMHVLCQPKETSDSSLVCSRYLQYCRATNLYLDLRNIKRNHDRFKEDFFQSGEIGGHCKLDIRTLTSEGQRKSPLQSWFAELQSYTQLNFRPIEDAKCDIVIEKPTYFMKLDAGVNMYHHFCDFINLYITQHVNNSFSTDVYIVMWDTSSYGYGDLFSDTWNAFTDYDVIHLKTYDSKRVCFKEAVFSLLPRMRYGLFYNTPLISGCQNTGLFRAFAQHVLHRLNITQEGPKDGKIRVTILARSTEYRKILNQNELVNALKTVSTFEVQIVDYKYRELGFLDQLRITHNTDIFIGMHGAGLTHLLFLPDWAAVFELYNCEDERCYLDLARLRGVHYITWRRQNKVFPQDKGHHPTLGEHPKFTNYSFDVEEFMYLVLQAADHVLQHPKWPFKKKHDEL

SEQ ID NO: 1407 - protein, 864 aa, unidentified
MTTEKSLVTEAENSQHQQKEEGEEAINSGQQEPQQEESCQTAAEGDNWCEQKLKASNGDTPTHEDLTKNKERTSESRGLSRLFSSFLKRPKSQVSEEEGKEVESDKEKGEGGQKEIEFGTSLDEEIILKAPIAAPEPELKTDPSLDLHSLSSAETQPAQEELREDPDFEIKEGEGLEECSKIEVKEESPQSKAETELKASQKPIRKHRNMHCKVSLLDDTVYECVVEKHAKGQDLLKRVCEHLNLLEEDYFGLAIWDNATSKTWLDSAKEIKKQVRGVPWNFTFNVKFYPPDPAQLTEDITRYYLCLQLRQDIVAGRLPCSFATLALLGSYTIQSELGDYDPELHGVDYVSDFKLAPNQTKELEEKVMELHKSYRSMTPAQADLEFLENAKKLSMYGVDLHKAKDLEGVDIILGVCSSGLLVYKDKLRINRFPWPKVLKISYKRSSFFIKIRPGEQEQYESTIGFKLPSYRAAKKLWKVCVEHHTFFRLTSTDTIPKSKFLALGSKFRYSGRTQAQTRQASALIDRPAPHFERTASKRASRSLDGAAAVDSADRSPRPTSAPAITQGQVAEGGVLDASAKKTVVPKAQKETVKAEVKKEDEPPEQAEPEPTEAWKVEKTHIEVTVPTSNGDQTQKLAEKTEDLIRMRKKKRERLDGENIYIRHSNLMLEDLDKSQEEIKKHHASISELKKNFMESVPEPRPSEWDKRLSTHSPFRTLNINGQIPTGEGPPLVKTQTVTISDNANAVKSEIPTKDVPIVHTETKTITYEAAQTDDNSGDLDPGVLLTAQTITSETPSSTTTTQITKTVKGGISETRIEKRIVITGDADIDHDQVLVQAIKEAKEQHPDMSVTKVVVHQETEIADE

SEQ ID NO: 1408 - protein, 1087 aa, unidentified
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGEVGTGQYATTKGISQTNLITTVTPEKKAEEERDEEEDKRRKGEEVTPISAIRHEGKSPGLGTDSCPLSPPSTHCAPTSPTELRRRCKENDCKLPGYEPSRAEHLPGEPALDSDGPGRPYLGDQDVAFSYRQQTGKGTTLFSFSLQLPESFPSLLDDDGYLSFPNLSETNLLPQSLQHYLPIRSPSLVPCFLFIFFFLLSASFSVPYALTLSFPLALCLCYLEPKAASLSASLDNDPSDSSEEETDSERTDTAADGETTATESDQEEDAELKAQELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 1409 - protein, 314 aa, unidentified
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 1410 - protein, 154 aa, unidentified
MALGVPISVYLLFNAMTALTEEAAVTVTPPITAQQGNWTVNKTEADNIEGPIALKFSHLCLEDHNSYCINGACAFHHELEKAICRCFTGYTGERCEHLTLTSYAVDSYEKYIAIGIGVGLLLSGFLVIFYCYIRKRCLKLKSPYNVCSGERRPL

SEQ ID NO: 1411 - protein, 976 aa, unidentified
MERRWPLGLGLVLLLCAPLPPGARAKEVTLMDTSKAQGELGWLLDPPKDGWSEQQQILNGTPLYMYQDCPMQGRRDTDHWLRSNWIYRGEEASRVHVELQFTVRDCKSFPGGAGPLGCKETFNLLYMESDQDVGIQLRRPLFQKVTTVAADQSFTIRDLVSGSVKLNVERCSLGRLTRRGLYLAFHNPGACVALVSVRVFYQRCPETLNGLAQFPDTLPGPAGLVEVAGTCLPHARASPRPSGAPRMHCSPDGEWLVPVGRCHCEPGYEEGGSGEACVACPSGSYRMDMDTPHCLTCPQQSTAESEGATICTCESGHYRAPGEGPQVACTGPPSAPRNLSFSASGTQLSLRWEPPADTGGRQDVRYSVRCSQCQGTAQDGGPCQPCGVGVHFSPGARGLTTPAVHVNGLEPYANYTFNVEAQNGVSGLGSSGHASTSVSISMGHAESLSGLSLRLVKKEPRQLELTWAGSRPRSPGANLTYELHVLNQDEERYQMVLEPRVLLTELQPDTTYIVRVRMLTPLGPGPFSPDHEFRTSPPVSRGLTGGEIVAVIFGLLLGAALLLGILVFRSRRAQRQRQQRQRDRATDVDREDKLWLKPYVDLQAYEDPAQGALDFTRELDPAWLMVDTVIGEGEFGEVYRGTLRLPSQDCKTVAIKTLKDTSPGGQWWNFLREATIMGQFSHPHILHLEGVVTKRKPIMIITEFMENGALDAFLREREDQLVPGQLVAMLQGIASGMNYLSNHNYVHRDLAARNILVNQNLCCKVSDFGLTRLLDDFDGTYETQGGKIPIRWTAPEAIAHRIFTTASDVWSFGIVMWEVLSFGDKPYGEMSNQEVMKSIEDGYRLPPPVDCPAPLYELMKNCWAYDRARRPHFQKLQAHLEQLLANPHSLRTIANFDPRMTLRLPSLSGSDGIPYRTVSEWLESIRMKRYILHFHSAGLDTMECVLELTAEDLTQMGITLPGHQKRILCSIQGFKD

SEQ ID NO: 1412 - protein, 1008 aa, unidentified
METCAGPHPLRLFLCRMQLCLALLLGPWRPGTAEEVILLDSKASQAELGWTALPSNGWEEISGVDEHDRPIRTYQVCNVLEPNQDNWLQTGWISRGRGQRIFVELQFTLRDCSSIPGAAGTCKETFNVYYLETEADLGRGRPRLGGSRPRKIDTIAADESFTQGDLGERKMKLNTEVREIGPLSRRGFHLAFQDVGACVALVSVRVYYKQCRATVRGLATFPATAAESAFSTLVEVAGTCVAHSEGEPGSPPRMHCGADGEWLVPVGRCSCSAGFQERGDFCEACPPGFYKVSPRRPLCSPCPEHSRALENASTFCVCQDSYARSPTDPPSASCTRPPSAPRDLQYSLSRSPLVLRLRWLPPADSGGRSDVTYSLLCLRCGREGPAGACEPCGPRVAFLPRQAGLRERAATLLHLRPGARYTVRVAALNGVSGPAAAAGTTYAQVTVSTGPGAPWEEDEIRRDRVEPQSVSLSWREPIPAGAPGANDTEYEIRYYEKGQSEQTYSMVKTGAPTVTVTNLKPATRYVFQIRAASPGPSWEAQSFNPSIEVQTLGEAASGSRDQSPAIVVTVVTISALLVLGSVMSVLAIWRRPCSYGKGGGDAHDEEELYFHFKVPTRRTFLDPQSCGDLLQAVHLFAKELDAKSVTLERSLGGGRFGELCCGCLQLPGRQELLVAVHMLRDSASDSQRLGFLAEALTLGQFDHSHIVRLEGVVTRGSTLMIVTEYMSHGALDGFLRRHEGQLVAGQLMGLLPGLASAMKYLSEMGYVHRGLAARHVLVSSDLVCKISGFGRGPRDRSEAVYTTMSGRSPALWAAPETLQFGHFSSASDVWSFGIIMWEVMAFGERPYWDMSGQDVIKAVEDGFRLPPPRNCPNLLHRLMLDCWQKDPGERPRFSQIHSILSKMVQDPEPPKCALTTCPRPPTPLADRAFSTFPSFGSVGAWLEALDLCRYKDSFAAAGYGSLEAVAEMTAQDLVSLGISLAEHREALLSGISALQARVLQLQGQGVQV

SEQ ID NO: 1413 - protein, 976 aa, unidentified
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 1414 - protein, 983 aa, unidentified
MDCQLSILLLLSCSVLDSFGELIPQPSNEVNLLDSKTIQGELGWISYPSHGWEEISGVDEHYTPIRTYQVCNVMDHSQNNWLRTNWVPRNSAQKIYVELKFTLRDCNSIPLVLGTCKETFNLYYMESDDDHGVKFREHQFTKIDTIAADESFTQMDLGDRILKLNTEIREVGPVNKKGFYLAFQDVGACVALVSVRVYFKKCPFTVKNLAMFPDTVPMDSQSLVEVRGSCVNNSKEEDPPRMYCSTEGEWLVPIGKCSCNAGYEERGFMCQACRPGFYKALDGNMKCAKCPPHSSTQEDGSMNCRCENNYFRADKDPPSMACTRPPSSPRNVISNINETSVILDWSWPLDTGGRKDVTFNIICKKCGWNIKQCEPCSPNVRFLPRQFGLTNTTVTVTDLLAHTNYTFEIDAVNGVSELSSPPRQFAAVSITTNQAAPSPVLTIKKDRTSRNSISLSWQEPEHPNGIILDYEVKYYEKQEQETSYTILRARGTNVTISSLKPDTIYVFQIRARTAAGYGTNSRKFEFETSPDSFSISGESSQVVMIAISAAVAIILLTVVIYVLIGRFCGYKSKHGADEKRLHFGNGHLKLPGLRTYVDPHTYEDPTQAVHEFAKELDATNISIDKVVGAGEFGEVCSGRLKLPSKKEISVAIKTLKVGYTEKQRRDFLGEASIMGQFDHPNIIRLEGVVTKSKPVMIVTEYMENGSLDSFLRKHDAQFTVIQLVGMLRGIASGMKYLSDMGYVHRDLAARNILINSNLVCKVSDFGLSRVLEDDPEAAYTTRGGKIPIRWTSPEAIAYRKFTSASDVWSYGIVLWEVMSYGERPYWEMSNQDVIKAVDEGYRLPPPMDCPAALYQLMLDCWQKDRNNRPKFEQIVSILDKLIRNPGSLKIITSAAARPSNLLLDQSNVDITTFRTTGDWLNGVWTAHCKEIFTGVEYSSCDTIAKISTDDMKKVGVTVVGPQKKIISSIKALETQSKNGPVPV

SEQ ID NO: 1415 - protein, 986 aa, unidentified
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 1416 - protein, 1037 aa, unidentified
MRGSGPRGAGRRRPPSGGGDTPITPASLAGCYSAPRRAPLWTCLLLCAALRTLLASPSNEVNLLDSRTVMGDLGWIAFPKNGWEEIGEVDENYAPIHTYQVCKVMEQNQNNWLLTSWISNEGASRIFIELKFTLRDCNSLPGGLGTCKETFNMYYFESDDQNGRNIKENQYIKIDTIAADESFTELDLGDRVMKLNTEVRDVGPLSKKGFYLAFQDVGACIALVSVRVYYKKCPSVVRHLAVFPDTITGADSSQLLEVSGSCVNHSVTDEPPKMHCSAEGEWLVPIGKCMCKAGYEEKNGTCQVCRPGFFKASPHIQSCGKCPPHSYTHEEASTSCVCEKDYFRRESDPPTMACTRPPSAPRNAISNVNETSVFLEWIPPADTGGRKDVSYYIACKKCNSHAGVCEECGGHVRYLPRQSGLKNTSVMMVDLLAHTNYTFEIEAVNGVSDLSPGARQYVSVNVTTNQAAPSPVTNVKKGKIAKNSISLSWQEPDRPNGIILEYEIKYFEKDQETSYTIIKSKETTITAEGLKPASVYVFQIRARTAAGYGVFSRRFEFETTPVFAASSDQSQIPVIAVSVTVGVILLAVVIGVLLSGSCCECGCGRASSLCAVAHPSLIWRCGYSKAKQDPEEEKMHFHNGHIKLPGVRTYIDPHTYEDPNQAVHEFAKEIEASCITIERVIGAGEFGEVCSGRLKLPGKRELPVAIKTLKVGYTEKQRRDFLGEASIMGQFDHPNIIHLEGVVTKSKPVMIVTEYMENGSLDTFLKKNDGQFTVIQLVGMLRGISAGMKYLSDMGYVHRDLAARNILINSNLVCKVSDFGLSRVLEDDPEAAYTTRGGKIPIRWTAPEAIAFRKFTSASDVWSYGIVMWEVVSYGERPYWEMTNQDVIKAVEEGYRLPSPMDCPAALYQLMLDCWQKERNSRPKFDEIVNMLDKLIRNPSSLKTLVNASCRVSNLLAEHSPLGSGAYRSVGEWLEAIKMGRYTEIFMENGYSSMDAVAQVTLEDLRRLGVTLVGHQKKIMNSLQEMKVQLVNGMVPL

SEQ ID NO: 1417 - protein, 1036 aa, unidentified
MGGCEVREFLLQFGFFLPLLTAWPGDCSHVSNNQVVLLDTTTVLGELGWKTYPLNGWDAITEMDEHNRPIHTYQVCNVMEPNQNNWLRTNWISRDAAQKIYVEMKFTLRDCNSIPWVLGTCKETFNLFYMESDESHGIKFKPNQYTKIDTIAADESFTQMDLGDRILKLNTEIREVGPIERKGFYLAFQDIGACIALVSVRVFYKKCPFTVRNLAMFPDTIPRVDSSSLVEVRGSCVKSAEERDTPKLYCGADGDWLVPLGRCICSTGYEEIEGSCHACRPGFYKAFAGNTKCSKCPPHSLTYMEATSVCQCEKGYFRAEKDPPSMACTRPPSAPRNVVFNINETALILEWSPPSDTGGRKDLTYSVICKKCGLDTSQCEDCGGGLRFIPRHTGLINNSVIVLDFVSHVNYTFEIEAMNGVSELSFSPKPFTAITVTTDQDAPSLIGVVRKDWASQNSIALSWQAPAFSNGAILDYEIKYYEKEHEQLTYSSTRSKAPSVIITGLKPATKYVFHIRVRTATGYSGYSQKFEFETGDETSDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTGGKIPIRWTAPEAIAYRKFSSASDAWSYGIVMWEVMSYGERPYWEMSNQDVILSIEEGYRLPAPMGCPASLHQLMLHCWQKERNHRPKFTDIVSFLDKLIRNPSALHTLVEDILVMPESPGEVPEYPLFVTVGDWLDSIKMGQYKNNFVAAGFTTFDLISRMSIDDIRRIGVILIGHQRRIVSSIQTLRLHMMHIQEKGFHV

SEQ ID NO: 1418 - protein, 998 aa, unidentified
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 1419 - protein, 1005 aa, unidentified
MAPARGRLPPALWVVTAAAAAATCVSAARGEVNLLDTSTIHGDWGWLTYPAHGWDSINEVDESFQPIHTYQVCNVMSPNQNNWLRTSWVPRDGARRVYAEIKFTLRDCNSMPGVLGTCKETFNLYYLESDRDLGASTQESQFLKIDTIAADESFTGADLGVRRLKLNTEVRSVGPLSKRGFYLAFQDIGACLAILSLRIYYKKCPAMVRNLAAFSEAVTGADSSSLVEVRGQCVRHSEERDTPKMYCSAEGEWLVPIGKCVCSAGYEERRDACVACELGFYKSAPGDQLCARCPPHSHSAAPAAQACHCDLSYYRAALDPPSSACTRPPSAPVNLISSVNGTSVTLEWAPPLDPGGRSDITYNAVCRRCPWALSRCEACGSGTRFVPQQTSLVQASLLVANLLAHMNYSFWIEAVNGVSDLSPEPRRAAVVNITTNQAAPSQVVVIRQERAGQTSVSLLWQEPEQPNGIILEYEIKYYEKDKEMQSYSTLKAVTTRATVSGLKPGTRYVFQVRARTSAGCGRFSQAMEVETGKPRPRYDTRTIVWICLTLITGLVVLLLLLICKKRHCGYSKAFQDSDEEKMHYQNGQAPPPVFLPLHHPPGKLPEPQFYAEPHTYEEPGRAGRSFTREIEASRIHIEKIIGSGDSGEVCYGRLRVPGQRDVPVAIKALKAGYTERQRRDFLSEASIMGQFDHPNIIRLEGVVTRGRLAMIVTEYMENGSLDTFLRTHDGQFTIMQLVGMLRGVGAGMRYLSDLGYVHRDLAARNVLVDSNLVCKVSDFGLSRVLEDDPDAAYTTTGGKIPIRWTAPEAIAFRTFSSASDVWSFGVVMWEVLAYGERPYWNMTNRDVISSVEEGYRLPAPMGCPHALHQLMLDCWHKDRAQRPRFSQIVSVLDALIRSPESLRATATVSRCPPPAFVRSCFDLRGGSGGGGGLTVGDWLDSIRMGRYRDHFAAGGYSSLGMVLRMNAQDVRALGITLMGHQKKILGSIQTMRAQLTSTQGPRRHL

SEQ ID NO: 1420 - protein, 984 aa, unidentified
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 1421 - protein, 1055 aa, unidentified
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 1422 - protein, 998 aa, unidentified
MARARPPPPPSPPPGLLPLLPPLLLLPLLLLPAGCRALEETLMDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPLIVGSATAGLVFVVAVVVIAIVCLRKQRHGSDSEYTEKLQQYIAPGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFTTVGDWLDAIKMGRYKESFVSAGFASFDLVAQMTAEDLLRIGVTLAGHQKKILSSIQDMRLQMNQTLPVQV

SEQ ID NO: 1423 - protein, 987 aa, unidentified
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 1424 - protein, 1021 aa, unidentified
MATEGAAQLGNRVAGMVCSLWVLLLVSSVLALEEVLLDTTGETSEIGWLTYPPGGWDEVSVLDDQRRLTRTFEACHVAGAPPGTGQDNWLQTHFVERRGAQRAHIRLHFSVRACSSLGVSGGTCRETFTLYYRQAEEPDSPDSVSSWHLKRWTKVDTIAADESFPSSSSSSSSSSSAAWAVGPHGAGQRAGLQLNVKERSFGPLTQRGFYVAFQDTGACLALVAVRLFSYTCPAVLRSFASFPETQASGAGGASLVAAVGTCVAHAEPEEDGVGGQAGGSPPRLHCNGEGKWMVAVGGCRCQPGYQPARGDKACQACPRGLYKSSAGNAPCSPCPARSHAPNPAAPVCPCLEGFYRASSDPPEAPCTGPPSAPQELWFEVQGSALMLHWRLPRELGGRGDLLFNVVCKECEGRQEPASGGGGTCHRCRDEVHFDPRQRGLTESRVLVGGLRAHVPYILEVQAVNGVSELSPDPPQAAAINVSTSHEVPSAVPVVHQVSRASNSITVSWPQPDQTNGNILDYQLRYYDQAEDESHSFTLTSETNTATVTQLSPGHIYGFQVRARTAAGHGPYGGKVYFQTLPQGELSSQLPERLSLVIGSILGALAFLLLAAITVLAVVFQRKRRGTGYTEQLQQYSSPGLGVKYYIDPSTYEDPCQAIRELAREVDPAYIKIEEVIGTGSFGEVRQGRLQPRGRREQTVAIQALWAGGAESLQMTFLGRAAVLGQFQHPNILRLEGVVTKSRPLMVLTEFMELGPLDSFLRQREGQFSSLQLVAMQRGVAAAMQYLSSFAFVHRSLSAHSVLVNSHLVCKVARLGHSPQGPSCLLRWAAPEVIAHGKHTTSSDVWSFGILMWEVMSYGERPYWDMSEQEVLNAIEQEFRLPPPPGCPPGLHLLMLDTWQKDRARRPHFDQLVAAFDKMIRKPDTLQAGGDPGERPSQALLTPVALDFPCLDSPQAWLSAIGLECYQDNFSKFGLCTFSDVAQLSLEDLPALGITLAGHQKKLLHHIQLLQQHLRQQGSVEV

SEQ ID NO: 1425 - protein, 508 aa, unidentified
MDHLGASLWPQVGSLCLLLAGAAWAPPPNLPDPKFESKAALLAARGPEELLCFTERLEDLVCFWEEAASAGVGPGNYSFSYQLEDEPWKLCRLHQAPTARGAVRFWCSLPTADTSSFVPLELRVTAASGAPRYHRVIHINEVVLLDAPVGLVARLADESGHVVLRWLPPPETPMTSHIRYEVDVSAGNGAGSVQRVEILEGRTECVLSNLRGRTRYTFAVRARMAEPSFGGFWSAWSEPVSLLTPSDLDPLILTLSLILVVILVLLTVLALLSHRRALKQKIWPGIPSPESEFEGLFTTHKGNFQLWLYQNDGCLWWSPCTPFTEDPPASLEVLSERCWGTMQAVEPGTDDEGPLLEPVGSEHAQDTYLVLDKWLLPRNPPSEDLPGPGGSVDIVAMDEGSEASSCSSALASKPSPEGASAASFEYTILDPSSQLLRPWTLCPELPPTPPHLKYLYLVVSDSGISTDYSSGDSQGAQGGLSDGPYSNPYENSLIPAAEPLPPSYVACS

SEQ ID NO: 1426 - protein, 318 aa, unidentified
MNTRNRVVNSGLGASPASRPTRDPQDPSGRQGELSPVEDQREGLEAAPKGPSRESVVHAGQRRTSAYTLIAPNINRRNEIQRIAEQELANLEKWKEQNRAKPVHLVPRRLGGSQSETEVRQKQQLQLMQSKYKQKLKREESVRIKKEAEEAELQKMKAIQREKSNKLEEKKRLQENLRREAFREHQQYKTAEFLSKLNTESPDRSACQSAVCGPQSSTWKLPILPRDHSWARSWAYRDSLKAEENRKLQKMKDEQHQKSELLELKRQQQEQERAKIHQTEHRRVNNAFLDRLQGKSQPGGLEQSGGCWNMNSGNSWGI

SEQ ID NO: 1427 - protein, 294 aa, unidentified
MNFILFIFIPGVFSLKSSTLKPTIEALPNVLPLNEDVNKQEEKNEDHTPNYAPANEKNGNYYKDIKQYVFTTQNPNGTESEISVRATTDLNFALKNDKTVNATTYEKSTIEEETTTSEPSHKNIQRSTPNVPAFWTMLAKAINGTAVVMDDKDQLFHPIPESDVNATQGENQPDLEDLKIKIMLGISLMTLLLFVVLLAFCSATLYKLRHLSYKSCESQYSVNPELATMSYFHPSEGVSDTSFSKSAESSTFLGTTSSDMRRSGTRTSESKIMTDIISIGSDNEMHENDESVTR

SEQ ID NO: 1428 - protein, 1255 aa, unidentified [sequence omitted]

SEQ ID NO: 1429 - protein, 1342 aa, unidentified
MRANDALQVLGLLFSLARGSEVGNSQAVCPGTLNGLSVTGDAENQYQTLYKLYERCEVVMGNLEIVLTGHNADLSFLQWIREVTGYVLVAMNEFSTLPLPNLRVVRGTQVYDGKFAIFVMLNYNTNSSHALRQLRLTQLTEILSGGVYIEKNDKLCHMDTIDWRDIVRDRDAEIVVKDNGRSCPPCHEVCKGRCWGPGSEDCQTLTKTICAPQCNGHCFGPNPNQCCHDECAGGCSGPQDTDCFACRHFNDSGACVPRCPQPLVYNKLTFQLEPNPHTKYQYGGVCVASCPHNFVVDQTSCVRACPPDKMEVDKNGLKMCEPCGGLCPKACEGTGSGSRFQTVDSSNIDGFVNCTKILGNLDFLITGLNGDPWHKIPALDPEKLNVFRTVREITGYLNIQSWPPHMHNFSVFSNLTTIGGRSLYNRGFSLLIMKNLNVTSLGFRSLKEISAGRIYISANRQLCYHHSLNWTKVLRGPTEERLDIKHNRPRRDCVAEGKVCDPLCSSGGCWGPGPGQCLSCRNYSRGGVCVTHCNFLNGEPREFAHEAECFSCHPECQPMEGTATCNGSGSDTCAQCAHFRDGPHCVSSCPHGVLGAKGPIYKYPDVQNECRPCHENCTQGCKGPELQDCLGQTLVLIGKTHLTMALTVIAGLVVIFMMLGGTFLYWRGRRIQNKRAMRRYLERGESIEPLDPSEKANKVLARIFKETELRKLKVLGSGVFGTVHKGVWIPEGESIKIPVCIKVIEDKSGRQSFQAVTDHMLAIGSLDHAHIVRLLGLCPGSSLQLVTQYLPLGSLLDHVRQHRGALGPQLLLNWGVQIAKGMYYLEEHGMVHRNLAARNVLLKSPSQVQVADFGVADLLPPDDKQLLYSEAKTPIKWMALESIHFGKYTHQSDVWSYGVTVWELMTFGAEPYAGLRLAEVPDLLEKGERLAQPQICTIDVYMVMVKCWMIDENIRPTFKELANEFTRMARDPPRYLVIKRESGPGIAPGPEPHGLTNKKLEEVELEPELDLDLDLEAEEDNLATTTLGSALSLPVGTLNRPRGSQSLLSPSSGYMPMNQGNLGESCQESAVSGSSERCPRPVSLHPMPRGCLASESSEGHVTGSEAELQEKVSMCRSRSRSRSPRPRGDSAYHSQRHSLLTPVTPLSPPGLEEEDVNGYVMPDTHLKGTPSSREGTLSSVGLSSVLGTEEEDEDEEYEYMNRRRRHSPPHPPRPSSLEELGYEYMDVGSDLSASLGSTQSCPLHPVPIMPTAGTTPDEDYEYMNRQRDGGGPGGDYAAMGACPASEQGYEEMRAFQGPGHQAPHVHYARLKTLRSLEATDSAFDNPDYWHSRLFPKANAQRT

SEQ ID NO: 1430 - protein, 1308 aa, unidentified
MKPATGLWVWVSLLVAAGTVQPSDSQSVCAGTENKLSSLSDLEQQYRALRKYYENCEVVMGNLEITSIEHNRDLSFLRSVREVTGYVLVALNQFRYLPLENLRIIRGTKLYEDRYALAIFLNYRKDGNFGLQELGLKNLTEILNGGVYVDQNKFLCYADTIHWQDIVRNPWPSNLTLVSTNGSSGCGRCHKSCTGRCWGPTENHCQTLTRTVCAEQCDGRCYGPYVSDCCHRECAGGCSGPKDTDCFACMNFNDSGACVTQCPQTFVYNPTTFQLEHNFNAKYTYGAFCVKKCPHNFVVDSSSCVRACPSSKMEVEENGIKMCKPCTDICPKACDGIGTGSLMSAQTVDSSNIDKFINCTKINGNLIFLVTGIHGDPYNAIEAIDPEKLNVFRTVREITGFLNIQSWPPNMTDFSVFSNLVTIGGRVLYSGLSLLILKQQGITSLQFQSLKEISAGNIYITDNSNLCYYHTINWTTLFSTINQRIVIRDNRKAENCTAEGMVCNHLCSSDGCWGPGPDQCLSCRRFSRGRICIESCNLYDGEFREFENGSICVECDPQCEKMEDGLLTCHGPGPDNCTKCSHFKDGPNCVEKCPDGLQGANSFIFKYADPDRECHPCHPNCTQGCNGPTSHDCIYYPWTGHSTLPQHARTPLIAAGVIGGLFILVIVGLTFAVYVRRKSIKKKRALRRFLETELVEPLTPSGTAPNQAQLRILKETELKRVKVLGSGAFGTVYKGIWVPEGETVKIPVAIKILNETTGPKANVEFMDEALIMASMDHPHLVRLLGVCLSPTIQLVTQLMPHGCLLEYVHEHKDNIGSQLLLNWCVQIAKGMMYLEERRLVHRDLAARNVLVKSPNHVKITDFGLARLLEGDEKEYNADGGKMPIKWMALECIHYRKFTHQSDVWSYGVTIWELMTFGGKPYDGIPTREIPDLLEKGERLPQPPICTIDVYMVMVKCWMIDADSRPKFKELAAEFSRMARDPQRYLVIQGDDRMKLPSPNDSKFFQNLLDEEDLEDMMDAEEYLVPQAFNIPPPIYTSRARIDSNRSEIGHSPPPAYTPMSGNQFVYRDGGFAAEQGVSVPYRAPTSTIPEAPVAQGATAEIFDDSCCNGTLRKPVAPHVQEDSSTQRYSADPTVFAPERSPRGELDEEGYMTPMRDKPKQEYLNPVEENPFVSRRKNGDLQALDNPEYHNASNGPPKAEDEYVNEPLYLNTFANTLGKAEYLKNNILSMPEKAKKAFDNPDYWNHSLPPRSTLQHPDYLQEYSTKYFYKQNGRIRPIVAENPEYLSEFSLKPGTVLPPPPYRHRNTVV

SEQ ID NO: 1431 - protein, 169 aa, unidentified
MTAGRRMEMLCAGRVPALLLCLGFHLLQAVLSTTVIPSCIPGESSDNCTALVQTEDNPRVAQVSITKCSSDMNGYCLHGQCIYLVDMSQNYCRCEVGYTGVRCEHFFLTVHQPLSKEYVALTVILIILFLITVVGSTYYFCRWYRNRKSKEPKKEYERVTSGDPELPQV

SEQ ID NO: 1432 - protein, 290 aa, unidentified
MPFDFRRFDIYRKVPKDLTQPTYTGAIISICCCLFILFLFLSELTGFITTEVVNELYVDDPDKDSGGKIDVSLNISLPNLHCELVGLDIQDEMGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITTICAIIGGTFTVAGILDSCIFTASEAWKKIQLGKMH

SEQ ID NO: 1433 - protein, 377 aa, unidentified
MRRLNRKKTLSLVKELDAFPKVPESYVETSASGGTVSLIAFTTMALLTIMEFSVYQDTWMKYEYEVDKDFSSKLRINIDITVAMKCQYVGADVLDLAETMVASADGLVYEPTVFDLSPQQKEWQRMLQLIQSRLQEEHSLQDVIFKSAFKSTSTALPPREDDSSQSPNACRIHGHLYVNKVAGNFHITVGKAIPHPRGHAHLAALVNHESYNFSHRIDHLSFGELVPAIINPLDGTEKIAIDHNQMFQYFITVVPTKLHTYKISADTHQFSVTERERIINHAAGSHGVSGIFMKYDLSSLMVTVTEEHMPFWQFFVRLCGIVGGIFSTTGMLHGIGKFIVEIICCRFRLGSYKPVNSVPFEDGHTDNHLPLLENNTH

SEQ ID NO: 1434 - protein, 383 aa, unidentified
MEALGKLKQFDAYPKTLEDFRVKTCGGATVTIVSGLLMLLLFLSELQYYLTTEVHPELYVDKSRGDKLKINIDVLFPHMPCAYLSIDAMDVAGEQQLDVEHNLFKQRLDKDGIPVSSEAERHELGKVEVTVFDPDSLDPDRCESCYGAEAEDIKCCNTCEDVREAYRRRGWAFKNPDTIEQCRREGFSQKMQEQKNEGCQVYGFLEVNKVAGNFHFAPGKSFQQSHVHVHDLQSFGLDNINMTHYIQHLSFGEDYPGIVNPLDHTNVTAPQASMMFQYFVKVVPTVYMKVDGEVLRTNQFSVTRHEKVANGLLGDQGLPGVFVLYELSPMMVKLTEKHRSFTHFLTGVCAIIGGMFTVAGLIDSLIYHSARAIQKKIDLGKTT

SEQ ID NO: 1435 - protein, 475 aa, unidentified
MEMASSAGSWLSGCLIPLVFLRLSVHVSGHAGDAGKFHVALLGGTAELLCPLSLWPGTVPKEVRWLRSPFPQRSQAVHIFRDGKDQDEDLMPEYKGRTVLVRDAQEGSVTLQILDVRLEDQGSYRCLIQVGNLSKEDTVILQVAAPSVGSLSPSAVALAVILPVLVLLIMVCLCLIWKQRRAKEKLLYEHVTEVDNLLSDHAKEKGKLHKAVKKLRSELKLKRAAANSGWRRARLHFVAVTLDPDTAHPKLILSEDQRCVRLGDRRQPVPDNPQRFDFVVSILGSEYFTTGCHYWEVYVGDKTKWILGVCSESVSRKGKVTASPANGHWLLRQSRGNEYEALTSPQTSFRLKEPPRCVGIFLDYEAGVISFYNVTNKSHIFTFTHNFSGPLRPFFEPCLHDGGKNTAPLVICSELHKSEESIVPRPEGKGHANGDVSLKVNSSLLPPKAPELKDIILSLPPDLGPALQELKAPSF

SEQ ID NO: 1436 - protein, 678 aa, unidentified
MEVLIGDPITTCLSPSVYDIICNLGFQLRENCDINSIVTQNGEVCWKTITDCVSYTESEQGLDYWGSVRLLGPVCEAVHSHFLSLTKGQFEIRYAPWFQWTSFPELFPEIFDALESLQSPAISLSLMKLTSCLERALGDVFLLIGKECPFLLRDLLSSEELAQVFSQSVMNVLKVFVGSPCGLNLRNVLWHGFASPEEIPPKYCSMMILLTAGLGQLLKSYLQNTKLTLAHRSFISLTNLEDLIVFPDVTYEVLSVLEEVMMKSAFILKIMLPYWEVALVKFKSHRFADCAILLLTQLETGLRNVFATLNRCPKRLLTAESTALYTTFDQILAKHLNDGKINQLPLFLGEPAMEFLWDFLNHQEGPRIRDHLSHGEINLHEFSKETTNQLLAFSLVLLLRFVDDCLLSVFKEKSAVELLISLAEGYSSRCHPVFQLKKQVLSCEESIRVWALLPFPEELTRQAVRLEDNSETNACHSLITKMTDELYHHMPENRCVLKDLDRLPTETWPQLLRELCSTPVPTLFCPRIVLEVLVVLRSISEQCRRVSSQVTVASELRHRQWVERTLRSRQRQNYLRMWSSIRLLSPVLSLILLLIALELVNIHAVCGKNAHEYQQYLKFVKSILQYTENLVAYTSYEKNKWNETINLTHTALLKMWTFSEKKQMLIHLAKKSTSKVLL

SEQ ID NO: 1437 - protein, 904 aa, unidentified
MEWGSESAAVRRHRVGVERREGAAAAPPPEREARAQEPLVDGCSGGGRTRKRSPGGSGGASRGAGTGLSEVRAALGLALYLIALRTLVQLSLQQLVLRGAAGHRGEFDALQARDYLEHITSIGPRTTGSPENEILTVHYLLEQIKLIEVQSNSLHKISVDVQRPTGSFSIDFLGGFTSYYDNITNVVVKLEPRDGAQHAVLANCHFDSVANSPGASDDAVSCSVMLEVLRVLSTSSEALHHAVIFLFNGAEENVLQASHGFITQHPWASLIRAFINLEAAGVGGKELVFQTGPENPWLVQAYVSAAKHPFASVVAQEVFQSGIIPSDTDFRIYRDFGNIPGIDLAFIENGYIYHTKYDTADRILTDSIQRAGDNILAVLKHLATSDMLAAASKYRHGNMVFFDVLGLFVIAYPSRIGSIINYMVVMGVVLYLGKKFLQPKHKTGNYKKDFLCGLGITLISWFTSLVTVLIIAVFISLIGQSLSWYNHFYVSVCLYGTATVAKIILIHTLAKRFYYMNASAQYLGEVFFDISLFVHCCFLVTLTYQGLCSAFISAVWVAFPLLTKLCVHKDFKQHGAQGKFIAFYLLGMFIPYLYALYLIWAVFEMFTPILGRSGSEIPPDVVLASILAGCTMILSSYFINFIYLAKSTKKTMLTLTLVCAITFLLVCSGTFFPYSSNPANPKPKRVFLQHMTRTFHDLEGNAVKRDSGIWINGFDYTGISHITPHIPEINDSIRAHCEENAPLCGFPWYLPVHFLIRKNWYLPAPEVSPRNPPHFRLISKEQTPWDSIKLTFEATGPSHMSFYVRAHKGSTLSQWSLGNGTPVTSKGGDYFVFYSHGLQASAWQFWIEVQVSEEHPEGMVTVAIAAHYLSGEDKRSPQLDALKEKFPDWTFPSAWVCTYDLFVF

SEQ ID NO: 1438 - protein, 977 aa, unidentified
MPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYVWQREGLRKVMHINVAVETLRYLTFMSGEVGRITKWKYPFPKETEAKSKLTPTLYVGKYSTSLYASPSMVHEGVAVVPRGSTLPLLEGPQTDGVTIGDKGECVITPSTDVKFDPGLKSKNKLNYLRNYWLLIGHHETPLSASTKMLERFPNNLPKHRENVIPADSEKKSFEEVINLVDQTSENAPTTVSRDVEEKPAHAPARPEAPVDSMLKDMATIILSTFLLIGWVAFIITYPLSMHQQQQLQHQQFQKELEKIQLLQQQQQQLPFHPPGDTAQDGELLDTSGPYSESSGTSSPSTSPRASNHSLCSGSSASKAGSSPSLEQDDGDEETSVVIVGKISFCPKDVLGHGAEGTIVYRGMFDNRDVAVKRILPECFSFADREVQLLRESDEHPNVIRYFCTEKDRQFQYIAIELCAATLQEYVEQKDFAHLGLEPITLLQQTTSGLAHLHSLNIVHRDLKPHNILISMPNAHGKIKAMISDFGLCKKLAVGRHSFSRRSGVPGTEGWIAPEMLSEDCKENPTYTVDIFSAGCVFYYVISEGSHPFGKSLQRQANILLGACSLDCLHPEKHEDVIARELIEKMIAMDPQKRPSAKHVLKHPFFWSLEKQLQFFQDVSDRIEKESLDGPIVKQLERGGRAVVKMDWRENITVPLQTDLRKFRTYKGGSVRDLLRAMRNKKHHYRELPAEVRETLGSLPDDFVCYFTSRFPHLLAHTYRAMELCSHERLFQPYYFHEPPEPQPPVTPDAL

SEQ ID NO: 1439 - protein, 926 aa, unidentified
MASAVRGSRPWPRLGLQLQFAALLLGTLSPQVHTLRPENLLLVSTLDGSLHALSKQTGDLKWTLRDDPVIEGPMYVTEMAFLSDPADGSLYILGTQKQQGLMKLPFTIPELVHASPCRSSDGVFYTGRKQDAWFVVDPESGETQMTLTTEGPSTPRLYIGRTQYTVTMHDPRAPALRWNTTYRRYSAPPMDGSPGKYMSHLASCGMGLLLTVDPGSGTVLWTQDLGVPVMGVYTWHQDGLRQLPHLTLARDTLHFLALRWGHIRLPASGPRDTATLFSTLDTQLLMTLYVGKDETGFYVSKALVHTGVALVPRGLTLAPADGPTTDEVTLQVSGEREGSPSTAVRYPSGSVALPSQWLLIGHHELPPVLHTTMLRVHPTLGSGTAETRPPENTQAPAFFLELLSLSREKLWDSELHPEEKTPDSYLGLGPQDLLAASLTAVLLGGWILFVMRQQQPQVVEKQQETPLAPADFAHISQDAQSLHSGASRRSQKRLQSPSKQAQPLDDPEAEQLTVVGKISFNPKDVLGRGAGGTFVFRGQFEGRAVAVKRLLRECFGLVRREVQLLQESDRHPNVLRYFCTERGPQFHYIALELCRASLQEYVENPDLDRGGLEPEVVLQQLMSGLAHLHSLHIVHRDLKPGNILITGPDSQGLGRVVLSDFGLCKKLPAGRCSFSLHSGIPGTEGWMAPELLQLLPPDSPTSAVDIFSAGCVFYYVLSGGSHPFGDSLYRQANILTGAPCLAHLEEEVHDKVVARDLVGAMLSPLPQPRPSAPQVLAHPFFWSRAKQLQFFQDVSDWLEKESEQEPLVRALEAGGCAVVRDNWHEHISMPLQTDLRKFRSYKGTSVRDLLRAVRNKKHHYRELPVEVRQALGQVPDGFVQYFTNRFPRLLLHTHRAMRSCASESLFLPYYPPDSEARRPCPGATGR

SEQ ID NO: 1440 - protein, 538 aa, unidentified
MGLLLLVLILTPSLAAYRHPDFPLLEKAQQLLQSTGSPYSTNCWLCTSSSTETPGTAYPASPREWTSIEAELHISYRWDPNLKGLMRPANSLLSTVKQDFPDIRQKPPIFGPIFTNINLMGIAPICVMAKRKNGTNVGTLPSTVCNVTFTVDSNQQTYQTYTHNQFRHQPRFPKPPNITFPQGTLLDKSSRFCQGRPSSCSTRNFWFRPADYNQCLQISNLSSTAEWVLLDQTRNSLFWENKTKGANQSQTPCVQVLAGMTIATSYLGISAVSEFFGTSLTPLFHFHISTCLKTQGAFYICGQSIHQCLPSNWTGTCTIGYVTPDIFIAPGNLSLPIPIYGNSPLPRVRRAIHFIPLLAGLGILAGTGTGIAGITKASLTYSQLSKEIANNIDTMAKALTTMQEQIDSLAAVVLQNRRGLDMLTAAQGGICLALDEKCCFWVNQSGKVQDNIRQLLNQASSLRERATQGWLNWEGTWKWFSWVLPLTGPLVSLLLLLLFGPCLLNLITQFVSSRLQAIKLQTNLSAGRHPRNIQESPF

SEQ ID NO: 1441 - protein, 563 aa, unidentified
MGSLSNYALLQLTLTAFLTILVQPQHLLAPVFRTLSILTNQSNCWLCEHLDNAEQPELVFVPASASTWWTYSGQWMYERVWYPQAEVQNHSTSSYRKVTWHWEASMEAQGLSFAQVRLLEGNFSLCVENKNGSGPFLGNIPKQYCNQILWFDSTDGTFMPSIDVTNESRNDDDDTSVCLGTRQCSWFAGCTNRTWNSSAVPLIGLPNTQDYKWVDRNSGLTWSGNDTCLYSCQNQTKGLLYQLFRNLFCSYGLTEAHGKWRCADASITNDKGHDGHRTPTWWLTGSNLTLSVNNSGLFFLCGNGVYKGFPPKWSGRCGLGYLVPSLTRYLTLNASQITNLRSFIHKVTPHRCTQGDTDNPPLYCNPKDNSTIRALFPSLGTYDLEKAILNISKAMEQEFSATKQTLEAHQSKVSSLASASRKDHVLDIPTTQRQTACGTVGKQCCLYINYSEEIKSNIQRLHEASENLKNVPLLDWQGIFAKVGDWFRSWGYVLLIVLFCLFIFVLIYVRVFRKSRRSLNSQPLNLALSPQQSAQLLVSETSCQVSNRAMKGLTTHQYDTSLL

SEQ ID NO: 1442 - protein, 477 aa, unidentified
MTEKFLFLYLSLLPMPLLSQAQWNENSLVSFSKIIASGNHLSNCWICHNFITRSSSYQYILVRNFSLNLTFGSGIPEGQHKSVPLQVSLANSAHQVPCLDLTPPFNQSSKTSFYFYNCSSLNQTCCPCPEGHCDRKNTSEEGFPSPTIHPMSFSPAGCHPNLTHWCPAKQMNDYRDKSPQNRCAAWEGKELITWRVLYLLPKAHTVPTWPKSTVPLGGPLSPACNQTIPAGWKSQLHKWFDSHIPRWACTPPGYVFLCGPQKNKLPFDGSPKITYSTPPVANLYTCINNIQHTGECAVGLLGPRGIGVTIYNTTQPRQKRALGLILAGMGAAIGMIAPWGGFTYHDVTLRNLSRQIDNIAKSTRDSISKLKASIDSLANVVMNNRLALDYLLAEQGGVCAVISKSCCIYVNNSGAIEEDIKKIYDEVTWLHNFGKGDSAGSIWEAVKSALPSLTWFVPLLGPAALNSLLSPLWPLSL

SEQ ID NO: 1443 - protein, 535 aa, unidentified
MTEKFLFLYLSLLPMPLLSQAQWNENSLVSFSKIIASGNHLSNCWICHNFITRSSSYQYILVRNFSLNLTFGSGIPEGQHKSVPLQVSLANSAHQVPCLDLTPPFNQSSKTSFYFYNCSSLNQTCCPCPEGHCDRKNTSEEGFPSPTIHPMSFSPAGCHPNLTHWCPAKQMNDYRDKSPQNRCAAWEGKELITWRVLYSLPKAHTVPTWPKSTVPLGGPLSPACNQTIPAGWKSQLHKWFDSHIPRWACTPPGYVFLCGPQKNKLPFDGSPKITYSTPPVANLYTCINNIQHTGECAVGLLGPRGIGVTIYNTTQPRQKRALGLILAGMGAAIGMIAPWGGFTYHDVTLRNLSRQIDNIAKSTRDSISKLKASIDSLANVVMDNRLALDYLLAEQGGVCAVINKSCCVYVNNSGAIEEDIKKIYDEATWLHDFGKGGASARAIWEAVKSALPSLNWFVPLLGPATVILLLFLFGPCFFNLLIKCVSSRIKQFHMKSPQMERYQLSVIGGPSTYKHISPLDASGQRFRETMEEFSL

SEQ ID NO: 1444 - protein, 538 aa, unidentified
MALPYHIFLFTVLLPSFTLTAPPPCRCMTSSSPYQEFLWRMQRPGNIDAPSYRSLSKGTPTFTAHTHMPRNCYHSATLCMHANTHYWTGKMINPSCPGGLGVTVCWTYFTQTGMSDGGGVQDQAREKHVKEVISQLTRVHGTSSPYKGLDLSKLHETLRTHTRLVSLFNTTLTGLHEVSAQNPTNCWICLPLNFRPYVSIPVPEQWNNFSTEINTTSVLVGPLVSNLEITHTSNLTCVKFSNTTYTTNSQCIRWVTPPTQIVCLPSGIFFVCGTSAYRCLNGSSESMCFLSFLVPPMTIYTEQDLYSYVISKPRNKRVPILPFVIGAGVLGALGTGIGGITTSTQFYYKLSQELNGDMERVADSLVTLQDQLNSLAAVVLQNRRALDLLTAERGGTCLFLGEECCYYVNQSGIVTEKVKEIRDRIQRRAEELRNTGPWGLLSQWMPWILPFLGPLAAIILLLLFGPCIFNLLVNFVSSRIEAVKLQMEPKMQSKTKIYRRPLDRPASPRSDVNDIKGTPPEEISAAQPLLRPNSAGSS

SEQ ID NO: 1445 - protein, 390 aa, unidentified
MISLPGPLVTNLLRFLFLGLSALAPPSRAQLQLHLPANRLQAVEGGEVVLPAWYTLHGEVSSSQPWEVPFVMWFFKQKEKEDQVLSYINGVTTSKPGVSLVYSMPSRNLSLRLEGLQEKDSGPYSCSVNVQDKQGKSRGHSIKTLELNVLVPPAPPSCRLQGVPHVGANVTLSCQSPRSKPAVQYQWDRQLPSFQTFFAPALDVIRGSLSLTNLSSSMAGVYVCKAHNEVGTAQCNVTLEVSTGPGAAVVAGAVVGTLVGLGLLAGLVLLYHRRGKALEEPANDIKEDAIAPRTLPWPKSSDTISKNGTLSSVTSARALRPPHGPPRPGALTPTPSLSSQALPSPRLPTTDGAHPQPISPIPGGVSSSGLSRMGAVPVMVPAQSQAGSLV

SEQ ID NO: 1446 - protein, 2120 aa, unidentified
MRSFKRVNFGTLLSSQKEAEELLPALKEFLSNPPAGFPSSRSDAERRQACDAILRACNQQLTAKLACPRHLGSLLELAELACDGYLVSTPQRPPLYLERILFVLLRNAAAQGSPEATLRLAQPLHACLVQCSREAAPQDYEAVARGSFSLLWKGAEALLERRAAFAARLKALSFLVLLEDESTPCEVPHFASPTACRAVAAHQLFDASGHGLNEADADFLDDLLSRHVIRALVGERGSSSGLLSPQRALCLLELTLEHCRRFCWSRHHDKAISAVEKAHSYLRNTNLAPSLQLCQLGVKLLQVGEEGPQAVAKLLIKASAVLSKSMEAPSPPLRALYESCQFFLSGLERGTKRRYRLDAILSLFAFLGGYCSLLQQLRDDGVYGGSSKQQQSFLQMYFQGLHLYTVVVYDFAQGCQIVDLADLTQLVDSCKSTVVWMLEALEGLSGQELTDHMGMTASYTSNLAYSFYSHKLYAEACAISEPLCQHLGLVKPGTYPEVPPEKLHRCFRLQVESLKKLGKQAQGCKMVILWLAALQPCSPEHMAEPVTFWVRVKMDAARAGDKELQLKTLRDSLSGWDPETLALLLREELQAYKAVRADTGQERFNIICDLLELSPEETPAGAWARATHLVELAQVLCYHDFTQQTNCSALDAIREALQLLDSVRPEAQARDQLLDDKAQALLWLYICTLEAKMQEGIERDRRAQAPGNLEEFEVNDLNYEDKLQEDRFLYSNIAFNLAADAAQSKCLDQALALWKELLTKGQAPAVRCLQQTAASLQILAALYQLVAKPMQALEVLLLLRIVSERLKDHSKAAGSSCHITQLLLTLGCPSYAQLHLEEAASSLKHLDQTTDTYLLLSLTCDLLRSQLYWTHQKVTKGVSLLLSVLRDPALQKSSKAWYLLRVQVLQLVAAYLSLPSNNLSHSLWEQLCAQGWQTPEIALIDSHKLLRSIILLLMGSDILSTQKAAVETSFLDYGENLVQKWQVLSEVLSCSEKLVCHLGRLGSVSEAKAFCLEALKLTTKLQIPRQCALFLVLKGELELARNDIDLCQSDLQQVLFLLESCTEFGGVTQHLDSVKKVHLQKGKQQAQVPCPPQLPEEELFLRGPALELVATVAKEPGPIAPSTNSSPVLKTKPQPIPNFLSHSPTCDCSLCASPVLTAVCLRWVLVTAGVRLAMGHQAQGLDLLQVVLKGCPEAAERLTQALQASLNHKTPPSLVPSLLDEILAQAYTLLALEGLNQPSNESLQKVLQSGLKFVAARIPHLEPWRASLLLIWALTKLGGLSCCTTQLFASSWGWQPPLIKSVPGSEPSKTQGQKRSGRGRQKLASAPLRLNNTSQKGLEGRGLPCTPKPPDRIRQAGPHVPFTVFEEVCPTESKPEVPQAPRVQQRVQTRLKVNFSDDSDLEDPVSAEAWLAEEPKRRGTASRGRGRARKGLSLKTDAVVAPGSAPGNPGLNGRSRRAKKVASRHCEERRPQRASDQARPGPEIMRTIPEEELTDNWRKMSFEILRGSDGEDSASGGKTPAPGPEAASGEWELLRLDSSKKKLPSPCPDKESDKDLGPRLRLPSAPVATGLSTLDSICDSLSVAFRGISHCPPSGLYAHLCRFLALCLGHRDPYATAFLVTESVSITCRHQLLTHLHRQLSKAQKHRGSLEIADQLQGLSLQEMPGDVPLARIQRLFSFRALESGHFPQPEKESFQERLALIPSGVTVCVLALATLQPGTVGNTLLLTRLEKDSPPVSVQIPTGQNKLHLRSVLNEFDAIQKAQKENSSCTDKREWWTGRLALDHRMEVLIASLEKSVLGCWKGLLLPSSEEPGPAQEASRLQELLQDCGWKYPDRTLLKIMLSGAGALTPQDIQALAYGLCPTQPERAQELLNEAVGRLQGLTVPSNSHLVLVLDKDLQKLPWESMPSLQALPVTRLPSFRFLLSYSIIKEYGASPVLSQGVDPRSTFYVLNPHNNLSSTEEQFRANFSSEAGWRGVVGEVPRPEQVQEALTKHDLYIYAGHGAGARFLDGQAVLRLSCRAVALLFGCSSAALAVRGNLEGAGIVLKYIMAGCPLFLGNLWDVTDRDIDRYTEALLQGWLGAGPGAPLLYYVNQARQAPRLKYLIGAAPIAYGLPVSLR

SEQ ID NO: 1447 - protein, 1104 aa, unidentified
MERSPGEGPSPSPMDQPSAPSDPTDQPPAAHAKPDPGSGGQPAGPGAAGEALAVLTSFGRRLLVLIPVYLAGAVGLSVGFVLFGLALYLGWRRVRDEKERSLRAARQLLDDEEQLTAKTLYMSHRELPAWVSFPDVEKAEWLNKIVAQVWPFLGQYMEKLLAETVAPAVRGSNPHLQTFTFTRVELGEKPLRIIGVKVHPGQRKEQILLDLNISYVGDVQIDVEVKKYFCKAGVKGMQLHGVLRVILEPLIGDLPFVGAVSMFFIRRPTLDINWTGMTNLLDIPGLSSLSDTMIMDSIAAFLVLPNRLLVPLVPDLQDVAQLRSPLPRGIIRIHLLAARGLSSKDKYVKGLIEGKSDPYALVRLGTQTFCSRVIDEELNPQWGETYEVMVHEVPGQEIEVEVFDKDPDKDDFLGRMKLDVGKVLQASVLDDWFPLQGGQGQVHLRLEWLSLLSDAEKLEQVLQWNWGVSSRPDPPSAAILVVYLDRAQDLPLKKGNKEPNPMVQLSIQDVTQESKAVYSTNCPVWEEAFRFFLQDPQSQELDVQVKDDSRALTLGALTLPLARLLTAPELILDQWFQLSSSGPNSRLYMKLVMRILYLDSSEICFPTVPGCPGAWDVDSENPQRGSSVDAPPRPCHTTPDSQFGTEHVLRIHVLEAQDLIAKDRFLGGLVKGKSDPYVKLKLAGRSFRSHVVREDLNPRWNEVFEVIVTSVPGQELEVEVFDKDLDKDDFLGRCKVRLTTVLNSGFLDEWLTLEDVPSGRLHLRLERLTPRPTAAELEEVLQVNSLIQTQKSAELAAALLSIYMERAEDLPLRKGTKHLSPYATLTVGDSSHKTKTISQTSAPVWDESASFLIRKPHTESLELQVRGEGTGVLGSLSLPLSELLVADQLCLDRWFTLSSGQGQVLLRAQLGILVSQHSGVEAHSHSYSHSSSSLSEEPELSGGPPHITSSAPELRQRLTHVDSPLEAPAGPLGQVKLTLWYYSEERKLVSIVHGCRSLRQNGRDPPDPYVSLLLLPDKNRGTKRRTSQKKRTLSPEFNERFEWELPLDEAQRRKLDVSVKSNSSFMSRERELLGKVQLDLAETDLSQGVARWYDLMDNKDKGSS

SEQ ID NO: 1448 - protein, 921 aa, unidentified
MTANRDAALSSHRHPGCAQRPRTPTFASSSQRRSAFGFDDGNFPGLGERSHAPGSRLGARRRAKTARGLRGHRQRGAGAGLSRPGSARAPSPPRPGGPENPGGVLSVELPGLLAQLARSFALLLPVYALGYLGLSFSWVLLALALLAWCRRSRGLKALRLCRALALLEDEERVVRLGVRACDLPAWVHFPDTERAEWLNKTVKHMWPFICQFIEKLFRETIEPAVRGANTHLSTFSFTKVDVGQQPLRINGVKVYTENVDKRQIILDLQISFVGNCEIDLEIKRYFCRAGVKSIQIHGTMRVILEPLIGDMPLVGALSIFFLRKPLLEINWTGLTNLLDVPGLNGLSDTIILDIISNYLVLPNRITVPLVSEVQIAQLRFPVPKGVLRIHFIEAQDLQGKDTYLKGLVKGKSDPYGIIRVGNQIFQSRVIKENLSPKWNEVYEALVYEHPGQELEIELFDEDPDKDDFLGSLMIDLIEVEKERLLDEWFTLDEVPKGKLHLRLEWLTLMPNASNLDKVLTDIKADKDQANDGLSSALLILYLDSARNLPSGKKISSNPNPVVQMSVGHKAQESKIRYKTNEPVWEENFTFFIHNPKRQDLEVEVRDEQHQCSLGNLKVPLSQLLTSEDMTVSQRFQLSNSGPNSTIKMKIALRVLHLEKRERPPDHQHSAQVKRPSVSKEGRKTSIKSHMSGSPGPGGSNTAPSTPVIGGSDKPGMEEKAQPPEAGPQGLHDLGRSSSSLLASPGHISVKEPTPSIASDISLPIATQELRQRLRQLENGTTLGQSPLGQIQLTIRHSSQRNKLIVVVHACRNLIAFSEDGSDPYVRMYLLPDKRRSGRRKTHVSKKTLNPVFDQSFDFSVSLPEVQRRTLDVAVKNSGGFLSKDKGLLGKVLVALASEELAKGWTQWYDLTEDGTRPQAMT

SEQ ID NO: 1449 - protein, 886 aa, unidentified
MRAEEPCAPGAPSALGAQRTPGPELRLSSQLLPELCTFVVRVLFYLGPVYLAGYLGLSITWLLLGALLWMWWRRNRRGKLGRLAAAFEFLDNEREFISRELRGQHLPAWIHFPDVERVEWANKIISQTWPYLSMIMESKFREKLEPKIREKSIHLRTFTFTKLYFGQKCPRVNGVKAHTNTCNRRRVTVDLQICYIGDCEISVELQKIQAGVNGIQLQGTLRVILEPLLVDKPFVGAVTVFFLQKPHLQINWTGLTNLLDAPGINDVSDSLLEDLIATHLVLPNRVTVPVKKGLDLTNLRFPLPCGVIRVHLLEAEQLAQKDNFLGLRGKSDPYAKVSIGLQHFRSRTIYRNLNPTWNEVFEFMVYEVPGQDLEVDLYDEDTDRDDFLGSLQICLGDVMTNRVVDEWFVLNDTTSGRLHLRLEWLSLLTDQEVLTEDHGGLSTAILVVFLESACNLPRNPFDYLNGEYRAKKLSRFARNKVSKDPSSYVKLSVGKKTHTSKTCPHNKDPVWSQVFSFFVHNVATERLHLKVLDDDQECALGMLEVPLCQILPYADLTLEQRFQLDHSGLDSLISMRLVLRFLQVEERELGSPYTGPEALKKGPLLIKKVATNQGPKAQPQEEGPTDLPCPPDPASDTKDVSRSTTTTTSATTVATEPTSQETGPEPKGKDSAKRFCEPIGEKKSPATIFLTVPGPHSPGPIKSPRPMKCPASPFAWPPKRLAPSMSSLNSLASSCFDLADISLNIEGGDLRRRQLGEIQLTVRYVCLRRCLSVLINGCRNLTPCTSSGADPYVRVYLLPERKWACRKKTSVKRKTLEPLFDETFEFFVPMEEVKKRSLDVAVKNSRPLGSHRRKELGKVLIDLSKEDLIKGFSQWYELTPNGQPRS

SEQ ID NO: 1450 - protein, 617 aa, unidentified
MLVPLAKLSCLAYQCFHALKIKKNYLPLCATRWSSTSTVPRITTHYTIYPRDKDKRWEGVNMERFAEEADVVIVGAGPAGLSAAVRLKQLAVAHEKDIRVCLVEKAAQIGAHTLSGACLDPGAFKELFPDWKEKGAPLNTPVTEDRFGILTEKYRIPVPILPGLPMNNHGNYIVRLGHLVSWMGEQAEALGVEVYPGYAAAEVLFHDDGSVKGIATNDVGIQKDGAPKATFERGLELHAKVTIFAEGCHGHLAKQLYKKFDLRANCEPQTYGIGLKELWVIDEKNWKPGRVDHTVGWPLDRHTYGGSFLYHLNEGEPLVALGLVVGLDYQNPYLSPFREFQRWKHHPSIRPTLEGGKRIAYGARALNEGGFQSIPKLTFPGGLLIGCSPGFMNVPKIKGTHTAMKSGILAAESIFNQLTSENLQSKTIGLHVTEYEDNLKNSWVWKELYSVRNIRPSCHGVLGVYGGMIYTGIFYWILRGMEPWTLKHKGSDFERLKPAKDCTPIEYPKPDGQISFDLLSSVALSGTNHEHDQPAHLTLRDDSIPVNRNLSIYDGPEQRFCPAGVYEFVPVEQGDGFRLQINAQNCVHCKTCDIKDPSQNINWVVPEGGGGPAYNGM

SEQ ID NO: 1451 - protein, 452 aa, unidentified
MLCGRPRSSSDNRNFLRERAGLSSAAVQTRIGNSAASRRSPAARPPVPAPPALPRGRPGTEGSTSLSAPAVLVVAVAVVVVVVSAVAWAMANYIHVPPGSPEVPKLNVTVQDQEEHRCREGALSLLQHLRPHWDPQEVTLQLFTDGITNKLIGCYVGNTMEDVVLVRIYGNKTELLVDRDEEVKSFRVLQAHGCAPQLYCTFNNGLCYEFIQGEALDPKHVCNPAIFRLIARQLAKIHAIHAHNGWIPKSNLWLKMGKYFSLIPTGFADEDINKRFLSDIPSSQILQEEMTWMKEILSNLGSPVVLCHNDLLCKNIIYNEKQGDVQFIDYEYSGYNYLAYDIGNHFNEFAGVSDVDYSLYPDRELQSQWLRAYLEAYKEFKGFGTEVTEKEVEILFIQVNQFALASHFFWGLWALIQAKYSTIEFDFLGYAIVRFNQYFKMKPEVTALKVPE

SEQ ID NO: 1452 - protein, 152 aa, unidentified
MRLPLSHSPEHVEMALLSNILAAYSFVSENPERAALYFVSGVCIGLVLTLAALVIRISCHTDCRRRPGKKFLQDRESSSDSSDSEDGSEDTVSDLSVRRHRRFERTLNKNVFTSAEELERAQRLEERERIIREIWMNGQPEVPGTRSLNRYY

SEQ ID NO: 1453 - protein, 441 aa, unidentified
MLLPGRARQPPTPQPVQHPGLRRQVEPPGQLLRLFYCTVLVCSKEISALTDFSGYLTKLLQNHTTYACDGDYLNLQCPRHSTISVQSAFYGQDYQMCSSQKPASQREDSLTCVAATTFQKVLDECQNQRACHLLVNSRVFGPDLCPGSSKYLLVSFKCQPNELKNKTVCEDQELKLHCHESKFLNIYSATYGRRTQERDICSSKAERLPPFDCLSYSALQVLSRRCYGKQRCKIIVNNHHFGSPCLPGVKKYLTVTYACVPKNILTAIDPAIANLKPSLKQKDGEYGINFDPSGSKVLRKDGILVSNSLAAFAYIRAHPERAALLFVSSVCIGLALTLCALVIRESCAKDFRDLQLGREQLVPGSDKVEEDSEDEEEEEDPSESDFPGELSGFCRTSYPIYSSIEAAELAERIERREQIIQEIWMNSGLDTSLPRNMGQFY

SEQ ID NO: 1454 - protein, 992 aa, unidentified
MARGGAACKSDARLLLGRDALRPAPALLAPAVLLGAALGLGLGLWLGCRAGRQRTRHQKDDTQNLLKNLESNAQTPSETGSPSRRRKREVQMSKDKEAVDECEPPSNSNITAFALKAKVIYPINQKFRPLADGSSNPSLHENLKQAVLPHQPVEASPSSSLGSLSQGEKDDCSSSSSVHSATSDDRFLSRTFLRVNAFPEVLACESVDVDLCIYSLHLKDLLHLDTALRQEKHMMFIQIFKMCLLDLLPKKKSDDELYQKILSKQEKDLEELEKGLQVKLSNTEMSGAGDSEYITLADVEKKEREYSEQLIDNMEAFWKQMANIQHFLVDQFKCSSSKARQLMMTLTERMIAAEGLLCDSQELQALDALERTMGRAHMAKVIEFLKLQVQEETRCRLAAISHGLELLAGEGKLSGRQKEELLTQQHKAFWQEAERFSREFVQRGKDLVTASLAHQVEGTAKLTLAQEEEQRSFLAEAQPTADPEKFLEAFHEVLERQRLMQCDLEEEENVRATEAVVALCQELYFSTVDTFQKFVDALFLQTLPGMTGLPPEECDYLRQEVQENAAWQLGKSNRFRRQQWKLFQELLEQDQQVWMEECALSSVLQTHLREDHEGTIRGVLGRLGGLTEESTRCVLQGHDLLLRSALRRLALRGNALATLTQMRLSGKKHLLQELREQRALEQGSSQCLDEHQWQLLRALEARVLEEASRLEEEAQQTRLQLQQRLLAEAQEVGQLLQQHMECAIGQALLVHARNAATKSRAKDRDDFKRTLMEAAVESVYVTSAGVSRLVQAYYQQIGRIMEDHEERKLQHLKTLQGERMENYKLRKKQELSNPSSGSRTAGGAHETSQAVHQRMLSQQKRFLAQFPVHQQMRLHAQQQQAGVMDLLEAQLETQLQEAEQNFISELAALARVPLAESKLLPAKRGLLEKPLRTKRKKPLPQERGDLGVPNNEDLASGDQTSGSLSSKRLSQQESEAGDSGNSKKMLKRRSNL

SEQ ID NO: 1455 - protein, 1308 aa, unidentified
MDPSGSRGRPTWVLAGGLLAVALALGGRGCLGASSRPRWRPLGAQPPRDPQVAPRSGPGLRIPPGRSGAGPESSTQDLPCMIWPKVECCHFKTAVEAPLGMKLDKKMEVFIPLSTSAASSGPWAHSLFAFIPSWPKKNLFKRESPITHRLYGDISREVQGTSENGVIFQKCALVSGSSEAQTARIWLLVNNTKTTSSANLSELLLLDSIAGLTIWDSVGNRTSEGFQAFSKKFLQVGDAFAVSYAATLQAGDLGNGESLKLPAQLTFQSSSRNRTQLKVLFSITAEENVTVLPHHGLHAAGFFIAFLLSLVLTWAALFLMVRYQCLKGNMLTRHRVWQYESKLEPLPFTSADGVNEDLSLNDQMIDILSSEDPGSMLQALEELEIATLNRADADLEACRTQISKDIIALLLKNLTSSGHLSPQVERKMSAVFKKQFLLLENEIQEEYDRKMVALTAECDLETRKKMENQYQREMMAMEEAEELLKRAGERSAVECSNLLRTLHGLEQEHLRKSLALQQEEDFAKAHRQLAVFQRNELHSIFFTQIKSAIFKGELKPEAAKMLLQNYSKIQENVEELMDFFQASKRYHLSKRFGHREYLVQNLQSSETRVQGLLSTAAAQLTHLIQKHERAGYLDEDQMEMLLERAQTEVFSIKQKLDNDLKQEKKKLHQKLITKRRRELLQKHREQRREQASVGEAFRTVEDAGQYLHQKRSLMEEHGATLEELQERLDQAALDDLRTLTLSLFEKATDELRRLQNSAMTQELLKRGVPWLFLQQILEEHGKEMAARAEQLEGEERDRDQEGVQSVRQRLKDDAPEAVTEEQAELRRWEHLIFMKLCSSVFSLSEEELLRMRQEVHGCFAQMDRSLALPKIRARVLLQQFQTAWREAEFVKLDQAVAAPELQQQSKVRKSRSKSKSKGELLKKCIEDKIHLCEEQASEDLVEKVRGELLRERVQRMEAQEGGFAQSLVALQFQKASRVTETLSAYTALLSIQDLLLEELSASEMLTKSACTQILESHSRELQELERKLEDQLVQQEAAQQQQALASWQQWVADGPGILNEPGEVDSERQVSTVLHQALSKSQTLLEQHQQCLREEQQNSVVLEDLLENMEADTFATLCSQELRLASYLARMAMVPGATLRRLLSVVLPTASQPQLLALLDSATERHVDHAAESDGGAEQADVGRRRKHQSWWQALDGKLRGDLISRGLEKMLWARKRKQSILKKTCLPLRERMIFSGKGSWPHLSLEPIGELAPVPIVGAETIDLLNTGEKLFIFRNPKEPEISLHVPPRKKKNFLNAKKAMRALGMD

SEQ ID NO: 1456 - protein, 236 aa, unidentified
MPTDMEHTGHYLHLAFLMTTVFSLSPGTKANYTRLWANSTSSWDSVIQNKTGRNQNENINTNPITPEVDYKGNSTNMPETSHIVALTSKSEQELYIPSVVSNSPSTVQSIENTSKSHGEIFKKDVCAENNNNMAMLICLIIIAVLFLICTFLFLSTVVLANKVSSLRRSKQVGKRQPRSNGDFLASGLWPAESDTWKRTKQLTGPNLVMQSTGVLTATRERKDEEGTEKLTNKQIG

SEQ ID NO: 1457 - protein, 448 aa, unidentified
MDPKYFILILFCGHLNNTFFSKTETITTEKQSQPTLFTSSMSQVLANSQNTTGNPLGQPTQFSDTFSGQSISPAKVTAGQPTPAVYTSSEKPEAHTSAGQPLAYNTKQPTPIANTSSQQAVFTSARQLPSARTSTTQPPKSFVYTFTQQSSSVQIPSRKQITVHNPSTQPTSTVKNSPRSTPGFILDTTSNKQTPQKNNYNSIAAILIGVLLTSMLVAIIIIVLWKCLRKPVLNDQNWAGRSPFADGETPDICMDNIRENEISTKRTSIISLTPWKPSKSTLLADDLEIKLFESSENIEDSNNPKTEKIKDQVNGTSEDSADGSTVGTAVSSSDDADLPPPPPLLDLEGQESNQSDKPTMTIVSPLPNDSTSLPPSLDCLNQDCGDHKSEIIQSFPPLDSLNLPLPPVDFMKNQEDSNLEIQCQEFSIPPNSDQDLNESLPPPPAELL

SEQ ID NO: 1458 - protein, 810 aa, unidentified
MVTNKMTAAFRNPSGKQVATDKVAEKLSSTLSWVKNTVSHTVSQMASQVASPSTSLHTTSSSTTLSTPALSPSSPSQLSPDDLELLAKLEEQNRLLETDSKSLRSVNGSRRNSGSSLVSSSSASSNLSHLEEDSWILWGRIVNEWEDVRKKKEKQVKELVHKGIPHHFRAIVWQLLCSAQSMPIKDQYSELLKMTSPCEKLIRRDIARTYPEHNFFKEKDSLGQEVLFNVMKAYSLVDREVGYCQGSAFIVGLLLMQMPEEEAFCVFVKLMQDYRLRELFKPSMAELGLCMYQFECMIQEHLPELFVHFQSQSFHTSMYASSWFLTIFLTTFPLPIATRIFDIFMSEGLEIVFRVGLALLQMNQAELMQLDMEGMLQHFQKVIPHQFDGVPDKLIQAAYQVKYNSKKMKKLEKEYTTIKTKEMEEQVEIKRLRTENRLLKQRIETLEKHKCSSNYNEDFVLQLEKELVQARLSEAESQCALKEMQDKVLDIEKRNNSLPDENNIARLQEELIAVKLREAEAIMGLKELRQQVKDLEEHWQRHLARTTGRWKDPPKKNAMNELQDELMTIRLREAETQAEIREIKQRMMEMETQNQINSNHLRRAEQEVISLQEKVQYLSAQNKGLLTQLSEAKRKQAEIECKNKEEVMAVRLREADSIAAVAELRQHIAELEIQKEEGKLQGQLNKSDSNQYIGELKDQIAELNHELRCLKGQRGFSGQPPFDGIHIVNHLIGDDESFHSSDEDFIDNSLQETGVGFPLHGKSGSMSLDPAVADGSESETEDSVLETRESNQVVQKERPPRRRESYSTTV

SEQ ID NO: 1459 - protein, 794 aa, unidentified
MASPTLSPDSSSQEALSAPTCSPTSDSENLSPDELELLAKLEEQNRLLEADSKSMRSMNGSRRNSGSSLVSSSSASSNLSHLEEDTWILWGRIANEWEEWRRRKEKLLKELIRKGIPHHFRAIVWQLLCSATDMPVKNQYSELLKMSSPCEKLIRRDIARTYPEHEFFKGQDSLGQEVLFNVMKAYSLVDREVGYCQGSAFIVGLLLMQMPEEEAFCVFVRLMQEYRLRELFKPSMAELGLCIYQFEYMLQEQLPDLNTHFRSQSFHTSMYASSWFLTLFLTTFPLPVATRVFDIFMYEGLEIVFRVGLALLQVNQAELMQLDMEGMSQYFQRVIPHQFDSCPDKLVLKAYQVKYNPKKMKRLEKEYAAMKSKEMEEQIEIKRLRTENRLLKQRIETLEKGQVTRAQEAEENYVIKRELAVVRQQCSSAAEDLQKAQSTIRQLQEQQENPRLTEDFVSHLETELEQSRLRETETLGALREMQDKVLDMEKRNSSLPDENNVAQLQEELKALKVREGQAVASTRELKLQLQELSDTWQAHLARGGRWKESPRKLVVGELQDELMSVRLREAQALAEGRELRQRVVELETQDHIHRNLLNRVEAERAALQEKLQYLAAQNKGLQTQLSESRRKQAEAECKSKEEVMAVRLREADSMAAVAEMRQRIAELEIQREEGRIQGQLNHSDSSQYIRELKDQIEELKAEVRLLKGPPPFEDPLAFDGLSLARHLDEDSLPSSDEELLGVGVGAALQDALYPLSPRDARFFRRLERPAKDSEGSSDSDADELAAPYSQGLDN

SEQ ID NO: 1460 - protein, 621 aa, unidentified
MSRQNLVALTVTTLLGVAVGGFVLWKGIQRRRRSKTSPVTQQPQQKVLGSRELPPPEDDQLHSSAPRSSWKERILKAKVVTVSQEAEWDQIEPLLRSELEDFPVLGIDCEWVNLEGKASPLSLLQMASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQVIYAARDAQISVALFLHLLGYPFSRNSPGEKNDDHSSWRKVLEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETRISNENYVPHGLKVVQCHSQGGLRSLMQLESRWRQHFLDSMQPKHLPQQWSVDHNHQKLLRKFGEDLPIQLS

SEQ ID NO: 1461 - protein, 746 aa, unidentified
MQAKKRYFILLSAGSCLALLFYFGGLQFRASRSHSRREEHSGRNGLHHPSPDHFWPRFPDALRPFVPWDQLENEDSSVHISPRQKRDANSSIYKGKKCRMESCFDFTLCKKNGFKVYVYPQQKGEKIAESYQNILAAIEGSRFYTSDPSQACLFVLSLDTLDRDQLSPQYVHNLRSKVQSLHLWNNGRNHLIFNLYSGTWPDYTEDVGFDIGQAMLAKASISTENFRPNFDVSIPLFSKDHPRTGGERGFLKFNTIPPLRKYMLVFKGKRYLTGIGSDTRNALYHVHNGEDVVLLTTCKHGKDWQKHKDSRCDRDNTEYEKYDYREMLHNATFCLVPRGRRLGSFRFLEALQAACVPVMLSNGWELPFSEVINWNQAAVIGDERLLLQIPSTIRSIHQDKILALRQQTQFLWEAYFSSVEKIVLTTLEIIQDRIFKHISRNSLIWNKHPGGLFVLPQYSSYLGDFPYYYANLGLKPPSKFTAVIHAVTPLVSQSQPVLKLLVAAAKSQYCAQIIVLWNCDKPLPAKHRWPATAVPVVVIEGESKVMSSRFLPYDNIITDAVLSLDEDTVLSTTEVDFAFTVWQSFPERIVGYPARSHFWDNSKERWGYTSKWTNDYSMVLTGAAIYHKYYHYLYSHYLPASLKNMVDQLANCEDILMNFLVSAVTKLPPIKVTQKKQYKETMMGQTSRASRWADPDHFAQRQSCMNTFASWFGYMPLIHSQMRLDPVLFKDQVSILRKKYRDIERL

SEQ ID NO: 1462 - protein, 718 aa, unidentified
MCASVKYNIRGPALIPRMKTKHRIYYITLFSIVLLGLIATGMFQFWPHSIESSNDWNVEKRSIRDVPVVRLPADSPIPERGDLSCRMHTCFDVYRCGFNPKNKIKVYIYALKKYVDDFGVSVSNTISREYNELLMAISDSDYYTDDINRACLFVPSIDVLNQNTLRIKETAQAMAQLSRWDRGTNHLLFNMLPGGPPDYNTALDVPRDRALLAGGGFSTWTYRQGYDVSIPVYSPLSAEVDLPEKGPGPRQYFLLSSQVGLHPEYREDLEALQVKHGESVLVLDKCTNLSEGVLSVRKRCHKHQVFDYPQVLQEATFCVVLRGARLGQAVLSDVLQAGCVPVVIADSYILPFSEVLDWKRASVVVPEEKMSDVYSILQSIPQRQIEEMQRQARWFWEAYFQSIKAIALATLQIINDRIYPYAAISYEEWNDPPAVKWGSVSNPLFLPLIPPQSQGFTAIVLTYDRVESLFRVITEVSKVPSLSKLLVVWNNQNKNPPEDSLWPKIRVPLKVVRTAENKLSNRFFPYDEIETEAVLAIDDDIIMLTSDELQFGYEVWREFPDRLVGYPGRLHLWDHEMNKWKYESEWTNEVSMVLTGAAFYHKYFNYLYTYKMPGDIKNWVDAHMNCEDIAMNFLVANVTGKAVIKVTPRKKFKCPECTAIDGLSLDQTHMVERSECINKFASVFGTMPLKVVEHRADPVLYKDDFPEKLKSFPNIGSL

SEQ ID NO: 1463 - protein, 919 aa, unidentified
MTGYTMLRNGGAGNGGQTCMLRWSNRIRLTWLSFTLFVILVFFPLIAHYYLTTLDEADEAGKRIFGPRVGNELCEVKHVLDLCRIRESVSEELLQLEAKRQELNSEIAKLNLKIEACKKSIENAKQDLLQLKNVISQTEHSYKELMAQNQPKLSLPIRLLPEKDDAGLPPPKATRGCRLHNCFDYSRCPLTSGFPVYVYDSDQFVFGSYLDPLVKQAFQATARANVYVTENADIACLYVILVGEMQEPVVLRPAELEKQLYSLPHWRTDGHNHVIINLSRKSDTQNLLYNVSTGRAMVAQSTFYTVQYRPGFDLVVSPLVHAMSEPNFMEIPPQVPVKRKYLFTFQGEKIESLRSSLQEARSFEEEMEGDPPADYDDRIIATLKAVQDSKLDQVLVEFTCKNQPKPSLPTEWALCGEREDRLELLKLSTFALIITPGDPRLVISSGCATRLFEALEVGAVPVVLGEQVQLPYQDMLQWNEAALVVPKPRVTEVHFLLRSLSDSDLLAMRRQGRFLWETYFSTADSIFNTVLAMIRTRIQIPAAPIREEAAAEIPHRSGKAAGTDPNMADNGDLDLGPVETEPPYASPRYLRNFTLTVTDFYRSWNCAPGPFHLFPHTPFDPVLPSEAKFLGSGTGFRPIGGGAGGSGKEFQAALGGNVPREQFTVVMLTYEREEVLMNSLERLNGLPYLNKVVVVWNSPKLPSEDLLWPDIGVPIMVVRTEKNSLNNRFLPWNEIETEAILSIDDDAHLRHDEIMFGFRVWREARDRIVGFPGRYHAWDIPHQSWLYNSNYSCELSMVLTGAAFFHKYYAYLYSYVMPQAIRDMVDEYINCEDIAMNFLVSHITRKPPIKVTSRWTFRCPGCPQALSHDDSHFHERHKCINFFVKVYGYMPLLYTQFRVDSVLFKTRLPHDKTKCFKFI

SEQ ID NO: 1464 - protein, 299 aa, unidentified
MGTKAQVERKLLCLFILAILLCSLALGSVTVHSSEPEVRIPENNPVKLSCAYSGFSSPRVEWKFDQGDTTRLVCYNNKITASYEDRVTFLPTGITFKSVTREDTGTYTCMVSEEGGNSYGEVKVKLIVLVPPSKPTVNIPSSATIGNRAVLTCSEQDGSPPSEYTWFKDGIVMPTNPKSTRAFSNSSYVLNPTTGELVFDPLSASDTGEYSCEARNGYGTPMTSNAVRMEAVERNVGVIVAAVLVTLILLGILVFGIWFAYSRGHFDRTKKGTSSKKVIYSQPSARSEGEFKQTSSFLV

SEQ ID NO: 1465 - protein, 425 aa, unidentified
MGPRRLLLVAACFSLCGPLLSARTRARRPESKATNATLDPRSFLLRNPNDKYEPFWEDEEKNESGLTEYRLVSINKSSPLQKQLPAFISEDASGYLTSSWLTLFVPSVYTGVFVVSLPLNIMAIVVFILKMKVKKPAVVYMLHLATADVLFVSVLPFKISYYFSGSDWQFGSELCRFVTAAFYCNMYASILLMTVISIDRFLAVVYPMQSLSWRTLGRASFTCLAIWALAIAGVVPLLLKEQTIQVPGLNITTCHDVLNETLLEGYYAYYFSAFSAVFFFVPLIISTVCYVSIIRCLSSSAVANRSKKSRALFLSAAVFCIFIICFGPTNVLLIAHYSFLSHTSTTEAAYFAYLLCVCVSSISCCIDPLIYYYASSECQRYVYSILCCKESSDPSSYNSSGQLMASKMDTCSSNLNNSIYKKLLT

SEQ ID NO: 1466 - protein, 397 aa, unidentified
MRSPSAAWLLGAAILLAASLSCSGTIQGTNRSSKGRSLIGKVDGTSHVTGKGVTVETVFSVDEFSASVLTGKLTTVFLPIVYTIVFVVGLPSNGMALWVFLFRTKKKHPAVIYMANLALADLLSVIWFPLKIAYHIHGNNWIYGEALCNVLIGFFYGNMYCSILFMTCLSVQRYWVIVNPMGHSRKKANIAIGISLAIWLLILLVTIPLYVVKQTIFIPALNITTCHDVLPEQLLVGDMFNYFLSLAIGVFLFPAFLTASAYVLMIRMLRSSAMDENSEKKRKRAIKLIVTVLAMYLICFTPSNLLLVVHYFLIKSQGQSHVYALYIVALCLSTLNSCIDPFVYYFVSHDFRDHAKNALLCRSVRTVKQMQVSLTSKKHSRKSSSYSSSSTTVKTSY

SEQ ID NO: 1467 - protein, 374 aa, unidentified
MKALIFAAAGLLLLLPTFCQSGMENDTNNLAKPTLPIKTFRGAPPNSFEEFPFSALEGWTGATITVKIKCPEESASHLHVKNATMGYLTSSLSTKLIPAIYLLVFVVGVPANAVTLWMLFFRTRSICTTVFYTNLAIADFLFCVTLPFKIAYHLNGNNWVFGEVLCRATTVIFYGNMYCSILLLACISINRYLAIVHPFTYRGLPKHTYALVTCGLVWATVFLYMLPFFILKQEYYLVQPDITTCHDVHNTCESSSPFQLYYFISLAFFGFLIPFVLIIYCYAAIIRTLNAYDHRWLWYVKASLLILVIFTICFAPSNIILIIHHANYYYNNTDGLYFIYLIALCLGSLNSCLDPFLYFLMSKTRNHSTAYLTK

SEQ ID NO: 1468 - protein, 385 aa, unidentified
MWGRLLLWPLVLGFSLSGGTQTPSVYDESGSTGGGDDSTPSILPAPRGYPGQVCANDSDTLELPDSSRALLLGWVPTRLVPALYGLVLVVGLPANGLALWVLATQAPRLPSTMLLMNLAAADLLLALALPPRIAYHLRGQRWPFGEAACRLATAALYGHMYGSVLLLAAVSLDRYLALVHPLRARALRGRRLALGLCMAAWLMAAALALPLTLQRQTFRLARSDRVLCHDALPLDAQASHWQPAFTCLALLGCFLPLLAMLLCYGATLHTLAASGRRYGHALRLTAVVLASAVAFFVPSNLLLLLHYSDPSPSAWGNLYGAYVPSLALSTLNSCVDPFIYYYVSAEFRDKVRAGLFQRSPGDTVASKASAEGGSRGMGTHSSLLQ

SEQ ID NO: 1469 - protein, 295 aa, unidentified
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 1470 - protein, 372 aa, unidentified
MAPAPPPAASFSPSEVQRRLAAGACWVRRGARLYDLSSFVRHHPGGEQLLRARAGQDISADLDGPPHRHSANARRWLEQYYVGELRGEQQGSMENEPVALEETQKTDPAMEPRFKVVDWDKDLVDWRKPLLWQVGHLGEKYDEWVHQPVTRPIRLFHSDLIEGLSKTVWYSVPIIWVPLVLYLSWSYYRTFAQGNVRLFTSFTTEYTVAVPKSMFPGLFMLGTFLWSLIEYLIHRFLFHMKPPSDSYYLIMLHFVMHGQHHKAPFDGSRLVFPPVPASLVIGVFYLCMQLILPEAVGGTVFAGGLLGYVLYDMTHYYLHFGSPHKGSYLYSLKAHHVKHHFAHQKSGFGISTKLWDYCFHTLTPEKPHLKTQ

SEQ ID NO: 1471 - protein, 579 aa, unidentified
MVQYELWAALPGASGVALACCFVAAAVALRWSGRRTARGAVVRARQRQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLKPTGNRLSKSGLKGCVYGQEAVRLSVGPMARDVESLALCLRALLCEDMFRLDPTVPPLPFREEVYTSSQPLRVGYYETDNYTMPSPAMRRAVLETKQSLEAAGHTLVPFLPSNIPHALETLSTGGLFSDGGHTFLQNFKGDFVDPCLGDLVSILKLPQWLKGLLAFLVKPLLPRLSAFLSNMKSRSAGKLWELQHEIEVYRKTVIAQWRALDLDVVLTPMLAPALDLNAPGRATGAVSYTMLYNCLDFPAGVVPVTTVTAEDEAQMEHYRGYFGDIWDKMLQKGMKKSVGLPVAVQCVALPWQEELCLRFMREVERLMTPEKQSS

SEQ ID NO: 1472 - protein, 444 aa, unidentified
MAPDPVAAETAAQGPTPRYFTWDEVAQRSGCEERWLVIDRKVYNISEFTRRHPGGSRVISHYAGQDATDPFVAFHINKGLVKKYMNSLLIGELSPEQPSFEPTKNKELTDEFRELRATVERMGLMKANHVFFLLYLLHILLLDGAAWLTLWVFGTSFLPFLLCAVLLSAVQAQAGWLQHDFGHLSVFSTSKWNHLLHHFVIGHLKGAPASWWNHMHFQHHAKPNCFRKDPDINMHPFFFALGKILSVELGKQKKKYMPYNHQHKYFFLIGPPALLPLYFQWYIFYFVIQRKKWVDLAWMITFYVRFFLTYVPLLGLKAFLGLFFIVRFLESNWFVWVTQMNHIPMHIDHDRNMDWVSTQLQATCNVHKSAFNDWFSGHLNFQIEHHLFPTMPRHNYHKVAPLVQSLCAKHGIEYQSKPLLSAFADIIHSLKESGQLWLDAYLHQ

SEQ ID NO: 1473 - protein, 444 aa, unidentified
MGKGGNQGEGAAEREVSVPTFSWEEIQKHNLRTDRWLVIDRKVYNITKWSIQHPGGQRVIGHYAGEDATDAFRAFHPDLEFVGKFLKPLLIGELAPEEPSQDHGKNSKITEDFRALRKTAEDMNLFKTNHVFFLLLLAHIIALESIAWFTVFYFGNGWIPTLITAFVLATSQAQAGWLQHDYGHLSVYRKPKWNHLVHKFVIGHLKGASANWWNHRHFQHHAKPNIFHKDPDVNMLHVFVLGEWQPIEYGKKKLKYLPYNHQHEYFFLIGPPLLIPMYFQYQIIMTMIVHKNWVDLAWAVSYYIRFFITYIPFYGILGALLFLNFIRFLESHWFVWVTQMNHIVMEIDQEAYRDWFSSQLTATCNVEQSFFNDWFSGHLNFQIEHHLFPTMPRHNLHKIAPLVKSLCAKHGIEYQEKPLLRALLDIIRSLKKSGKLWLDAYLHK

SEQ ID NO: 1474 - protein, 445 aa, unidentified
MGGVGEPGPREGPAQPGAPLPTFCWEQIRAHDQPGDKWLVIERRVYDISRWAQRHPGGSRLIGHHGAEDATDAFRAFHQDLNFVRKFLQPLLIGELAPEEPSQDGPLNAQLVEDFRALHQAAEDMKLFDASPTFFAFLLGHILAMEVLAWLLIYLLGPGWVPSALAAFILAISQAQSWCLQHDLGHASIFKKSWWNHVAQKFVMGQLKGFSAHWWNFRHFQHHAKPNIFHKDPDVTVAPVFLLGESSVEYGKKKRRYLPYNQQHLYFFLIGPPLLTLVNFEVENLAYMLVCMQWADLLWAASFYARFFLSYLPFYGVPGVLLFFVAVRVLESHWFVWITQMNHIPKEIGHEKHRDWVSSQLAATCNVEPSLFTNWFSGHLNFQIEHHLFPRMPRHNYSRVAPLVKSLCAKHGLSYEVKPFLTALVDIVRSLKKSGDIWLDAYLHQ

SEQ ID NO: 1475 - protein, 356 aa, unidentified [sequence omitted]

SEQ ID NO: 1476 - protein, 445 aa, unidentified
MAAPEERDLTQEQTEKLLQFQDLTGIESMDQCRHTLEQHNWNIEAAVQDRLNEQEGVPSVFNPPPSRPLQVNTADHRIYSYVVSRPQPRGLLGWGYYLIMLPFRFTYYTILDIFRFALRFIRPDPRSRVTDPVGDIVSFMHSFEEKYGRAHPVFYQGTYSQALNDAKRELRFLLVYLHGDDHQDSDEFCRNTLCAPEVISLINTRMLFWACSTNKPEGYRVSQALRENTYPFLAMIMLKDRRMTVVGRLEGLIQPDDLINQLTFIMDANQTYLVSERLEREERNQTQVLRQQQDEAYLASLRADQEKERKKREERERKRRKEEEVQQQKLAEERRRQNLQEEKERKLECLPPEPSPDDPESVKIIFKLPNDSRVERRFHFSQSLTVIHDFLFSLKESPEKFQIEANFPRRVLPCIPSEEWPNPPTLQEAGLSHTEVLFVQDLTDE

SEQ ID NO: 1477 - protein, 316 aa, unidentified
MTQGKLSVANKAPGTEGQQQVHGEKKEAPAVPSAPPSYEEATSGEGMKAGAFPPAPTAVPLHPSWAYVDPSSSSSYDNGFPTGDHELFTTFSWDDQKVRRVFVRKVYTILLIQLLVTLAVVALFTFCDPVKDYVQANPGWYWASYAVFFATYLTLACCSGPRRHFPWNLILLTVFTLSMAYLTGMLSSYYNTTSVLLCLGITALVCLSVTVFSFQTKFDFTSCQGVLFVLLMTLFFSGLILAILLPFQYVPWLHAVYAALGAGVFTLFLALDTQLLMGNRRHSLSPEEYIFGALNIYLDIIYIFTFFLQLFGTNRE

SEQ ID NO: 1478 - protein, 356 aa, unidentified
MAATRSPTRARERERSGAPAAGSDQVHSWMLATSQALDTVWRMAKGFVMLAVSFLVAAICYFRRLHLYSGHKLKWWIGYLQRKFKRNLSVEAEVDLLSYCAREWKGETPRNKLMRKAYEELFWRHHIKCVRQVRRDNYDALRSVLFQIFSQGISFPSWMKEKDIVKLPEKLLFSQGCNWIQQYSFGPEKYTGSNVFGKLRKYVELLKTQWTEFNGIRDYHKRGSMCNTLFSDAILEYKLYEALKFIMLYQVTEVYEQMKTKKVIPSLFRLLFSRETSSDPLSFMMNHLNSVGDTCGLEQIDMFILGYSLEVKIKVFRLFKFNSRDFEVCYPEEPLRDWPEISLLTENDRHYHIPVF

SEQ ID NO: 1479 - protein, 195 aa, unidentified
MAQEKMKLGFKSLPSSTTADGNILRRVNSAPLINGLGFNSQVLQADMLRIRTNRTTFRNRRSLLLPPPPFHGSISRLHQIKQEEAMDLINRETMSEWKLQSEIQISHSWEEGLKLVKWHFNINQKRFSKAQPTCFLLILPNCQKIMCIYFQLLLMETTAMLDLLVIRQLKSALSQTLLCHLLILVLICSSRQTFN

SEQ ID NO: 1480 - protein, 543 aa, unidentified
MASGGGGGNTGAGGGPGMGLSLGLGLGLSLGMSEATSEAEEEAATAEAVGRLATTLWLRLRGWEAVLAAAQRLLVWEKPLHSLVTAAALNGLFWLLSSSSLRPFFLLSVSLLAYFLLDLWQPRFLPDVSASSPEEPHSDSEGAGSGARPHLLSVPELCRYLAESWLTFQIHLQELLQYKRQNPAQFCVRVCSGCAVLAVLGHYVPGIMISYIVLLSILLWPLVVYHELIQRMYTRLEPLLMQLDYSMKAEANALHHKHDKRKRQGKNAPPGGDEPLAETESESEAELAGFSPVVDVKKTALALAITDSELSDEEASILESGGFSVSRATTPQLTDVSEDLDQQSLPSEPEETLSRDLGEGEEGELAPPEDLLGRPQALSRQALDSEEEEEDVAAKETLLRLSSPLHFVNTHFNGAGSPPDGVKCSPGGPVETLSPETVSGGLTALPGTLSPPLCLVGSDPAPSPSILPPVPQDSPQPLPAPEEEEALTTEDFELLDQGELEQLNAELGLEPETPPKPPDAPPLGPDIHSLVQSDQEAQAVAEP

SEQ ID NO: 1481 - protein, 497 aa, unidentified
MASPAPPEHAEEGCPAPAAEEQAPPSPPPPQASPAERQQQEEEAQEAGAAEGAGLQVEEAAGRAAAAVTWLLGEPVLWLGCRADELLSWKRPLRSLLGFVAANLLFWFLALTPWRVYHLISVMILGRVIMQIIKDMVLSRTRGAQLWRSLSESWEVINSKPDERPRLSHCIAESWMNFSIFLQEMSLFKQQSPGKFCLLVCSVCTFFTILGSYIPGVILSYLLLLCAFLCPLFKCNDIGQKIYSKIKSVLLKLDFGIGEYINQKKRERSEADKEKSHKDDSELDFSALCPKISLTVAAKELSVSDTDVSEVSWTDNGTFNLSEGYTPQTDTSDDLDRPSEEVFSRDLSDFPSLENGMGTNDEDELSLGLPTELKRKKEQLDSGHRPSKETQSAAGLTLPLNSDQTFHLMSNLAGDVITAAVTAAIKDQLEGVQQALSQAAPIPEEDTDTEEGDDFELLDQSELDQIESELGLTQDQEAEAQQNKKSSGFLSNLLGGH

SEQ ID NO: 1482 - protein, 466 aa, unidentified
MAEAEGVPTTPGPASGSTFRGRRDVSGSWERDQQVEAAQRALVEVLGPYEPLLSRVQAALVWERPARSALWCLGLNAAFWFFALTSLRLVFLLAFGLMIIVCIDQWKNKIWPEIKVPRPDALDNESWGFVHPRLLSVPELCHHVAEVWVSGTIFIRNVLLFKKQNPGKFCLLSCGILTFLAVLGRYVPGLLLSYLMLVTVMMWPLAVYHRLWDRAYVRLKPALQRLDFSVRGYMMSKQRERQLRRRALHPERAMDNHSDSEEELAAFCPQLDDSTVARELAITDSEHSDAEVSCTDNGTFNLSRGQTPLTEGSEDLDGHSDPEESFARDLPDFPSINMDPAGLDDEDDTSIGMPSLMYRSPPGAEEPQAPPASRDEAALPELLLGALPVGSNLTSNLASLVSQGMIQLALSGASQPGPSGAPAQRATRGFLRSPSSDLDTDAEGDDFELLDQSELSQLDPASSRSH

SEQ ID NO: 1483 - protein, 458 aa, unidentified
MTRGAWMCRQYDDGLKIWLAAPRENEKPFIDSERAQKWRLSLASLLFFTVLLSDHLWFCAEAKLTRARDKEHQQQQRQQQQQQQQQRQRQQQQQQRRQQEPSWPALLASMGESSPAAQAHRLLSASSSPTLPPSPGDGGGGGGKGNRGKDDRGKALFLGNSAKPVWRLETCYPQGASSGQCFTVENADAVCARNWSRGAAGGDGQEVRSKHPTPLWNLSDFYLSFCNSYTLWELFSGLSSPNTLNCSLDVVLKEGGEMTTCRQCVEAYQDYDHHAQEKYEEFESVLHKYLQSEEYSVKSCPEDCKIVYKAWLCSQYFEVTQFNCRKTIPCKQYCLEVQTRCPFILPDNDEVIYGGLSSFICTGLYETFLTNDEPECCDVRREEKSNNPSKGTVEKSGSCHRTSLTVSSATRLCNSRLKLCVLVLILLHTVLTASAAQNTAGLSFGGINTLEENSTNEE

SEQ ID NO: 1484 - protein, 472 aa, unidentified
MFRGAWMWPGKDAAALTICCCCCCWAPRPSDKPCADSERAQRWRLSLASLLFFTVLLADHLWLCAGARPRARELSSAMRPPWGAGRERQPVPPRAVLPLPPPPPGEPSAPPGTCGPRYSNLTKAAPAAGSRPVCGGVPEPTGLDAACTKLQSLQRLFEPTTPAPPLRPPDSLSRAPAEFPSAKKNLLKGHFRNFTLSFCDTYTVWDLLLGMDRPDSLDCSLDTLMGDLLAVVASPGSGAWEACSNCIEAYQRLDRHAQEKYDEFDLVLHKYLQAEEYSIRSCTKGCKAVYKAWLCSEYFSVTQQECQRWVPCKQYCLEVQTRCPFILPDNEEMVYGGLPGFICTGLLDTSPKRLETKCCDVQWVSCEAKKKKFKESEAPKTHQQQFHHSYFHHYHQQYHHYHPHHDPPGRVSNKPALLPVSGGSRLSPSRIRLCVLVLMLLHTVVSFSSNQGGGGLGLETLPALEEGLTREE

SEQ ID NO: 1485 - protein, 190 aa, unidentified
MSGACTSYVSAEQEVVRGFSCPRPGGEAAAVFCCGFRDHKYCCDDPHSFFPYEHSYMWWLSIGALIGLSVAAVVLLAFIVTACVLCYLFISSKPHTKLDLGLSLQTAGPEEVSPDCQGVNTGMAAEVPKVSPLQQSYSCLNPQLESNEGQAVNSKRLLHHCFMATVTTSDIPGSPEEASVPNPDLCGPVP

SEQ ID NO: 1486 - protein, 160 aa, unidentified
MSEASRLCSGYYSLNQSFVEPFQCPRRGEGAALQYCCGFADLKYCCSEPGSYFPYKHSYMWSLSIGALIGLGIAALVLLAFVISVCVLCYLFLYTKPQRLDTGLKLQHLEASSTQEGKSNGKTKALNSNAASNATNETYYEADDIIQEKTMDATQIHIAY

SEQ ID NO: 1487 - protein, 972 aa, unidentified
MERMNWLSRLASRGPGHRIPQGANLQTPVMADPETCLMVFKNHWSQVVRILERQGPRAAPGGADDLSAVRNHTYQMLTLLAEDRAVPSAPTGPGPLLEFALHEDLLTRVLTWQLQWDELGDGVEERRAEQLKLFEMLVSEARQPLLRHGPVREALLTLLDACGRPVPSSPALDEGLVLLLSQLCVCVAQEPSLLEFFLQPPPEPGAAPRLLLFSRLVPFVHREGTLGQQARDALLLLMALSAGSPTVGRYIADHSYFCPVLATGLSALYSSLPRKIEVPGDDWHCLRREDWLGVPALALFMSSLEFCNAVIQVAHPLVQKQLVDYIHNGFLVPVMGPALHKTSVEEMIASTAYLELFLRSISEPALLRTFLRFLLLHRHDTHTILDTLVARIGSNSRLCMVSLSLFRTLLNLSCEDVLLQLVLRYLVPCNHVMLSQKPAVRDVDLYGRAADKFLSLIPRCCRHHAPSPPRPEHASWARGPGSPSVDSSSVTTVPRPSTPSRLALFLRQQSLGGSESPGPAPCSPGLSASPASSPGRRPTPAEEPGELEDNYLEYLREARRGVDRCVRACRTWSAPYDGERPSPEPSPFGSRTKKRSLLPEEDRNNVGEGEEEELGRRGRAGGAGEGPGHLPPPQLNGVPGSWPEGAKKVRLVPKEGAGELLEGISEGMAGLEGFGQELRELEVALSNGGTGSESPLEPPLPLEEEEAYESFTCPPEPPGPFLSSPLRTLNQLPSQPFTGPFMAVLFAKLENMLQNSVYVNFLLTGLVAQLACHPQPLLRSFLLNTNMVFQPSVKSLLQVLGSVKNKIENFAASQEDFPALLSKAKKYLIARGKLDWAEGPAAGPAPRRSDPLVKSRRPSLGELLLRHAHSPTRARQAAQLVLQPGRDGAGLGLSGGSPGASTPVLLTRGGAPERQGEALRVKNAVYCAVIFPEFLKELAAISQAHAVTSPFLLETSEEGSGPLISGCGPLNP

SEQ ID NO: 1488 - protein, 154 aa, unidentified
MGSLSGLRLAAGSCFRLCERDVSSSLRLTRSSDLKRINGFCTKPQESPGAPSRTYNRVPLHKPTDWQKKILIWSGRFKKEDEIPETVSLEMLDAAKNKMRVKISYLMIALTVVGCIFMVIEGKKAAQRHETLTSLNLEKKARLKEEAAMKAKTE

SEQ ID NO: 1489 - protein, 162 aa, unidentified
MLRAVGSLLRLGRGLTVRCGPGAPLEATRRPAPALPPRGLPCYSSGGAPSNSGPQGHGEIHRVPTQRRPSQFDKKILLWTGRFKSMEEIPPRIPPEMIDTARNKARVKACYIMIGLTIIACFAVIVSAKRAVERHESLTSWNLAKKAKWREEAALAAQAKAK

SEQ ID NO: 1490 - protein, 167 aa, unidentified
MTAGTVVITGGILATVILLCIIAVLCYCRLQYYCCKKSGTEVADEEEEREHDLPTHPRGPTCNACSSQALDGRGSLAPLTSEPCSQPCGVAASHCTTCSPYSSPFYIRTADMVPNGGGGERLSFAPTYYKEGGPPSLKLAAPQSYPVTWPGSGREAFTNPRAISTDV

SEQ ID NO: 1491 - protein, 166 aa, unidentified
MTAGTVVITGGILATVILLCIIAVLCYCRLQYYCCKKDESEEDEEEPDFAVHSHLPPLHSNRNLVLTNGPALYPTASTSFSQKSPQARALCRSCSHCEPPTFFLQEPPEEEEDVLNGGERVLYKSVSQEDVELPPGGFGGLQALNPNRLSAMREAFARSRSISTDV

SEQ ID NO: 1492 - protein, 890 aa, unidentified
MSRSATLLLCLLGCHVWKAVTKTLREPGAGAQEVTLKVHISDASTHQPVADALIEIFTNQASIASGTSGTDGVAFIKFQYKLGSQLIVTASKHAYVPNSAPWKPIRLPVFSSLSLGLLPERSATLMVYEDVVQIVSGFQGARPQPRVHFQRRALRLPENTSYSDLTAFLTAASSPSEVDSFPYLRGLDGNGTGNSTRHDLTPVTAVSVHLLSSNGTPVLVDGPIYVTVPLATQSSLRHNAYVAAWRFDQKLGTWLKSGLGLVHQEGSQLTWTYIAPQLGYWVAAMSPPIPGPVVTQDITTYHTVFLLAILGGMAFILLVLLCLLLYYCRRKCLKPRQHHRKLQLPAGLESSKRDQSTSMSHINLLFSRRASEFPGPLSVTSHGRPEAPGTKELMSGVHLEMMSPGGEGDLHTPMLKLSYSTSQEFSSREELLSCKEEDKSQISFDNLTPSGTLGKDYHKSVEVFPLKARKSMEREGYESSGNDDYRGSYNTVLSQPLFEKQDREGPASTGSKLTIQEHLYPAPSSPEKEQLLDRRPTECMMSRSVDHLERPTSFPRPGQLICCSSVDQVNDSVYRKVLPALVIPAHYMKLPGDHSYVSQPLVVPADQQLEIERLQAELSNPHAGIFPHPSSQIQPQPLSSQAISQQHLQDAGTREWSPQNASMSESLSIPASLNDAALAQMNSEVQLLTEKALMELGGGKPLPHPRAWFVSLDGRSNAHVRHSYIDLQRAGRNGSNDASLDSGVDMNEPKSARKGRGDALSLQQNYPPVQEHQQKEPRAPDSTAYTQLVYLDDVEQSGSECGTTVCTPEDSALRCLLEGSSRRSGGQLPSLQEETTRRTADAPSEPAASPHQRRSAHEEEEDDDDDDQGEDKKSPWQKREERPLMAFNIK

SEQ ID NO: 1493 - protein, 826 aa, unidentified
MPPASGPSVLARLLPLLGLLLGSASRAPGKSPPEPPSPQEILIKVQVYVSGELVPLARASVDVFGNRTLLAAGTTDSEGVATLPLSYRLGTWVLVTAARPGFLTNSVPWRVDKLPLYASVSLYLLPERPATLILYEDLVHILLGSPGARSQPLVQFQRRAARLPVSSTYSQLWASLTPASTQQEMRAFPAFLGTEASSSGNGSWLELMPLTAVSVHLLTGNGTEVPLSGPIHLSLPVPSETRALTVGTSIPAWRFDPKSGLWVRNGTGVIRKEGRQLYWTFVSPQLGYWVAAMASPTAGLVTITSGIQDIGTYHTIFLLTILAALALLVLILLCLLIYYCRRRCLKPRQQHRKLQLSGPSDGNKRDQATSMSQLHLICGGPLEPAPSGDPEAPPPGPLHSAFSSSRDLASSRDDFFRTKPRSASRPAAEPSGARGGESAGLKGARSAEGPGGLEPGLEEHRRGPSGAAAFLHEPPSPPPPFDHYLGHKGAAEGKTPDFLLSQSVDQLARPPSLGQAGQLIFCGSIDHLKDNVYRNVMPTLVIPAHYVRLGGEAGAAGVGDEPAPPEGTAPGPARAFPQPDPQRPQMPGHSGPGGEGGGGGGEGWGAGRAAPVSGSVTIPVLFNESTMAQLNGELQALTEKKLLELGVKPHPRAWFVSLDGRSNSQVRHSYIDLQAGGGARSTDASLDSGVDVHEARPARRRPAREERERAPPAAPPPPPAPPRLALSEDTEPSSSESRTGLCSPEDNSLTPLLDEVAAPEGRAATVPRGRGRSRGDSSRSSASELRRDSLTSPEDELGAEVGDEAGDKKSPWQRREERPLMVFNVK

SEQ ID NO: 1494 - protein, 826 aa, unidentified
MARLCRRVPCTLLLGLAVVLLKARLVPAAARAELSRSDLSLIQQQQQQQQQQQQQQKQLEEAEEERTEVPGATSTLTVPVSVFMLKVQVNDIISRQYLSQAVVEVFVNYTKTNSTVTKSNGAVLIKVPYKLGLSLTIIAYKDGYVLTPLPWKTRRMPIYSSVTLSLFPQSQANIWLFEDTVLITGKLADAKSQPSVQFSKALIKLPDNHHISNVTGYLTVLQQFLKVDNFLHTTGITLNKPGFENIELTPLAAICVKIYSGGKELKVNGSIQVSLPLLRLNDISAGDRIPAWTFDMNTGAWVNHGRGMVKEHNNHLIWTYDAPHLGYWIAAPLPGTRGSGINEDSKDITAYHTVFLTAILGGTIVIVIGFFAVLLCYCRDKCGTPQKRERNITKLEVLKRDQTTSTTHINHISTVKVALKAEDKSQLFNAKNSSYSPQKKEPSKAETEERVSMVKTRDDFKIYNEDVSFLSVNQNNYSRNPTQSLEPNVGSKQPKHINNNLSSSLGDAQDEKRYLTGNEEAYGRSHIPEQLMHIYSQPIAILQTSDLFSTPEQLHTAKSATLPRKGQLVYGQLMEPVNRENFTQTLPKMPIHSHAQPPDAREEDIILEGQQSLPSQASDWSRYSSSLLESVSVPGTLNEAVVMTPFSSELQGISEQTLLELSKGKPSPHPRAWFVSLDGKPVAQVRHSFIDLKKGKRTQSNDTSLDSGVDMNELHSSRKLEREKTFIKSMHQPKILYLEDLDLSSSESGTTVCSPEDPALRHILDGGSGVIMEHPGEESPGRKSTVEDFEANTSPTKRRGRPPLAKRDSKTNIWKKREERPLIPIN

SEQ ID NO: 1495 - protein, 235 aa, unidentified
MEQDDPVEALTELRERRLGALELLQAAAGSGLAAYAVWALLLQPGFRRVPLRLQVPYVGASARQVEHVLSLLRGRPGKTVDLGSGDGRIVLAAHRCGLRPAVGYELNPWLVALARLHAWRAGCAGSVCYRRKDLWKVSLRDCRNVSVFLAPSVLPLLEDKLRTELPAGARVVSGRFPLPTWQPVTAVGEGLDRVWAYDVPEGGQAGEAASSRIPIQAAPGPSSAPIPGGLISQAS

SEQ ID NO: 1496 - protein, 233 aa, unidentified
MEGGGGIPLETLKEESQSRHVLPASFEVNSLQKSNWGFLLTGLVGGTLVAVYAVATPFVTPALRKVCLPFVPATTKQIENVVKMLRCRRGSLVDIGSGDGRIVIAAAKKGFTAVGYELNPWLVWYSRYRAWREGVHGSAKFYISDLWKVTFSQYSNVVIFGVPQMMLQLEKKLERELEDDARVIACRFPFPHWTPDHVTGEGIDTVWAYDASTFRGREKRPCTSMHFQLPIQA

SEQ ID NO: 1497 - protein, 190 aa, unidentified
MKASQCCCCLSHLLASVLLLLLLPELSGPLAVLLQAAEAAPGLGPPDPRPRTLPPLPPGPTPAQQPGRGLAEAAGPRGSEGGNGSNPVAGLETDDHGGKAGEGSVGGGLAVSPNPGDKPMTQRALTVLMVVSGAVLVYFVVRTVRMRRRNRKTRRYGVLDTNIENMELTPLEQDDEDDDNTLFDANHPRR

SEQ ID NO: 1498 - protein, 159 aa, unidentified
MRAVPLPAPLLPLLLLALLAAPAARASRAESVSAPWPEPERESRPPPGPGPGNTTRFGSGAAGGSGSSSSNSSGDALVTRISILLRDLPTLKAAVIVAFAFTTLLIACLLLRVFRSGKRLKKTRKYDIITTPAERVEMAPLNEEDDEDEDSTVFDIKYR

SEQ ID NO: 1499 - protein, 413 aa, unidentified
MHLALTTVLLWAWGLQAFEIVEKENIFQRTPCPAFLMFENAAYLADMSFELPCHCKPEEVPAVVWFYQKHLGSSHTKVLTDFDGRVLTEAAQVRVGSDMLTRFSIRMFSLLVFRAQSEDSGLYFCGTRKGDYFYAYDVDIQNSEGMVATFQDKGQEPFADEYYGHLHVFTTFWEWTPCDRCGVRGEQWRIGLCYLQSPDLSPRYLKAVPDVVSCGSRAVPRKLRTKARDHTPEVLVRSCLVPCEKTKTIREGVLAIINYVSKVGSRPWVPQVPIQFHQQRLGHGLIISCPGARPEHAVAWDKDRQHLYRTQYLKGVNRSMRVFIDHGNQLHIRFTQLDDRGIYYCWRQGVLVAGFRLGVTSHGHYPASFSDPETRSAVELTLIGYLLITAVFVTIHFCRCCCYLFHCCPSFSP

SEQ ID NO: 1500 - protein, 369 aa, unidentified
MPPMLWLLLHFAAPALGFYFSISCPSGKQCQQALLSGNDILLYCNSSGAHWYYLFTQGKKGRLTSLTNISNMEIMPEGSLLIKDPLPSQTGLYHCWNKNGRQVVQYEIDFQDVTTLHITHKDLGQRPLQNETLHLGSKQLIFTWWEPWQDCNRCEEPGECKRLGYRYIEEPLEEAMPCWLYLGEVLVWSSRLRPELQVEACHVQCTNNTQLRVDYVIFDNFRLDEKTEFVWLDCPLGSMYRPVNWRANDTPLTWESQLSGQDFTTFLDPSTGGRQLQVFQPAVYKCFVQQELVAQFKPAASLETLEAQWRENDAQWREARKALRGRADSVLKGLKLVLLVVTVLALLGALLKCIHPSPGRRSTQVLVVK

SEQ ID NO: 1501 - protein, 539 aa, unidentified
MPPAGGPRAPRPAALPRSLSRLRECPGRSRIVLALGATQMALGCLIVAVSFAALALTTSARVRHSCPFWAGFSVLLSGLIGVVSWKRPLSLVITFFMLLSAVCVMLNLAGSILSCQNAQLVNSLEGCQLIKFDSVEVCVCCELQHQSSGCSNLGETLKLNPLQENCNAVRLTLKDLLFSVCALNVLSTIVCALATAMCCMQMVSSDVLQMFLPQRSHPANPTCVTPHGTVLHQTLDFDEFIPPLPPPPYYPPEYTCTPSTEAQRGLHLDFAPSPFGTLYDVAINSPGLLYPAELPPPYEAVVGQPPASQVTSIGQQVAESSSGDPNTSAGFSTPVPADSTSLLVSEGTATPGSSPSPDGPVGAPAPSEPALPPGHVSPEDPGMGSQVQPGPGRVSRSTSDPTLCTSSMAGDASSHRPSCSQDLEAGLSEAVPGSASMSRSATAACRAQLSPAGDPDTWKTDQRPTPEPFPATSKERPRSLVDSKAYADARVLVAKFLEHSHCALPTEAQHMVGAMRLAVTNEERLEEEAVFGADVLDQV

SEQ ID NO: 1502 - protein, 450 aa, unidentified
MILLVNLFVLLSVVCVLLNLAGFILGCQGAQFVSSVPRCDLVDLGEGKICFCCEEFQPAKCTDKENALKLFPVQPCSAVHLLLKKVLFALCALNALTTTVCLVAAALRYLQIFATRRSCIDESQISAEEAEDHGRIPDPDDFVPPVPPPSYFATFYSCTPRMNRRMVGPDVIPLPHIYGARIKGVEVFCPLDPPPPYEAVVSQMDQEQGSSFQMSEGSEAAVIPLDLGCTQVTQDGDIPNIPAEENASTSTPSSTLVRPIRSRRALPPLRTRSKSDPVLHPSEERAAPVLSCEAATQTERRLDLAAVTLRRGLRSRASRCRPRSLIDYKSYMDTKLLVARFLEQSSCTMTPDIHELVENIKSVLKSDEEHMEEAITSASFLEQIMAPLQPSTSRAHKLPSRRQPGLLHLQSCGDLHTFTPAGRPRAERRPRRVEAERPHSLIGVIRETVL

SEQ ID NO: 1503 - protein, 668 aa, unidentified
MMPSPSDSSRSLTSRPSTRGLTHLRLHRPWLQALLTLGLVQVLLGILVVTFSMVASSVTTTESIKRSCPSWAGFSLAFSGVVGIVSWKRPFTLVISFFSLLSVLCVMLSMAGSVLSCKNAQLARDFQQCSLEGKVCVCCPSVPLLRPCPESGQELKVAPNSTCDEARGALKNLLFSVCGLTICAAIICTLSAIVCCIQIFSLDLVHTLAPERSVSGPLGPLGCTSPPPAPLLHTMLDLEEFVPPVPPPPYYPPEYTCSSETDAQSITYNGSMDSPVPLYPTDCPPSYEAVMGLRGDSQATLFDPQLHDGSCICERVASIVDVSMDSGSLVLSAIGDLPGGSSPSEDSCLLELQGSVRSVDYVLFRSIQRSRAGYCLSLDCGLRGPFEESPLPRRPPRAARSYSCSAPEAPPPLGAPTAARSCHRLEGWPPWVGPCFPELRRRVPRGGGRPAAAPPTRAPTRRFSDSSGSLTPPGHRPPHPASPPPLLLPRSHSDPGITTSSDTADFRDLYTKVLEEEAASVSSADTGLCSEACLFRLARCPSPKLLRARSAEKRRPVPTFQKVPLPSGPAPAHSLGDLKGSWPGRGLVTRFLQISRKAPDPSGTGAHGHKQVPRSLWGRPGRESLHLRSCGDLSSSSSLRRLLSGRRLERGTRPHSLSLNGGSRETGL

SEQ ID NO: 1504 - protein, 519 aa, unidentified
MTCPDKPGQLINWFICSLCVPRVRKLWSSRRPRTRRNLLLGTACAIYLGFLVSQVGRASLQHGQAAEKGPHRSRDTAEPSFPEIPLDGTLAPPESQGNGSTLQPNVVYITLRSKRSKPANIRGTVKPKRRKKHAVASAAPGQEALVGPSLQPQEAAREADAVAPGYAQGANLVKIGERPWRLVRGPGVRAGGPDFLQPSSRESNIRIYSESAPSWLSKDDIRRMRLLADSAVAGLRPVSSRSGARLLVLEGGAPGAVLRCGPSPCGLLKQPLDMSEVFAFHLDRILGLNRTLPSVSRKAEFIQDGRPCPIILWDASLSSASNDTHSSVKLTWGTYQQLLKQKCWQNGRVPKPESGCTEIHHHEWSKMALFDFLLQIYNRLDTNCCGFRPRKEDACVQNGLRPKCDDQGSAALAHIIQRKHDPRHLVFIDNKGFFDRSEDNLNFKLLEGIKEFPASAVSVLKSQHLRQKLLQSLFLDKVYWESQGGRQGIEKLIDVIEHRAKILITYINAHGVKVLPMNE

SEQ ID NO: 1505 - protein, 1335 aa, unidentified
MLSPTFVLWEVGYPLYIYGSIFIVIVIIWQVKRSHHELSSEPKRSCCRCHQKVRQRARDAASTARRRSREEAEKPQKLLSIIKSQGWLPLERSVRRILCADPCCQICNSVALEIQQLLVGENNQISLTLSGPLQGSSCLEMLSTSSMSLDQSLEFHSWHTRELSLSSVTPTLSQLTDQKSLTQSAAQSTYADGIQDYWADHLQLGQEFQVPDVLRGPNTIASSRIEKPRAPLNQEEMTQSNPSLVQGNQGQHHLNSQVSLLSLNPETLNRMHPMALHMVLPAHLPFLSPEVLRLLEVHVKKWMHFQRWGLPRRVEESLRQLMPNPPLYYQPGNDQPVSFNLKNTPQVSLHRFETISLQTWCSCVAGQPIQTFWVSEWSTMNPEQRHHCQQTPNPMALALPSPALKALSGPHPQSGGQDNDSGSDLQQKYSQLFCGLPSLHSESLVATFMGSQGLPKIENVPKPPLKDPFLFNELSFPQLLPKTSPQSAPPSSPLSPNWMSPSDHQRAQINVPFLTLAEYEALEWHLLQRQLQLQWGWPAALQRSQHTQCLMQHEPCGKAQSPETTTASQTGKSISVLTRELLFFPEHARKLLEFHIQKQLIRHRWGLPQKIQQSIQLLLTSTDQQTVSSSSTALANVSIPQPVALEANGACDVLSPIAAPVSIPRPHLLTQVKAILQSHIDSKCGQIHQGKIPACVHRSWDCRISGVLAVAPFPCIPESQFLELQTASDPDLHHKVMPWMPTALDQQQQALPGTVTEHPKLLRVLSVEAIEKLETTLRHKHLAFLSGLPALYYVALPRALAPAVTSQSVITEMEPSPVEIPAEPLIQMVSFEEQCISLGPCPQGNNESCTDVAKEFQPAVPVKGTMETLPLESQTHPTSPHSLQTHILTKLNFHLRKKVLEIQWGIPIRARKSREQTVAAPENISTQKSLESLNHQGETLLQELPIPPDTLPAPNPEGVHLKEQLANDLKAVQQNQKQSNSKAVPQGSAHSVSKISQPSGDMTEAHMPCVQVEANVNKPSLEEPCGPEPQSPSKSKDPAHVPMLAGNREDPEETKAARDHREGDAGFGRSSTREERRPAEDQRPAGMLPNKTPRGSWRWSRSFHLADPCQHSPQHHPQLKLPQLPPRVPGEKESEKDLQDSQTKLTVILEPATIPENAQTVLPQASQGQPFLSQPTQAKPLQGQTLQGQVLHGLVMPVHAQKKPSLTESSFRNKIKCFLQHINPKTKGKGHEDSMFSAAAKVAKTRKENVAKSLAPAKSPVGRSKTEKPTGCSKAQSRPAQKLVGPAFLDGPQSLDDKLRLHSRQPGSASALGYPRHCPRHCPREACANKPGHPT

SEQ ID NO: 1506 - protein, 171 aa, unidentified
MWTLKSSLVLLLCLTCSYAFMFSSLRQKTSEPQGKVQYGEHFRIRQNLPEHTQGWLGSKWLWLLFVVVPFVILQCQRDSEKNKEQSPPGLRGGQLHSPLKKKRNASPNKDCAFNTLMELEVELMKFVSKVRNLKRAMATGSGSNLRLRKSEMPADPYHVTICEIWGEESSS

SEQ ID NO: 1507 - protein, 171 aa, unidentified
MWTLKSSLVLLLCLTCSYAFMFSSLRQKTSEPQGKVPCGEHFRIRQNLPEHTQGWLGSKWLWLLFAVVPFVILQCQRDSEKNKEQSPPGLRGFPFRTPLKKNQNASLYKDCVFNTLNELEVELLKFVSEVQNLKGAMATGSGSNLKLRRSEMPADPYHVTICKIWGEESSS

SEQ ID NO: 1508 - protein, 272 aa, unidentified
MQWNVPRTVSRLARRTCLEPHNAGLFGHCQNVKGPLLLYNAESKVVLVQGPQKQWLHLSAAQCVAKERRPLDAHPPQPGVLRHKQGKQHVSFRRVFSSSATAQGTPEKKEEPDPLQDKSISLYQRFKKTFRQYGKVLIPVHLITSGVWFGTFYYAALKGVNVVPFLELIGLPDSVVSILKNSQSGNALTAYALFKIATPARYTVTLGGTSVTVKYLRSHGYMSTPPPVKEYLQDRMEETKELITEKMEETKDRLTEKLQETKEKVSFKKKVE

SEQ ID NO: 1509 - protein, 192 aa, unidentified
MAGLLALLGPAGRVGARVRPRATWLLGATAPCAPPPLALALLPPRLDARLLRTARGDCRGHQDPSQATGTTGSSVSCTEEKKQSKSQQLKKIFQEYGTVGVSLHIGISLISLGIFYMVVSSGVDMPAILLKLGFKESLVQSKMAAGTSTFVVAYAIHKLFAPVRISITLVSVPLIVRYFRKVGFFKPPAAKP

SEQ ID NO: 1510 - protein, 229 aa, unidentified
MSFLQDPSFFTMGMWSIGAGALGAAALALLLANTDVFLSKPQKAALEYLEDIDLKTLEKEPRTFKAKELWEKNGAVIMAVRRPGCFLCREEAADLSSLKSMLDQLGVPLYAVVKEHIRTEVKDFQPYFKGEIFLDEKKKFYGPQRRKMMFMGFIRLGVWYNFFRAWNGGFSGNLEGEGFILGGVFVVGSGKQGILLEHREKEFGDKVNLLSVLEAAKMIKPQTLASEKK

SEQ ID NO: 1511 - protein, 259 aa, unidentified
MRDRRGPLGTCLAQVQQAGGGDSDKLSCSLKKRMPEGPWPADAPSWMNKPVVDGNSQSEALSLEMRKDPSGAGLWLHSGGPVLPYVRESVRRNPASAATPSTAVGLFPAPTECFARVSCSGVEALGRRDWLGGGPRATDGHRGQCPKGEPRVSRLPRHQKVPEMGSFQDDPPSAFPKGLGSELEPACLHSILSATLHVYPEVLLSEETKRIFLDRLKPMFSKQTIEFKKMLKSTSDGLQITLGLLALQPFELANTLCHS

SEQ ID NO: 1512 - protein, 552 aa, unidentified
MLDHKDLEAEIHPLKNEERKSQENLGNPSKNEDNVKSAPPQSRLSRCRAAAFFLSLFLCLFVVFVVSFVIPCPDRPASQRMWRIDYSAAVIYDFLAVDDINGDRIQDVLFLYKNTNSSNNFSRSCVDEGFSSPCTFAAAVSGANGSTLWERPVAQDVALVECAVPQPRGSEAPSACILVGRPSSFIAVNLFTGETLWNHSSSFSGNASILSPLLQVPDVDGDGAPDLLVLTQEREEVSGHLYSGSTGHQIGLRGSLGVDGESGFLLHVTRTGAHYILFPCASSLCGCSVKGLYEKVTGSGGPFKSDPHWESMLNATTRRMLSHSSGAVRYLMHVPGNAGADVLLVGSEAFVLLDGQELTPRWTPKAAHVLRKPIFGRYKPDTLAVAVENGTGTDRQILFLDLGTGAVLCSLALPSLPGGPLSASLPTADHRSAFFFWGLHELGSTSETETGEARHSLYMFHPTLPRVLLELANVSTHIVAFDAVLFEPSRHAAYILLTGPADSEAPGLVSVIKHKVRDLVPSSRVVRLGEGGPDSDQAIRDRFSRLRYQSEA

SEQ ID NO: 1513 - protein, 622 aa, unidentified
MATVLSRALKLPGKKSPDLGEYDPLTQADSDESEDDLVLNLQKNGGVKNGKSPLGEAPEPDSDAEVAEAAKPHLSEVTTEGYPSEPLGGLEQKAASSLVSYVRTSVFLLTLGISMILVLLCAFLIPCPPRDLHSTWSRHLGSQGGGDLSPLELADVNGDGLRDVLLSFVMSRNGSAVGVSRPAANLVCLSGMNGSTLWSSLLPEEARDITCLELMPGSLAETICLVTGTHKMLSAFNATSGKAIWTLNPNYLSNGTLAAPVVVLPDLDEDGVRDLVVLAIGELQPDLCFLLVSGRTGNPVGRPVKYNIVGVGNLIGPQVYITTNGAVYILFGFGNIQAVALRDIFVQAQNRDSSPPSLQIEEPEWEKRRSINLSELIDVYSDGVELLQMVKAPDSNCSNLLITTRQSLVLLRGQNLTPYWALRLQGLRSQPTPGYFTDDQTLDFLLQIQDGVGMKKMMVVDGDSGSIVWSYRAPCHMKETPATSAVTSDQKSVFLFWAEGLSAASPNSDIILGTEPPSLHHLYLLHPAFPSILLDLANTTGTVTASEVGINDLWKDAFYVTRTTGPSSEGHPAALVVSKLSLRWALMEGQMAQLQESTPKIGRGELRRFLSRIKFVEAPYEI

SEQ ID NO: 1514 - protein, 314 aa, unidentified
MCPTLNNIVSSLQRNGIFINSLIAALTIGGQQLFSSSTFSCPCQVGKNFYYGSAFLVIPALILLVAGFALRSQMWTITGEYCCSCAPPYRRISPLECKLACLRFFSITGRAVIAPLTWLAVTLLTGTYYECAASEFASVDHYPMFDNVSASKREEILAGFPCCRSAPSDVILVRDEIALLHRYQSQMLGWILITLATIAALVSCCVAKCCSPLTSLQHCYWTSHLQNERELFEQAAEQHSRLLMMHRIKKLFGFIPGSEDVKHIRIPSCQDWKDISVPTLLCMGDDLQGHYSFLGNRVDEDNEEDRSRGIELKP

SEQ ID NO: 1515 - protein, 309 aa, unidentified
MDAFQGILKFFLNQKTVIGYSFMALLTVGSERLFSVVAFKCPCSTENMTYGLVFLFAPAWVLLILGFFLNNRSWRLFTGCCVNPRKIFPRGHSCRFFYVLGQITLSSLVAPVMWLSVALLNGTFYECAMSGTRSSGLLELICKGKPKECWEELHKVSCGKTSMLPTVNEELKLSLQAQSQILGWCLICSASFFSLLTTCYARCRSKVSYLQLSFWKTYAQKEKEQLENTFLDYANKLSERNLKCFFENKRPDPFPMPTFAAWEAASELHSFHQSQQHYSTLHRVVDNGLQLSPEDDETTMVLVGTAHNM

SEQ ID NO: 1516 - protein, 315 aa, unidentified
MEKFRAVLDLHVKHHSALGYGLVTLLTAGGERIFSAVAFQCPCSAAWNLPYGLVFLLVPALALFLLGYVLSARTWRLLTGCCSSARASCGSALRGSLVCTQISAAAALAPLTWVAVALLGGAFYECAATGSAAFAQRLCLGRNRSCAAELPLVPCNQAKASDVQDLLKDLKAQSQVLGWILIAVVIIILLIFTSVTRCLSPVSFLQLKFWKIYLEQEQQILKSKATEHATELAKENIKCFFEGSHPKEYNTPSMKEWQQISSLYTFNPKGQYYSMLHKYVNRKEKTHSIRSTEGDTVIPVLGFVDSSGINSTPEL

SEQ ID NO: 1517 - protein, 835 aa, unidentified
MSGGSQVHIFWGAPIAPLKITVSEDTASLMSVADPWKKIQLLYSQHSLYLKDEKQHKNLENYKVPESIGSPDLSGHFLANCMNRHVHVKDDFVRSVSETQNIESQKIHSSRLSDITSSNMQICGFKSTVPHFTEEEKYQKLLSENKIRDEQPKHQPDICGKNFNTNLFQLGHKCAAVLDLVCSTEKINIGPEVVQRECVPTEYHEIQNQCLGLFSSNAVDKSRSEAAVRKVSDLKISTDTEFLSIITSSQVAFLAQKKDKRRSPVNKGNVNMETEPKASYGEIRIPEENSIQLDGFTEAYESGQNQAYSLELFSPVCPKTENSRIHINSDKGLEEHTGSQELFSSEDELPPNEIRIELCSSGILCSQLNTFHKSAIKRSCTSEDKVGQSEALSRVLQVAKKMKLISNGGDSAVEMDRRNVSEFKSIKKTSLIKNCDSKSQKYNCLVMVLSPCHVKEINIKFGPNSGSKVPLATVTVIDQSETKKKVFLWRTAAFWAFTVFLGDIILLTDVVIHEDQWIGETVLQSTFSSQLLNLGSYSSIQPEEYSSVVSEVVLQDLLAYVSSKHSYLRDLPPRQPQRVNSIDFVELEHLQPDVLVHAVLRVVDFTILTEAVYSYRGQKQKKVMLTVEQAQDQHYALVLWGPGAAWYPQLQRKKGVVLIKAQISELAFPITASQKIALNAHSSLKSIFSSLPNIVYTGCAKCGLELETDENRIYKQCFSCLPFTMKKIYYRPALMTAIDGRHDVCIRVESKLIEKILLNISADCLNRVIVPSSEITYGMVVADLFHSLLAVSAEPCVLKIQSLFVLDENSYPLQQDFSLLDFYPDIVKHGANARL

SEQ ID NO: 1518 - protein, 230 aa, unidentified
MRLAGPLRIVVLVVSVGVTWIVVSILLGGPGSGFPRIQQLFTSPESSVTAAPRARKYKCGLPQPCPEEHLAFRVVSGAANVIGPKICLEDKMLMSSVKDNVGRGLNIALVNGVSGELIEARAFDMWAGDVNDLLKFIRPLHEGTLVFVASYDDPATKMNEETRKLFSELGSRNAKELAFRDSWVFVGAKGVQNKSPFEQHVKNSKHSNKYEGWPEALEMEGCIPRRSTAS

SEQ ID NO: 1519 - protein, 235 aa, unidentified
MRPLAGGLLKVVFVVFASLCAWYSGYLLAELIPDAPLSSAAYSIRSIGERPVLKAPVPKRQKCDHWTPCPSDTYAYRLLSGGGRSKYAKICFEDNLLMGEQLGNVARGINIAIVNYVTGNVTATRCFDMYEGDNSGPMTKFIQSAAPKSLLFMVTYDDGSTRLNNDAKNAIEALGSKEIRNMKFRSSWVFIAAKGLELPSEIQREKINHSDAKNNRYSGWPAEIQIEGCIPKERS

SEQ ID NO: 1520 - protein, 224 aa, unidentified
MRVSGVLRLLALIFAIVTTWMFIRSYMSFSMKTIRLPRWLAASPTKEIQVKKYKCGLIKPCPANYFAFKICSGAANVVGPTMCFEDRMIMSPVKNNVGRGLNIALVNGTTGAVLGQKAFDMYSGDVMHLVKFLKEIPGGALVLVASYDDPGTKMNDESRKLFSDLGSSYAKQLGFRDSWVFIGAKDLRGKSPFEQFLKNSPDTNKYEGWPELLEMEGCMPPKPF

SEQ ID NO: 1521 - protein, 257 aa, unidentified
MLLTLAGGALFFPGLFALCTWALRRSQPGWSRTDCVMISTRLVSSVHAVLATGSGIVIIRSCDDVITGRHWLAREYVWFLIPYMIYDSYAMYLCEWCRTRDQNRAPSLTLRNFLSRNRLMITHHAVILFVLVPVAQRLRGDLGDFFVGCIFTAELSTPFVSLGRVLIQLKQQHTLLYKVNGILTLATFLSCRILLFPFMYWSYGRQQGLSLLQVPFSIPFYCNVANAFLVAPQIYWFCLLCRKAVRLFDTPQAKKDG

SEQ ID NO: 1522 - protein, 274 aa, unidentified
MLTPMVAGGVVFPGLFLLSKNTLQRLPQLRWEEADAVIVSARLVSSVQAIMASTAGYIVSTSCKHIIDDQHWLSSAYTQFAVPYFIYDIYAMFLCHWHKHQVKGHGGDDGAARAPGSTWAIARGYLHKEFLMVLHHAAMVLVCFPLSVVWRQGKGDFFLGCMLMAEVSTPFVCLGKILIQYKQQHTLLHKVNGALMLLSFLCCRVLLFPYLYWAYGRHAGLPLLAVPLAIPAHVNLGAALLLAPQLYWFFLICRGACRLFWPRSRPPPACQAQD

SEQ ID NO: 1523 - protein, 428 aa, unidentified
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKAKLGDQGNLSELVNLILTVADGDKDGQVSLGEAKSAWALLQLNEFLLMVILQDKEHTPKLMGFCGDLYVMESVEYTSLYGISLPWVIELFIPSGFRRSMDQLFTPSWPRKAKIAIGLLEFVEDVFHGPYGNFLMCDTSAKNLGYNDKYDLKMVDMRKIVPETNLKELIKDRHCESDLDCVYGTDCRTSCDQSTMKCTSEVIQPNLAKACQLLKDYLLRGAPSEIREELEKQLYSCIALKVTANQMEMEHSLILNNLKTLLWKKISYTNDS

SEQ ID NO: 1524 - protein, 431 aa, unidentified
MRRLRRLAHLVLFCPFSKRLQGRLPGLRVRCIFLAWLGVFAGSWLVYVHYSSYSERCRGHVCQVVICDQYRKGIISGSVCQDLCELHMVEWRTCLSVAPGQQVYSGLWRDKDVTIKCGIEETLDSKARSDAAPRRELVLFDKPTRGTSIKEFREMTLSFLKANLGDLPSLPALVGQVLLMADFNKDNRVSLAEAKSVWALLQRNEFLLLLSLQEKEHASRLLGYCGDLYLTEGVPHGAWHAAALPPLLRPLLPPALQGALQQWLGPAWPWRAKIAIGLLEFVEELFHGSYGTFYMCETTLANVGYTATYDFKMADLQQVAPEATVRRFLQGRRCEHSTDCTYGRDCRAPCDRLMRQCKGDLIQPNLAKVCALLRGYLLPGAPADLREELGTQLRTCTTLSGLASQVEAHHSLVLSHLKTLLWKKISNTKYS

SEQ ID NO: 1525 - protein, 413 aa, unidentified
MAEGPEEARGHPPGQDDGGGDHEPVPSLRGPPTTAVPCPRDDPQAEPQAPGRPTAPGLAAAAAADKLEPPRELRKRGEAASGSGAELQEQAGCEAPEAAAPRERPARLSAREYSRQVHEWLWQSYCGYLTWHSGLAAFPAYCSPQPSPQSFPSGGAAVPQAAAPPPPQLGYYNPFYFLSPGAAGPDPRTAAGISTPAPVAGLGPRAPHVQASVRATPVTRVGSAAPSRSPSETGRQAGREYVIPSLAHRFMAEMVDFFILFFIKATIVLSIMHLSGIKDISKFAMHYIIEEIDEDTSMEDLQKMMVVALIYRLLVCFYEIICIWGAGGATPGKFLLGLRVVTCDTSVLIAPSRVLVIPSSNVSITTSTIRALIKNFSIASFFPAFITLLFFQHNRTAYDIVAGTIVVKRNGVR

SEQ ID NO: 1526 - protein, 433 aa, unidentified
MRGPEPGPQPTMEGDVLDTLEALGYKGPLLEEQALTKAAEGGLSSPEFSELCIWLGSQIKSLCNLEESITSAGRDDLESFQLEISGFLKEMACPYSVLISGDIKDRLKKKEDCLKLLLFLSTELQASQILQNKKHKNSQLDKNSEVYQEVQAMFDTLGIPKSTTSDIPHMLNQVESKVKDILSKVQKNHVGKPLLKMDLNSEQAEQLERINDALSCEYECRRRMLMKRLDVTVQSFGWSDRAKVKTDDIARIYQPKRYALSPKTTITMAHLLAAREDLSKIIRTSSGTSREKTACAINKVLMGRVPDRGGRPNEIEPPPPEMPPWQKRQEGGGGRGGWGGGGGGGGRGGGGGGGGRGGWGGGGGGWGGGGGGGGGWGGGGGGGRGGFQGRGDYGGRGGYGGRGGYGGRGYGDPYGGGGGGGGGGGGGGGYRRY

SEQ ID NO: 1527 - protein, 166 aa, unidentified
MAAKDQLEVQVMAAQEMELAGKDPVSHEHEERKPVTETKEGDVTDEHGERGSFAETDEHTGVDTKELEDIAADIKEHLAAKRKRIEKIAKACSEIKNRIKNVLRTTQLKRQKRDYRISLKLPNVLEEFITDEQKDEEGDGEKEEQIKIFQEQQKRWQQDGKGTERD

SEQ ID NO: 1528 - protein, 1455 aa, unidentified
MSDSWVPNSASGQDPGGRRRAWAELLAGRVKREKYNPERAQKLKESAVRLLRSHQDLNALLLEVEGPLCKKLSLSKVIDCDSSEAYANHSSSFIGSALQDQASRLGVPVGILSAGMVASSVGQICTAPAETSHPVLLTVEQRKKLSSLLEFAQYLLAHSMFSRLSFCQELWKIQSSLLLEAVWHLHVQGIVSLQELLESHPDMHAVGSWLFRNLCCLCEQMEASCQHADVARAMLSDFVQMFVLRGFQKNSDLRRTVEPEKMPQVTVDVLQRMLIFALDALAAGVQEESSTHKIVRCWFGVFSGHTLGSVISTDPLKRFFSHTLTQILTHSPVLKASDAVQMQREWSFARTHPLLTSLYRRLFVMLSAEELVGHLQEVLETQEVHWQRVLSFVSALVVCFPEAQQLLEDWVARLMAQAFESCQLDSMVTAFLVVRQAALEGPSAFLSYADWFKASFGSTRGYHGCSKKALVFLFTFLSELVPFESPRYLQVHILHPPLVPGKYRSLLTDYISLAKTRLADLKVSIENMGLYEDLSSAGDITEPHSQALQDVEKAIMVFEHTGNIPVTVMEASIFRRPYYVSHFLPALLTPRVLPKVPDSRVAFIESLKRADKIPPSLYSTYCQACSAAEEKPEDAALGVRAEPNSAEEPLGQLTAALGELRASMTDPSQRDVISAQVAVISERLRAVLGHNEDDSSVEISKIQLSINTPRLEPREHMAVDLLLTSFCQNLMAASSVAPPERQGPWAALFVRTMCGRVLPAVLTRLCQLLRHQGPSLSAPHVLGLAALAVHLGESRSALPEVDVGPPAPGAGLPVPALFDSLLTCRTRDSLFFCLKFCTAAISYSLCKFSSQSRDTLCSCLSPGLIKKFQFLMFRLFSEARQPLSEEDVASLSWRPLHLPSADWQRAALSLWTHRTFREVLKEEDVHLTYQDWLHLELEIQPEADALSDTERQDFHQWAIHEHFLPESSASGGCDGDLQAACTILVNALMDFHQSSRSYDHSENSDLVFGGRTGNEDIISRLQEMVADLELQQDLIVPLGHTPSQEHFLFEIFRRRLQALTSGWSVAASLQRQRELLMYKRILLRLPSSVLCGSSFQAEQPITARCEQFFHLVNSEMRNFCSHGGALTQDITAHFFRGLLNACLRSRDPSLMVDFILAKCQTKCPLILTSALVWWPSLEPVLLCRWRRHCQSPLPRELQKLQEGRQFASDFLSPEAASPAPNPDWLSAAALHFAIQQVREENIRKQLKKLDCEREELLVFLFFFSLMGLLSSHLTSNSTTDLPKAFHVCAAILECLEKRKISWLALFQLTESDLRLGRLLLRVAPDQHTRLLPFAFYSLLSYFHEDAAIREEAFLHVAVDMYLKLVQLFVAGDTSTVSPPAGRSLELKGQGNPVELITKARLFLLQLIPRCPKKSFSHVAELLADRGDCDPEVSAALQSRQQAAPDADLSQEPHLF

SEQ ID NO: 1529 - protein, 515 aa, unidentified
MVSIPEYYEGKNVLLTGATGFLGKVLLEKLLRSCPKVNSVYVLVRQKAGQTPQERVEEVLSGKLFDRLRDENPDFREKIIAINSELTQPKLALSEEDKEVIIDSTNIIFHCAATVRFNENLRDAVQLNVIATRQLILLAQQMKNLEVFMHVSTAYAYCNRKHIDEVVYPPPVDPKKLIDSLEWMDDGLVNDITPKLIGDRPNTYIYTKALAEYVVQQEGAKLNVAIVRPSIVGASWKEPFPGWIDNFNGPSGLFIAAGKGILRTIRASNNALADLVPVDVVVNMSLAAAWYSGVNRPRNIMVYNCTTGSTNPFHWGEVEYHVISTFKRNPLEQAFRRPNVNLTSNHLLYHYWIAVSHKAPAFLYDIYLRMTGRSPRMMKTITRLHKAMVFLEYFTSNSWVWNTENVNMLMNQLNPEDKKTFNIDVRQLHWAEYIENYCLGTKKYVLNEEMSGLPAARKHLNKLRNIRYGFNTILVILIWRIFIARSQMARNIWYFVVSLCYKFLSYFRASSTMRY

SEQ ID NO: 1530 - protein, 515 aa, unidentified
MSTIAAFYGGKSILITGATGFLGKVLMEKLFRTSPDLKVIYILVRPKAGQTLQQRVFQILDSKLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIIIATGKGFLRAIKATPMAVADVIPVDTVVNLMLAVGWYTAVHRPKSTLVYHITSGNMNPCNWHKMGVQVLATFEKIPFERPFRRPNANFTSNSFTSQYWNAVSHRAPAIIYDCYLRLTGRKPRMTKLMNRLLRTVSMLEYFINRSWEWSTYNTEMLMSELSPEDQRVFNFDVRQLNWLEYIENYVLGVKKYLLKEDMAGIPKAKQRLKRLRNIHYLFNTALFLIAWRLLIARSQMARNVWFFIVSFCYKFLSYFRASSTLKV

SEQ ID NO: 1531 - protein, 335 aa, unidentified
MLGIWTLLPLVLTSVARLSSKSVNAQVTDINSKGLELRKTVTTVETQNLEGLHHDGQFCHKPCPPGERKARDCTVNGDEPDCVPCQEGKEYTDKAHFSSKCRRCRLCDEGHGLEVEINCTRTQNTKCRCKPNFFCNSTVCEHCDPCTKCEHGIIKECTLTSNTKCKEEGSRSNLGWLCLLLLPIPLIVWVKRKEVQKTCRKHRKENQGSHESPTLNPETVAINLSDVDLSKYITTIAGVMTLSQVKGFVRKNGVNEAKIDEIKNDNVQDTAEQKVQLLRNWHQLHGKKEAYDTLIKDLKKANLCTLAEKIQTIILKDITSDSENSNFRNEIQSLV

SEQ ID NO: 1532 - protein, 281 aa, unidentified
MQQPFNYPYPQIYWVDSSASSPWAPPGTVLPCPTSVPRRPGQRRPPPPPPPPPLPPPPPPPPLPPLPLPPLKKRGNHSTGLCLLVMFFMVLVALVGLGLGMFQLFHLQKELAELRESTSQMHTASSLEKQIGHPSPPPEKKELRKVAHLTGKSNSRSMPLEWEDTYGIVLLSGVKYKKGGLVINETGLYFVYSKVYFRGQSCNNLPLSHKVYMRNSKYPQDLVMMEGKMMSYCTTGQMWARSSYLGAVFNLTSADHLYVNVSELSLVNFEESQTFFGLYKL

SEQ ID NO: 1533 - protein, 4588 aa, unidentified
MGRHLALLLLLLLLFQHFGDSDGSQRLEQTPLQFTHLEYNVTVQENSAAKTYVGHPVKMGVYITHPAWEVRYKIVSGDSENLFKAEEYILGDFCFLRIRTKGGNTAILNREVKDHYTLIVKALEKNTNVEARTKVRVQVLDTNDLRPLFSPTSYSVSLPENTAIRTSIARVSATDADIGTNGEFYYSFKDRTDMFAIHPTSGVIVLTGRLDYLETKLYEMEILAADRGMKLYGSSGISSMAKLTVHIEQANECAPVITAVTLSPSELDRDPAYAIVTVDDCDQGANGDIASLSIVAGDLLQQFRTVRSFPGSKEYKVKAIGGIDWDSHPFGYNLTLQAKDKGTPPQFSSVKVIHVTSPQFKAGPVKFEKDVYRAEISEFAPPNTPVVMVKAIPAYSHLRYVFKSTPGKAKFSLNYNTGLISILEPVKRQQAAHFELEVTTSDRKASTKVLVKVLGANSNPPEFTQTAYKAAFDENVPIGTTVMSLSAVDPDEGENGYVTYSIANLNHVPFAIDHFTGAVSTSENLDYELMPRVYTLRIRASDWGLPYRREVEVLATITLNNLNDNTPLFEKINCEGTIPRDLGVGEQITTVSAIDADELQLVQYQIEAGNELDFFSLNPNSGVLSLKRSLMDGLGAKVSFHSLRITATDGENFATPLYINITVAASHKLVNLQCEETGVAKMLAEKLLQANKLHNQGEVEDIFFDSHSVNAHIPQFRSTLPTGIQVKENQPVGSSVIFMNSTDLDTGFNGKLVYAVSGGNEDSCFMIDMETGMLKILSPLDRETTDKYTLNITVYDLGIPQKAAWRLLHVVVVDANDNPPEFLQESYFVEVSEDKEVHSEIIQVEATDKDLGPNGHVTYSIVTDTDTFSIDSVTGVVNIARPLDRELQHEHSLKIEARDQAREEPQLFSTVVVKVSLEDVNDNPPTFIPPNYRVKVREDLPEGTVIMWLEAHDPDLGQSGQVRYSLLDHGEGNFDVDKLSGAVRIVQQLDFEKKQVYNLTVRAKDKGKPVSLSSTCYVEVEVVDVNENLHPPVFSSFVEKGTVKEDAPVGSLVMTVSAHDEDARRDGEIRYSIRDGSGVGVFKIGEETGVIETSDRLDRESTSHYWLTVFATDQGVVPLSSFIEIYIEVEDVNDNAPQTSEPVYYPEIMENSPKDVSVVQIEAFDPDSSSNDKLMYKITSGNPQGFFSIHPKTGLITTTSRKLDREQQDEHILEVTVTDNGSPPKSTIARVIVKILDENDNKPQFLQKFYKIRLPEREKPDRERNARREPLYHVIATDKDEGPNAEISYSIEDGNEHGKFFIEPKTGVVSSKRFSAAGEYDILSIKAVDNGRPQKSSTTRLHIEWISKPKPSLEPISFEESFFTFTVMESDPVAHMIGVISVEPPGIPLWFDITGGNYDSHFDVDKGTGTIIVAKPLDAEQKSNYNLTVEATDGTTTILTQVFIKVIDTNDHRPQFSTSKYEVVIPEDTAPETEILQISAVDQDEKNKLIYTLQSSRDPLSLKKFRLDPATGSLYTSEKLDHEAVHQHTLTVMVRDQDVPVKRNFARIVVNVSDTNDHAPWFTASSYKGRVYESAAVGSVVLQVTALDKDKGKNAEVLYSIESGNIGNSFMIDPVLGSIKTAKELDRSNQAEYDLMVKATDKGSPPMSEITSVRIFVTIADNASPKFTSKEYSVELSETVSIGSFVGMVTAHSQSSVVYEIKDGNTGDAFDINPHSGTIITQKALDFETLPIYTLIIQGTNMAGLSTNTTVLVHLQDENDNAPVFMQAEYTGLISESASINSVVLTDRNVPLVIRAADADKDSNALLVYHIVEPSVHTYFAIDSSTGAIHTVLSLDYEETSIFHFTVQVHDMGTPRLFAEYAANVTVHVIDINDCPPVFAKPLYEASLLLPTYKGVKVITVNATDADSSAFSQLIYSITEGNIGEKFSMDYKTGALTVQNTTQLRSRYELTVRASDGRFAGLTSVKINVKESKESHLKFTQDVYSAVVKENSTEAETLAVITAIGNPINEPLFYHILNPDRRFKISRTSGVLSTTGTPFDREQQEAFDVVVEVTEEHKPSAVAHVVVKVIVEDQNDNAPVFVNLPYYAVVKVDTEVGHVIRYVTAVDRDSGRNGEVHYYLKEHHEHFQIGPLGEISLKKQFELDTLNKEYLVTVVAKDGGNPAFSAEVIVPITVMNKAMPVFEKPFYSAEIAESIQVHSPVVHVQANSPEGLKVFYSITDGDPFSQFTINFNTGVINVIAPLDFEAHPAYKLSIRATDSLTGAHAEVFVDIIVDDINDNPPVFAQQSYAVTLSEASVIGTSVVQVRATDSDSEPNRGISYQMFGNHSKSHDHFHVDSSTGLISLLRTLDYEQSRQHTIFVRAVDGGMPTLSSDVIVTVDVTDLNDNPPLFEQQIYEARISEHAPHGHFVTCVKAYDADSSDIDKLQYSILSGNDHKHFVIDSATGIITLSNLHRHALKPFYSLNLSVSDGVFRSSTQVHVTVIGGNLHSPAFLQNEYEVELAENAPLHTLVMEVKTTDGDSGIYGHVTYHIVNDFAKDRFYINERGQIFTLEKLDRETPAEKVISVRLMAKDAGGKVAFCTVNVILTDDNDNAPQFRATKYEVNIGSSAAKGTSVVKVLASDADEGSNADITYAIEADSESVKENLEINKLSGVITTKESLIGLENEFFTFFVRAVDNGSPSKESVVLVYVKILPPEMQLPKFSEPFYTFTVSEDVPIGTEIDLIRAEHSGTVLYSLVKGNTPESNRDESFVIDRQSGRLKLEKSLDHETTKWYQFSILARCTQDDHEMVASVDVSIQVKDANDNSPVFESSPYEAFIVENLPGGSRVIQIRASDADSGTNGQVMYSLDQSQSVEVIESFAINMETGWITTLKELDHEKRDNYQIKVVASDHGEKIQLSSTAIVDVTVTDVNDSPPRFTAEIYKGTVSEDDPQGGVIAILSTTDADSEEINRQVTYFITGGDPLGQFAVETIQNEWKVYVKKPLDREKRDNYLLTITATDGTFSSKAIVEVKVLDANDNSPVCEKTLYSDTIPEDVLPGKLIMQISATDADIRSNAEITYTLLGSGAEKFKLNPDTGELKTSTPLDREEQAVYHLLVRATDGGGRFCQASIVLTLEDVNDNAPEFSADPYAITVFENTEPGTLLTRVQATDADAGLNRKILYSLIDSADGQFSINELSGIIQLEKPLDRELQAVYTLSLKAVDQGLPRRLTATGTVIVSVLDINDNPPVFEYREYGATVSEDILVGTEVLQVYAASRDIEANAEITYSIISGNEHGKFSIDSKTGAVFIIENLDYESSHEYYLTVEATDGGTPSLSDVATVNVNVTDINDNTPVFSQDTYTTVISEDAVLEQSVITVMADDADGPSNSHIHYSIIDGNQGSSFTIDPVRGEVKVTKLLDRETISGYTLTVQASDNGSPPRVNTTTVNIDVSDVNDNAPVFSRGNYSVIIQENKPVGFSVLQLVVTDEDSSHNGPPFFFTIVTGNDEKAFEVNPQGVLLTSSAIKRKEKDHYLLQVKVADNGKPQLSSLTYIDIRVIEESIYPPAILPLEIFITSSGEEYSGGVIGKIHATDQDVYDTLTYSLDPQMDNLFSVSSTGGKLIAHKKLDIGQYLLNVSVTDGKFTTVADITVHIRQVTQEMLNHTIAIRFANLTPEEFVGDYWRNFQRALRNILGVRRNDIQIVSLQSSEPHPHLDVLLFVEKPGSAQISTKQLLHKINSSVTDIEEIIGVRILNVFQKLCAGLDCPWKFCDEKVSVDESVMSTHSTARLSFVTPRHHRAAVCLCKEGRCPPVHHGCEDDPCPEGSECVSDPWEEKHTCVCPSGRFGQCPGSSSMTLTGNSYVKYRLTENENKLEMKLTMRLRTYSTHAVVMYARGTDYSILEIHHGRLQYKFDCGSGPGIVSVQSIQVNDGQWHAVALEVNGNYARLVLDQVHTASGTAPGTLKTLNLDNYVFFGGHIRQQGTRHGRSPQVGNGFRGCMDSIYLNGQELPLNSKPRSYAHIEESVDVSPGCFLTATEDCASNPCQNGGVCNPSPAGGYYCKCSALYIGTHCEISVNPCSSKPCLYGGTCVVDNGGFVCQCRGLYTGQRCQLSPYCKDEPCKNGGTCFDSLDGAVCQCDSGFRGERCQSDIDECSGNPCLHGALCENTHGSYHCNCSHEYRGRHCEDAAPNQYVSTPWNIGLAEGIGIVVFVAGIFLLVVVFVLCRKMISRKKKHQAEPKDKHLGPATAFLQRPYFDSKLNKNIYSDIPPQVPVRPISYTPSIPSDSRNNLDRNSFEGSAIPEHPEFSTFNPESVHGHRKAVAVCSVAPNLPPPPPSNSPSDSDSIQKPSWDFDYDTKVVDLDPCLSKKPLEEKPSQPYSARESLSEVQSLSSFQSESCDDNGYHWDTSDWMPSVPLPDIQEFPNYEVIDEQTPLYSADPNAIDTDYYPGGYDIESDFPPPPEDFPAADELPPLPPEFSNQFESIHPPRDMPAAGSLGSSSRNRQRFNLNQYLPNFYPLDMSEPQTKGTGENSTCREPHAPYPPGYQRHFEAPAVESMPMSVYASTASCSDVSACCEVESEVMMSDYESGDDGHFEEVTIPPLDSQQHTEV

SEQ ID NO: 1534 - protein, 4349 aa, unidentified
MTIALLGFAIFLLHCATCEKPLEGILSSSAWHFTHSHYNATIYENSSPKTYVESFEKMGIYLAEPQWAVRYRIISGDVANVFKTEEYVVGNFCFLRIRTKSSNTALLNREVRDSYTLIIQATEKTLELEALTRVVVHILDQNDLKPLFSPPSYRVTISEDMPLKSPICKVTATDADLGQNAEFYYAFNTRSEMFAIHPTSGVVTVAGKLNVTWRGKHELQVLAVDRMRKISEGNGFGSLAALVVHVEPALRKPPAIASVVVTPPDSNDGTTYATVLVDANSSGAEVESVEVVGGDPGKHFKAIKSYARSNEFSLVSVKDINWMEYLHGFNLSLQARSGSGPYFYSQIRGFHLPPSKLSSLKFEKAVYRVQLSEFSPPGSRVVMVRVTPAFPNLQYVLKPSSENVGFKLNARTGLITTTKLMDFHDRAHYQLHIRTSPGQASTVVVIDIVDCNNHAPLFNRSSYDGTLDENIPPGTSVLAVTATDRDHGENGYVTYSIAGPKALPFSIDPYLGIISTSKPMDYELMKRIYTFRVRASDWGSPFRREKEVSIFLQLRNLNDNQPMFEEVNCTGSIRQDWPVGKSIMTMSAIDVDELQNLKYEIVSGNELEYFDLNHFSGVISLKRPFINLTAGQPTSYSLKITASDGKNYASPTTLNITVVKDPHFEVPVTCDKTGVLTQFTKTILHFIGLQNQESSDEEFTSLSTYQINHYTPQFEDHFPQSIDVLESVPINTPLARLAATDPDAGFNGKLVYVIADGNEEGCFDIELETGLLTVAAPLDYEATNFYILNVTVYDLGTPQKSSWKLLTVNVKDWNDNAPRFPPGGYQLTISEDTEVGTTIAELTTKDADSEDNGRVRYTLLSPTEKFSLHPLTGELVVTGHLDRESEPRYILKVEARDQPSKGHQLFSVTDLIITLEDVNDNSPQCITEHNRLKVPEDLPPGTVLTFLDASDPDLGPAGEVRYVLMDGAHGTFRVDLMTGALILERELDFERRAGYNLSLWASDGGRPLARRTLCHVEVIVLDVNENLHPPHFASFVHQGQVQENSPSGTQVIVVAAQDDDSGLDGELQYFLRAGTGLAAFSINQDTGMIQTLAPLDREFASYYWLTVLAVDRGSVPLSSVTEVYIEVTDANDNPPQMSQAVFYPSIQEDAPVGTSVLQLDAWDPDSSSKGKLTFNITSGNYMGFFMIHPVTGLLSTAQQLDRENKDEHILEVTVLDNGEPSLKSTSRVVVGILDVNDNPPIFSHKLFNVRLPERLSPVSPGPVYRLVASDLDEGLNGRVTYSIEDSDEEAFSIDLVTGVVSSSSTFTAGEYNILTIKATDSGQPPLSASVRLHIEWIPWPRPSSIPLAFDETYYSFTVMETDPVNHMVGVISVEGRPGLFWFNISGGDKDMDFDIEKTTGSIVIARPLDTRRRSNYNLTVEVTDGSRTIATQVHIFMIANINHHRPQFLETRYEVRVPQDTVPGVELLRVQAIDQDKGKSLIYTIHGSQDPGSASLFQLDPSSGVLVTVGKLDLGSGPSQHTLTVMVRDQEIPIKRNFVWVTIHVEDGNLHPPRFTQLHYEASVPDTIAPGTELLQVRAMDADRGVNAEVHYSLLKGNSEGFFNINALLGIITLAQKLDQANHAPHTLTVKAEDQGSPQWHDLATVIIHVYPSDRSAPIFSKSEYFVEIPESIPVGSPILLVSAMSPSEVTYELREGNKDGVFSMNSYSGLISTQKKLDHEKISSYQLKIRGSNMAGAFTDVMVVVDIIDENDNAPMFLKSTFVGQISEAAPLYSMIMDKNNNPFVIHASDSDKEANSLLVYKILEPEALKFFKIDPSMGTLTIVSEMDYESMPSFQFCVYVHDQGSPVLFAPRPAQVIIHVRDVNDSPPRFSEQIYEVAIVGPIHPGMELLMVRASDEDSEVNYSIKTGNADEAVTIHPVTGSISVLNPAFLGLSRKLTIRASDGLYQDTALVKISLTQVLDKSLQFDQDVYWAAVKENLQDRKALVILGAQGNHLNDTLSYFLLNGTDMFHMVQSAGVLQTRGVAFDREQQDTHELAVEVRDNRTPQRVAQGLVRVSIEDVNDNPPKFKHLPYYTIIQDGTEPGDVLFQVSATDEDLGTNGAVTYEFAEDYTYFRIDPYLGDISLKKPFDYQALNKYHLKVIARDGGTPSLQSEEEVLVTVRNKSNPLFQSPYYKVRVPENITLYTPILHTQARSPEGLRLIYNIVEEEPLMLFTTDFKTGVLTVTGPLDYESKTKHVFTVRATDTALGSFSEATVEVLVEDVNDNPPTFSQLVYTTSISEGLPAQTPVIQLLASDQDSGRNRDVSYQIVEDGSDVSKFFQINGSTGEMSTVQELDYEAQQHFHVKVRAMDKGDPPLTGETLVVVNVSDINDNPPEFRQPQYEANVSELATCGHLVLKVQAIDPDSRDTSRLEYLILSGNQDRHFFINSSSGIISMFNLCKKHLDSSYNLRVGASDGVFRATVPVYINTTNANKYSPEFQQHLYEAELAENAMVGTKVIDLLAIDKDSGPYGTIDYTIINKLASEKFSINPNGQIATLQKLDRENSTERVIAIKVMARDGGGRVAFCTVKIILTDENDNPPQFKASEYTVSIQSNVSKDSPVIQVLAYDADEGQNADVTYSVNPEDLVKDVIEINPVTGVVKVKDSLVGLENQTLDFFIKAQDGGPPHWNSLVPVRLQVVPKKVSLPKFSEPLYTFSAPEDLPEGSEIGIVKAVAAQDPVIYSLVRGTTPESNKDGVFSLDPDTGVIKVRKPMDHESTKLYQIDVMAHCLQNTDVVSLVSVNIQVGDVNDNRPVFEADPYKAVLTENMPVGTSVIQVTAIDKDTGRDGQVSYRLSADPGSNVHELFAIDSESGWITTLQELDCETCQTYHFHVVAYDHGQTIQLSSQALVQVSITDENDNAPRFASEEYRGSVVENSEPGELVATLKTLDADISEQNRQVTCYITEGDPLGQFGISQVGDEWRISSRKTLDREHTAKYLLRVTASDGKFQASVTVEIFVLDVNDNSPQCSQLLYTGKVHEDVFPGHFILKVSATDLDTDTNAQITYSLHGPGAHEFKLDPHTGELTTLTALDRERKDVFNLVAKATDGGGRSCQADITLHVEDVNDNAPRFFPSHCAVAVFDNTTVKTPVAVVFARDPDQGANAQVVYSLPDSAEGHFSIDATTGVIRLEKPLQVRPQAPLELTVRASDLGTPIPLSTLGTVTVSVVGLEDYLPVFLNTEHSVQVPEDAPPGTEVLQLATLTRPGAEKTGYRVVSGNEQGRFRLDARTGILYVNASLDFETSPKYFLSIECSRKSSSSLSDVTTVMVNITDVNEHRPQFPQDPYSTRVLENALVGDVILTVSATDEDGPLNSDITYSLIGGNQLGHFTIHPKKGELQVAKALDREQASSYSLKLRATDSGQPPLHEDTDIAIQVADVNDNPPRFFQLNYSTTVQENSPIGSKVLQLILSDPDSPENGPPYSFRITKGNNGSAFRVTPDGWLVTAEGLSRRAQEWYQLQIQASDSGIPPLSSLTSVRVHVTEQSHYAPSALPLEIFITVGEDEFQGGMVGKIHATDRDPQDTLTYSLAEEETLGRHFSVGAPDGKIIAAQGLPRGHYSFNVTVSDGTFTTTAGVHVYVWHVGQEALQQAMWMGFYQLTPEELVSDHWRNLQRFLSHKLDIKRANIHLASLQPAEAVAGVDVLLVFEGHSGTFYEFQELASIITHSAKEMEHSVGVQMRSAMPMVPCQGPTCQGQICHNTVHLDPKVGPTYSTARLSILTPRHHLQRSCSCNGTATRFSGQSYVRYRAPAARNWHIHFYLKTLQPQAILLFTNETASVSLKLASGVPQLEYHCLGGFYGNLSSQRHVNDHEWHSILVEEMDASIRLMVDSMGNTSLVVPENCRGLRPERHLLLGGLILLHSSSNVSQGFEGCLDAVVVNEEALDLLAPGKTVAGLLETQALTQCCLHSDYCSQNTCLNGGKCSWTHGAGYVCKCPPQFSGKHCEQGRENCTFAPCLEGGTCILSPKGASCNCPHPYTGDRCEMEARGCSEGHCLVTPEIQRGDWGQQELLIITVAVAFIIISTVGLLFYCRRCKSHKPVAMEDPDLLARSVGVDTQAMPAIELNPLSASSCNNLNQPEPSKASVPNELVTFGPNSKQRPVVCSVPPRLPPAAVPSHSDNEPVIKRTWSSEEMVYPGGAMVWPPTYSRNERWEYPHSEVTQGPLPPSAHRHSTPVVMPEPNGLYGGFPFPLEMENKRAPLPPRYSNQNLEDLMPSRPPSPRERLVAPCLNEYTAISYYHSQFRQGGGGPCLADGGYKGVGMRLSRAGPSYAVCEVEGAPLAGQGQPRVPPNYEGSDMVESDYGSCEEVMF

SEQ ID NO: 1535 - protein, 4557 aa, unidentified
MDIIMGHCVGTRPPACCLILLLFKLLATVSQGLPGTGPLGFHFTHSIYNATVYENSAARTYVNSQSRMGITLIDLSWDIKYRIVSGDEEGFFKAEEVIIADFCFLRIRTKGGNSAILNREIQDNYLLIVKGSVRGEDLEAWTKVNIQVLDMNDLRPLFSPTTYSVTIAESTPLRTSVAQVTATDADIGSNGEFYYYFKNKVDLFSVHPTSGVISLSGRLNYDEKNRYDLEILAVDRGMKLYGNNGVSSTAKLYVHIERINEHAPTIHVVTHVPFSLEKEPTYAVVTVDDLDDGANGEIESVSIVAGDPLDQFFLAKEGKWLNEYKIKERKQIDWESFPYGYNLTLQAKDKGSPQKCSALKAVYIGNPTRDTVPIRFEKEVYDVSISEFSPPGVVVAIVKLSPEPIDVEYKLSPGEDAVYFKINPRSGLIVTARPLNTVKKEVYKLEVTNKEGDLKAQVTISIEDANDHTPEFQQPLYDAYVNESVPVGTSVLTVSASDKDKGENGYITYSIASLNLLPFVINQFTGVISTTEELDFESSPEIYRFIVRASDWGSPYRHESEVNVTIRIGNVNDNSPLFEKVACQGVISYDFPVGGHITAVSAIDIDELELVKYKIISGNELGFFYLNPDSGVLQLKKSLTNSGIKNGNFALRITATDGENLADPMSINISVLHGKVSSKSFSCRETRVAQKLAEKLLIKAKANGKLNLEDGFLDFYSINRQGPYFDKSFPSDVAVKEDLPVGANILKIKAYDADSGFNGKVLFTISDGNTDSCFNIDMETGQLKVLMPMDREHTDLYLLNITIYDLGNPQKSSWRLLTINVEDANDNSPVFIQDSYSVNILESSGIGTEIIQVEARDKDLGSNGEVTYSVLTDTQQFAINSSTGIVYVADQLDRESKANYSLKIEARDKAESGQQLFSVVTLKVFLDDVNDCSPAFIPSSYSVKVLEDLPVGTVIAWLETHDPDLGLGGQVRYSLVNDYNGRFEIDKASGAIRLSKELDYEKQQFYNLTVRAKDKGRPVSLSSVSFVEVEVVDVNENLHTPYFPDFAVVGSVKENSRIGTSVLQVTARDEDSGRDGEIQYSIRDGSGLGRFSIDDESGVITAADILDRETMGSYWLTVYATDRGVVPLYSTIEVYIEVEDVNDNAPLTSEPIYYPVVMENSPKDVSVIQIQAEDPDSSSNEKLTYRITSGNPQNFFAINIKTGLITTTSRKLDREQQAEHFLEVTVTDGGPSPKQSTIWVVVQVLDENDNKPQFPEKVYQIKLPERDRKKRGEPIYRAFAFDRDEGPNAEISYSIVDGNDDGKFFIDPKTGMVSSRKQFTAGSYDILTIKAVDNGRPQKSSTARLHIEWIKKPPPSPIPLTFDEPFYNFTVMESDRVTEIVGVVSVQPANTPLWFDIVGGNFDSAFDAEKGVGTIVIAKPLDAEQRSIYNMSVEVTDGTNVAVTQVFIKVLDNNDNGPEFSQPNYDVTISEDVLPDTEILQIEATDRDEKHKLSYTVHSSIDSISMRKFRIDPSTGVLYTAERLDHEAQDKHILNIMVRDQEFPYRRNLARVIVNVEDANDHSPYFTNPLYEASVFESAALGSAVLQVTALDKDKGENAELIYTIEAGNTGNMFKIEPVLGIITICKEPDMTTMGQFVLSIKVTDQGSPPMSATAIVRISVTMSDNSHPKFIHKDYQAEVNENVDIGTSVILISAISQSTLIYEVKDGDINGIFTINPYSGVITTQKALDYERTSSYQLIIQATNMAGMASNATVNIQIVDENDNAPVFLFSQYSGSLSEAAPINSIVRSLDNSPLVIRATDADSNRNALLVYQIVESTAKKFFTVDSSTGAIRTIANLDHETIAHFHFHVHVRDSGSPQLTAESPVEVNIEVTDVNDNPPVFTQAVFETILLLPTYVGVEVLKVSATDPDSEVPPELTYSLMEGSLDHFLIDSNSGVLTIKNNNLSKDHYMLIVKVSDGKFYSTSMVTIMVKEAMDSGLHFTQSFYSTSISENNTNITKVAIVNAVGNRLNEPLKYSILNPGNKFKIKSTSGVIQTTGVPFDREEQELYELVVEASRELDHLRVARVVVRVNIEDINDNSPVFVGLPYYAAVQVDAEPGTLIYQVTAIDKDKGPNGEVTYVLQDDYGHFEINPNSGNVILKEAFNSDLSNIEYGVTILAKDGGKPSLSTSVELPITIVNKAMPVFDKPFYTASVNEDIRMNTPILSINATSPEGQGIIYIIIDGDPFKQFNIDFDTGVLKVVSPLDYEVTSAYKLTIRASDALTGARAEVTVDLLVNDVNDNPPIFDQPTYNTTLSEASLIGTPVLQVVSIDADSENNKMVHYQIVQDTYNSTDYFHIDSSSGLILTARMLDHELVQHCTLKVRSIDSGFPSLSSEVLVHIYISDVNDNPPVFNQLIYESYVSELAPRGHFVTCVQASDADSSDFDRLEYSILSGNDRTSFLMDSKSGVITLSNHRKQRMEPLYSLNVSVSDGLFTSTAQVHIRVLGANLYSPAFSQSTYVAEVRENVAAGTKVIHVRATDGDPGTYGQISYAIINDFAKDRFLIDSNGQVITTERLDRENPLEGDVSIFVRALDGGGRTTFCTVRVIVVDENDNAPQFMTVEYRASVRADVGRGHLVTQVQAIDPDDGANSRITYSLYSEASVSVADLLEIDPDNGWMVTKGNFNQLKNTVLSFFVKAVDGGIPVKHSLIPVYIHVLPPETFLPSFTQSQYSFTIAEDTAIGSTVDTLRILPSQNVWFSTVNGERPENNKGGIFVIEQETGTIKLDKRLDRETSPAFHFKVAATIPLDKVDIVFTVDVDIKVLDLNDNKPVFETSSYDTIIMEGMPVGTKLTQVRAIDMDWGANGQVTYSLHSDSQPEKVMEAFNIDSNTGWISTLKDLDHETDPTFTFSVVASDLGEAFSLSSTALVSVRVTDINDNAPVFAQEVYRGNVKESDPPGEVVAVLSTWDRDTSDVNRQVSYHITGGNPRGRFALGLVQSEWKVYVKRPLDREEQDIYFLNITATDGLFVTQAMVEVSVSDVNDNSPVCDQVAYTALLPEDIPSNKIILKVSAKDADIGSNGYIRYSLYGSGNSEFFLDPESGELKTLALLDRERIPVYSLMAKATDGGGRFCQSNIHLILEDVNDNPPVFSSDHYNTCVYENTATKALLTRVQAVDPDIGINRKVVYSLADSAGGVFSIDSSSGIIILEQPLDREQQSSYNISVRATDQSPGQSLSSLTTVTITVLDINDNPPVFERRDYLVTVPEDTSPGTQVLAVFATSKDIGTNAEITYLIRSGNEQGKFKINPKTGGISVSEVLDYELCKRFYLVVEAKDGGTPALSAVATVNINLTDVNDNPPKFSQDVYSAVISEDALVGDSVILLIAEDVDSQPNGQIHFSIVNGDRDNEFTVDPVLGLVKVKKKLDRERVSGYSLLVQAVDSGIPAMSSTATVNIDISDVNDNSPVFTPANYTAVIQENKPVGTSILQLVVTDRDSFHNGPPFSFSILSGNEEEEFVLDPHGILRSAVVFQHTESLEYVLCVQAKDSGKPQQVSHTYIRVRVIEESTHKPTAIPLEIFIVTMEDDFPGGVIGKIHATDQDMYDVLTFALKSEQKSLFKVNSHDGKIIALGGLDSGKYVLNVSVSDGRFQVPIDVVVHVEQLVHEMLQNTVTIRFENVSPEDFVGLHMHGFRRTLRNAVLTQKQDSLRIISIQPVAGTNQLDMLFAVEMHSSEFYKPAYLIQKLSNARRHLENIMRISAILEKNCSGLDCQEQHCEQGLSLDSHALMTYSTARISFVCPRFYRNVRCTCNGGLCPGSNDPCVEKPCPGDMQCVSYEASRRPFLCQCPPGKLGECSGHTSLSFAGNSYIKYRLSENSKEEDFKLALRLRTLQSNGIIMYTRANPCIILKIVDGKLWFQLDCGSGPGILGISGRAVNDGSWHSVFLELNRNFTSLSLDDSYVERRRAPLYFQTLSTESSIYFGALVQADNIRSLTDTRVTQVLSGFQGCLDSVILNNNELPLQNKRSSFAEVVGLTELKLGCVLYPDACKRSPCQHGGSCTGLPSGGYQCTCLSQFTGRNCESEITACFPNPCRNGGSCDPIGNTFICNCKAGLTGVTCEEDINECEREECENGGSCVNVFGSFLCNCTPGYVGQYCGLRPVVVPNIQAGHSYVGKEELIGIAVVLFVIFILVVLFIVFRKKVFRKNYSRNNITLVQDPATAALLNKSNGIPFRNLRGSGDGRNVYQEVGPPQVPVRPMAYTPCFQSDSRSNLDKIVDGLGGEHQEMTTFHPESPRILTARRGVVVCSVAPNLPAVSPCRSDCDSIRKNGWDAGTENKGVDDPGEVTCFAGSNKGSNSEVQSLSSFQSDSGDDNAYHWDTSDWMPGARLSDIEEVPNYENQDGGSAHQGSTRELESDYYLGGYDIDSEYPPPHEEEFLSQDQLPPPLPEDFPDQYEALPPSQPVSLASTLSPDCRRRPQFHPSQYLPPHPFPNETDLVGPPASCEFSTFAVSMNQGTEPTGPADSVSLSLHNSRGTSSSDVSANCGFDDSEVAMSDYESVGELSLASLHIPFVETQHQTQV

SEQ ID NO: 1536 - protein, 4981 aa, unidentified
MDLAPDRATGRPWLPLHTLSVSQLLRVFWLLSLLPGQAWVHGAEPRQVFQVLEEQPPGTLVGTIQTRPGFTYRLSESHALFAINSSTGALYTTSTIDRESLPSDVINLVVLSSAPTYPTEVRVLVRDLNDNAPVFPDPSIVVTFKEDSSSGRQVILDTATDSDIGSNGVDHRSYRIIRGNEAGRFRLDITLNPSGEGAFLHLVSKGGLDREVTPQYQLLVEVEDKGEPKRRGYLQVNVTVQDINDNPPVFGSSHYQAGVPEDAVVGSSVLQVAAADADEGTNADIRYRLQDEGTPFQMDPETGLITVREPLDFEARRQYSLTVQAMDRGVPSLTGRAEALIQLLDVNDNDPVVKFRYFPATSRYASVDENAQVGTVVALLTVTDADSPAANGNISVQILGGNEQRHFEVQSSKVPNLSLIKVASALDRERIPSYNLTVSVSDNYGAPPGAAVQARSSVASLVIFVNDINDHPPVFSQQVYRVNLSEEAPPGSYVSGISATDGDSGLNANLRYSIVSGNGLGWFHISEHSGLVTTGSSGGLDRELASQIVLNISARDQGVHPKVSYAQLVVTLLDVNDEKPVFSQPEGYDVSVVENAPTGTELLMLRATDGDLGDNGTVRFSLQEAETDRRSFRLDPVSGRLSTISSLDREEQAFYSLLVLATDLGSPPQSSMARINVSLLDINDNSPVFYPVQYFAHIKENEPGGSYITTVSATDPDLGTNGTVKYSISAGDRSRFQVNAQSGVISTRMALDREEKTAYQLQIVATDGGNLQSPNQAIVTITVLDTQDNPPVFSQVAYSFVVFENVALGYHVGSVSASTMDLNSNISYLITTGDQKGMFAINQVTGQLTTANVIDREEQSFYQLKVVASGGTVTGDTMVNITVKDLNDNSPHFLQAIESVNVVENWQAGHSIFQAKAVDPDEGVNGMVLYSLKQNPKNLFAINEKNGTISLLGPLDVHAGSYQIEILASDMGVPQLSSSVILTVYVHDVNDNSPVFDQLSYEVTLSESEPVNSRFFKVQASDKDSGANGEIAYTIAEGNTGDAFGIFPDGQLYIKSELDRELQDRYVLMVVASDRAVEPLSATVNVTVILEDVNDNRPLFNSTNYTFYFEEEQRAGSFVGKVSAVDKDFGPNGEVRYSFEMVQPDFELHAISGEITNTHQFDRESLMRRRGTAVFSFTVIATDQGIPQPLKDQATVHVYMKDINDNAPKFLKDFYQATISESAANLTQVLRVSASDVDEGNNGLIHYSIIKGNEERQFAIDSTSGQVTLIGKLDYEATPAYSLVIQAVDSGTIPLNSTCTLNIDILDENDNTPSFPKSTLFVDVLENMRIGELVSSVTATDSDSGDNADLYYSITGTNNHGTFSISPNTGSIFLAKKLDFETQSLYKLNITAKDQGRPPRSSTMSVVIHVRDFNDNPPSFPPGDIFKSIVENIPIGTSVISVTAHDPDADINGQLSYTIIQQMPRGNHFTIDEVKGTIYTNAEIDREFANLFELTVKANDQAVPIETRRYALKNVTILVTDLNDNVPMFISQNALAADPSAVIGSVLTTIMAADPDEGANGEIEYEIINGDTDTFIVDRYSGDLRVASALVPSQLIYNLIVSATDLGPERRKSTTELTIILQGLDGPVFTQPKYITILKEGEPIGTNVISIEAASPRGSEAPVEYYIVSVRCEEKTVGRLFTIGRHTGIIQTAAILDREQGACLYLVDVYAIEKSTAFPRTQRAEVEITLQDINDNPPVFPTDMLDLTVEENIGDGSKIMQLTAMDADEGANALVTYTIISGADDSFRIDPESGDLIATRRLDRERRSKYSLLVRADDGLQSSDMRINITVSDVNDHTPKFSRPVYSFDIPEDTIPGSLVAAILATDDDSGVNGEITYIVNEDDEDGIFFLNPITGVFNLTRLLDYEVQQYYILTVRAEDGGGQFTTIRVYFNILDVNDNPPIFSLNSYSTSLMENLPVGSTVLVFNVTDADDGINSQLTYSIASGDSLGQFTVDKNGVLKVLKALDRESQSFYNLVVQVHDLPQIPASRFTSTAQVSIILLDVNDNPPTFLSPKLTYIPENTPIDTVVFKAQATDPDSGPNSYIEYTLLNPLGNKFSIGTIDGEVRLTGELDREEVSNYTLTVVATDKGQPSLSSSTEVVVMVLDINDNNPIFAQALYKVEINENTLTGTDIIQVFAADGDEGTNGQVRYGIVNGNTNQEFRIDSVTGAITVAKPLDREKTPTYHLTVQATDRGSTPRTDTSTVSIVLLDINDFVPVFELSPYSVNVPENLGTLPRTILQVVARDDDRGSNSKLSYVLFGGNEDNAFTLSASGELGVTQSLDRETKERFVLMITATDSGSPALTGTGTINVIVDDVNDNVPTFASKAYFTTIPEDAPTGTDVLLVNASDADASKNAVIRIIGGNSQFTINPSTGQIITSALLDRETKDNYTLVVVCSDAGSPEPLSSSTSVLVTVTDVNDNPPRFQHHPYVTHIPSPTLPGSFVFAVTVTDADIGPNSELHYSLSGRNSEKFHIDPLRGAIMAAGPLNGASEVTFSVHVKDGGSFPKTDSTTVTVRFVNKADFPKVRAKEQTFMFPENQPVSSLVTTITGSSLRGEPMSYYIASGNLGNTFQIDQLTGQVSISQPLDFEKIQKYVVWIEARDGGFPPFSSYEKLDITVLDVNDNAPIFKEDPFISEILENLSPRKILTVSAMDKDSGPNGQLDYEIVNGNMENSFSINHATGEIRSVRPLDREKVSHYVLTIKSSDKGSPSQSTSVKVMINILDENDNAPRFSQIFSAHVPENSPLGYTVTRVTTSDEDIGINAISRYSIMDASLPFTINPSTGDIVISRPLNREDTDRYRIRVSAHDSGWTVSTDVTIFVTDINDNAPRFSRTSYYLDCPELTEIGSKVTQVFATDPDEGSNGQVFYFIKSQSEYFRINATTGEIFNKQILKYQNVTGFSNVNINRHSFIVTSSDRGKPSLISETTVTINIVDSNDNAPQFLKSKYFTPVTKNVKVGTKLIRVTAIDDKDFGLNSEVEYFISNDNHLGKFKLDNDTGWISVASSLISDLNQNFFITVTAKDKGNPPLSSQATVHITVTEENYHTPEFSQSHMSATIPESHSIGSIVRTVSARDRDAAMNGLIKYSISSGNEEGIFAINSSTGILTLAKALDYELCQKHEMTISAIDGGWVARTGYCSVTVNVIDVNDNSPVFLSDDYFPTVLENAPSGTTVIHLNATDADSGTNAVIAYTVQSSDSDLFVIDPNTGVITTQGFLDFETKQSYHLTVKAFNVPDEERCSFATVNIQLKGTNEYVPRFVSKLYYFEISEAAPKGTIVGEVFASDRDLGTDGEVHYLIFGNSRKKGFQINKKTGQIYVSGILDREKEERVSLKVLAKNFGSIRGADIDEVTVNVTVLDANDPPIFTLNIYSVQISEGVPIGTHVTFVSAFDSDSIPSWSRFSYFIGSGNENGAFSINPQTGQITVTAELDRETLPIYNLSVLAVDSGTPSATGSASLLVTLEDINDNGPMLTVSEGEVMENKRPGTLVMTLQSTDPDLPPNQGPFTYYLLSTGPATSYFSLSTAGVLSTTREIDREQIADFYLSVVTKDSGVPQMSSTGTVHITVIDQNDNPSQSRTVEIFVNYYGNLFPGGILGSVKPQDPDVLDSFHCSLTSGVTSLFSIPGGTCDLNSQPRSTDGTFDLTVLSNDGVHSTVTSNIRVFFAGFSNATVDNSILLRLGVPTVKDFLTNHYLHFLRIASSQLTGLGTAVQLYSAYEENNRTFLLAAVKRNHNQYVNPSGVATFFESIKEILLRQSGVKVESVDHDSCVHGPCQNGGSCLRRLAVSSVLKSRESLPVIIVANEPLQPFLCKCLPGYAGSWCEIDIDECLPSPCHSGGTCHNLVGGFSCSCPDGFTGRACERDINECLQSPCKNGAICQNFPGSFNCVCKTGYTGKMCESSVNYCECNPCFNGGSCQSGVDSYYCHCPFGVFGKHCELNSYGFEELSYMEFPSLDPNNNYIYVKFATIKSHALLLYNYDNQTGDRAEFLALEIAEERLRFSYNLGSGTYKLTTMKKVSDGHFHTVIARRAGMAASLTVDSCSENQEPGYCTVSNVAVSDDWTLDVQPNRVTVGGIRSLEPILQRRGHVESHDFVGCIMEFAVNGRPLEPSQALAAQGILDQCPRLEGACTRSPCQHGGTCMDYWSWQQCHCKEGLTGKYCEKSVTPDTALSLEGKGRLDYHMSQNEKREYLLRQSLRGAMLEPFGVNSLEVKFRTRSENGVLIHIQESSNYTTVKIKNGKVYFTSDAGIAGKVERNIPEVYVADGHWHTFLIGKNGTATVLSVDRIYNRDIIHPTQDFGGLDVLTISLGGIPPNQAHRDAQTAGFDGCIASMWYGGESLPFSGKHSLASISKTDPSVKIGCRGPNICASNPCWGDLLCINQWYAYRCVPPGDCASHPCQNGGSCEPGLHSGFTCSCPDSHTGRTCEMVVACLGVLCPQGKVCKAGSPAGHVCVLSQGPEEISLPLWAVPAIVGSCATVLALLVLSLILCNQCRGKKAKNPKEEKKPKEKKKKGSENVAFDDPDNIPPYGDDMTVRKQPEGNPKPDIIERENPYLIYDETDIPHNSETIPSAPLASPEQEIEHYDIDNASSIAPSDADIIQHYKQFRSHTPKFSIQRHSPLGFARQSPMPLGASSLTYQPSYGQGLRTSSLSHSACPTPNPLSRHSPAPFSKSSTFYRNSPARELHLPIRDGNTLEMHGDTCQPGIFNYATRLGRRSKSPQAMASHGSRPGSRLKQPIGQIPLESSPPVGLSIEEVERLNTPRPRNPSICSADHGRSSSEEDCRRPLSRTRNPADGIPAPESSSDSDSHESFTCSEMEYDREKPMVYTSRMPKLSQVNESDADDEDNYGARLKPRRYHGRRAEGGPVGTQAAAPGTADNTLPMKLGQQAGTFNWDNLLNWGPGFGHYVDVFKDLASLPEKAAANEEGKAGTTKPVPKDGEAEQYV

SEQ ID NO: 1537 - protein, 183 aa, unidentified
MAGGPPNTKAEMEMSLAEELNHGRQGENQEHLVIAEMMELGSRSRGASQKKQKLEQKAAGSASAKRVWNMTATRPKKMGSQLPKPRMLRESGHGDAHLQEYAGNFQGIRFHYDRNPGTDAVAQTSLEEFNVLEMEVMRRQLYAVNRRLRALEEQGATWRHRETLIIAVLVSASIANLWLWMNQ

SEQ ID NO: 1538 - protein, 333 aa, unidentified
MKGEAGHMLHNEKSKQEGHIWGSMRRTAFILGSGLLSFVAFWNSVTWHLQRFWGASGYFWQAQWERLLTTFEGKEWILFFIGAIQVPCLFFWSFNGLLLVVDTTGKPNFISRYRIQVGKNEPVDPVKLRQSIRTVLFNQCMISFPMVVFLYPFLKWWRDPCRRELPTFHWFLLELAIFTLIEEVLFYYSHRLLHHPTFYKKIHKKHHEWTAPIGVISLYAHPIEHAVSNMLPVIVGPLVMGSHLSSITMWFSLALIITTISHCGYHLPFLPSPEFHDYHHLKFNQCYGVLGVLDHLHGTDTMFKQTKAYERHVLLLGFTPLSESIPDSPKRME

SEQ ID NO: 1539 - protein, 701 aa, unidentified
MGHLLSKEPRNRPSQKRPRCCSWCRRRRPLLRLPRRTPAKVPPQPAAPRSRDCFFRGPCMLCFIVHSPGAPAPAGPEEEPPLSPPPRDGAYAAASSSQHLARRYAALAAEDCAAAARRFLLSSAAAAAAAAASASSPASCCKELGLAAAAAWEQQGRSLFLASLGPVRFLGPPAAVQLFRGPTPSPAELPTPPEMVCKRKGAGVPACTPCKQPRCGGGGCGGGGGGGGGGGPAGGGASPPRPPDAGCCQAPEQPPQPLCPPPSSPTSEGAPTEAGGDAVRAGGTAPLSAQQQHECGDADCRESPENPCDCHREPPPETPDINQLPPSILLKIFSNLSLDERCLSASLVCKYWRDLCLDFQFWKQLDLSSRQQVTDELLEKIASRSQNIIEINISDCRSMSDNGVCVLAFKCPGLLRYTAYRCKQLSDTSIIAVASHCPLLQKVHVGNQDKLTDEGLKQLGSKCRELKDIHFGQCYKISDEGMIVIAKGCLKLQRIYMQENKLVTDQSVKAFAEHCPELQYVGFMGCSVTSKGVIHLTKLRNLSSLDLRHITELDNETVMEIVKRCKNLSSLNLCLNWIINDRCVEVIAKEGQNLKELYLVSCKITDYALIAIGRYSMTIETVDVGWCKEITDQGATLIAQSSKSLRYLGLMRCDKVNEVTVEQLVQQYPHITFSTVLQDCKRTLERAYQMGWTPNMSAASS

SEQ ID NO: 1540 - protein, 1043 aa, unidentified
MRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAGEYFLQAELTSNVLKTGVVRCCVGQCNNAIPVDTVLTMKKLPITYSNRKENKGGYLCHSCAEQRIGPLAFLTASPEQVRAMERTVENIVLPRHEALLFLVF

SEQ ID NO: 1541 - protein, 539 aa, unidentified
MAVCARLCGVGPSRGCRRRQQRRGPAETAAADSEPDTDPEEERIEASAGVGGGLCAGPSPPPPRCSLLELPPELLVEIFASLPGTDLPSLAQVCTKFRRILHTDTIWRRRCREEYGVCENLRKLEITGVSCRDVYAKLLHRYRHILGLWQPDIGPYGGLLNVVVDGLFIIGWMYLPPHDPHVDDPMRFKPLFRIHLMERKAATVECMYGHKGPHHGHIQIVKKDEFSTKCNQTDHHRMSGGRQEEFRTWLREEWGRTLEDIFHEHMQELILMKFIYTSQYDNCLTYRRIYLPPSRPDDLIKPGLFKGTYGSHGLEIVMLSFHGRRARGTKITGDPNIPAGQQTVEIDLRHRIQLPDLENQRNFNELSRIVLEVRERVRQEQQEGGHEAGEGRGRQGPRESQPSPAQPRAEAPSKGPDGTPGEDGGEPGDAVAAAEQPAQCGQGQPFVLPVGVSSRNEDYPRTCRMCFYGTGLIAGHGFTSPERTPGVFILFDEDRFGFVWLELKSFSLYSRVQATFRNADAPSPQAFDEMLKNIQSLTS

SEQ ID NO: 1542 - protein, 464 aa, unidentified
MEIRLPDLALKRIFSFLDLFGLLQVSQVNKHWNRIADSDYLWRSLSLQRWDCSNFTNQHLGTHTWKQFFLHQRRKELRLALAQPHNFIYKVTKNIAFETELAYLSGNRLTVDEQEKSIICSVSPKQELCAWDVQEGTMIWSSPVQEFHFSNLVTLPQMHLAITMDRKKTIKVWNCQDRDALAVLPMPQPCYCMEAYLTKDGPFLMVGDAAGDIYTFTLPGLRDVSKVTAFQYGIVLLHCSPDKKWVFACGTYSRTLPQVFLTESLLRPSEGSVPLSTFLPHKLCASACWTPKVKNRITLMSQSSTGKKTEFITFDLTTKKTGGQTVIQAYEIASFQVAAHLKCPIWMGASDGYMIVFTSGPYLLLFSITGFLLQRFEDHQAAINNFWVDPCYVLTTSENSVHVYMWEEGGRHPYLRSCCHLENTWHDHTTDSCISSVMCDNASIVLRVRKVSDSSILVMYSLNT

SEQ ID NO: 1543 - protein, 532 aa, unidentified
MPLFLILCLLQGSSFALPQKRPHPRWLWEGSLPSRTHLRAMGTLRPSSPLCWREESSFAAPNSLKGSRLVSGEPGGAVTIQCHYAPSSVNRHQRKYWCRLGPPRWICQTIVSTNQYTHHRYRDRVALTDFPQRGLFVVRLSQLSPDDIGCYLCGIGSENNMLFLSMNLTISAGPASTLPTATPAAGELTMRSYGTASPVANRWTPGTTQTLGQGTAWDTVASTPGTSKTTASAEGRRTPGATRPAAPGTGSWAEGSVKAPAPIPESPPSKSRSMSNTTEGVWEGTRSSVTNRARASKDRREMTTTKADRPREDIEGVRIALDAAKKVLGTIGPPALVSETLAWEILPQATPVSKQQSQGSIGETTPAAGMWTLGTPAADVWILGTPAADVWTSMEAASGEGSAAGDLDAATGDRGPQATLSQTPAVGPWGPPGKESSVKRTFPEDESSSRTLAPVSTMLALFMLMALVLLQRKLWRRRTSQEAERVTLIQMTHFLEVNPQADQLPHVERKMLQDDSLPAGASLTAPERNPGP

SEQ ID NO: 1544 - protein, 287 aa, unidentified
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTALNKEASADVAEPSWSQQMCQPGLTFARTPSVCK

SEQ ID NO: 1545 - protein, 257 aa, unidentified
MAPAMESPTLLCVALLFFAPDGVLAVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQFFIPLLVVILFAVDTGLFISTQQQVTFLLKIKRTRKGFRLLNPHPKPNPKNN

SEQ ID NO: 1546 - protein, 86 aa, unidentified
MIPAVVLLLLLLVEQAAALGEPQLCYILDAILFLYGIVLTLLYCRLKIQVRKAAITSYEKSDGVYTGLSTRNQETYETLKHEKPPQ

SEQ ID NO: 1547 - protein, 321 aa, unidentified
MEEGQYSEIEELPRRRCCRRGTQIVLLGLVTAALWAGLLTLLLLWHWDTTQSLKQLEERAARNVSQVSKNLESHHGDQMAQKSQSTQISQELEELRAEQQRLKSQDLELSWNLNGLQADLSSFKSQELNERNEASDLLERLREEVTKLRMELQVSSGFVCNTCPEKWINFQRKCYYFGKGTKQWVHARYACDDMEGQLVSIHSPEEQDFLTKHASHTGSWIGLRNLDLKGEFIWVDGSHVDYSNWAPGEPTSRSQGEDCVMMRGSGRWNDAFCDRKLGAWVCDRLATCTPPASEGSAESMGPDSRPDPDGRLPTPSAPLHS

SEQ ID NO: 1548 - protein, 374 aa, unidentified
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFTEGEPLALRCHAWKDKLVYNVLYYRNGKAFKFFHWNSNLTILKTNISHNGTYHCSGMGKHRYTSAGISVTVKELFPAPVLNASVTSPLLEGNLVTLSCETKLLLQRPGLQLYFSFYMGSKTLRGRNTSSEYQILTARREDSGLYWCEAATEDGNVLKRSPELELQVLGLQLPTPVWFHVLFYLAVGIMFLVNTVLWVTIRKELKRKKKWDLEISLDSGHEKKVISSLQEDRHLEEELKCQEQKEEQLQEGVHRKEPQGAT

SEQ ID NO: 1549 - protein, 280 aa, unidentified
MWFLTTLLLWVPVDGQVDTTKAVITLQPPWVSVFQEETVTLHCEVLHLPGSSSTQWFLNGTATQTSTPSYRITSASVNDSGEYRCQRGLSGRSDPIQLEIHRGWLLLQVSSRVFMEGEPLALRCHAWKDKLVYNVLYYRNGKAFKFFHWNSNLTILKTNISHNGTYHCSGMGKHRYTSAGISQYTVKGLQLPTPVWFHVLFYLAVGIMFLVNTVLWVTIRKELKRKKKWNLEISLDSGHEKKVISSLQEDRHLEEELKCQEQKEEQLQEGVHRKEPQGAT

SEQ ID NO: 1550 - protein, 317 aa, unidentified
MTMETQMSQNVCPRNLWLLQPLTVLLLLASADSQAAAPPKAVLKLEPPWINVLQEDSVTLTCQGARSPESDSIQWFHNGNLIPTHTQPSYRFKANNNDSGEYTCQTGQTSLSDPVHLTVLSEWLVLQTPHLEFQEGETIMLRCHSWKDKPLVKVTFFQNGKSQKFSHLDPTFSIPQANHSHSGDYHCTGNIGYTLFSSKPVTITVQVPSMGSSSPMGIIVAVVIATAVAAIVAAVVALIYCRKKRISANSTDPVKAAQFEPPGRQMIAIRKRQLEETNNDYETADGGYMTLNPRAPTDDDKNIYLTLPPNDHVNSNN

SEQ ID NO: 1551 - protein, 310 aa, unidentified
MGILSFLPVLATESDWADCKSPQPWGHMLLWTAVLFLAPVAGTPAAPPKAVLKLEPQWINVLQEDSVTLTCRGTHSPESDSIQWFHNGNLIPTHTQPSYRFKANNNDSGEYTCQTGQTSLSDPVHLTVLSEWLVLQTPHLEFQEGETIVLRCHSWKDKPLVKVTFFQNGKSKKFSRSDPNFSIPQANHSHSGDYHCTGNIGYTLYSSKPVTITVQAPSSSPMGIIVAVVTGIAVAAIVAAVVALIYCRKKRISALPGYPECREMGETLPEKPANPTNPDEADKVGAENTITYSLLMHPDALEEPDDQNRI

SEQ ID NO: 1552 - protein, 254 aa, unidentified
MWQLLLPTALLLLVSAGMRTEDLPKAVVFLEPQWYRVLEKDSVTLKCQGAYSPEDNSTQWFHNESLISSQASSYFIDAATVDDSGEYRCQTNLSTLSDPVQLEVHIGWLLLQAPRWVFKEEDPIHLRCHSWKNTALHKVTYLQNGKGRKYFHHNSDFYIPKATLKDSGSYFCRGLFGSKNVSSETVNITITQGLAVSTISSFFPPGYQVSFCLVMVLLFAVDTGLYFSVKTNIRSSTRDWKDHKFKWRKDPQDK

SEQ ID NO: 1553 - protein, 233 aa, unidentified
MWQLLLPTALLLLVSAGMRTEDLPKAVVFLEPQWYSVLEKDSVTLKCQGAYSPEDNSTQWFHNESLISSQASSYFIDAATVNDSGEYRCQTNLSTLSDPVQLEVHIGWLLLQAPRWVFKEEDPIHLRCHSWKNTALHKVTYLQNGKDRKYFHHNSDFHIPKATLKDSGSYFCRGLVGSKNVSSETVNITITQGLAVSTISSFSPPGYQVSFCLVMVLLFAVDTGLYFSVKTNI

SEQ ID NO: 1554 - protein, 365 aa, unidentified
MGVPRPQPWALGLLLFLLPGSLGAESHLSLLYHLTAVSSPAPGTPAFWVSGWLGPQQYLSYNSLRGEAEPCGAWVWENQVSWYWEKETTDLRIKEKLFLEAFKALGGKGPYTLQGLLGCELGPDNTSVPTAKFALNGEEFMNFDLKQGTWGGDWPEALAISQRWQQQDKAANKELTFLLFSCPHRLREHLERGRGNLEWKEPPSMRLKARPSSPGFSVLTCSAFSFYPPELQLRFLRNGLAAGTGQGDFGPNSDGSFHASSSLTVKSGDEHHYCCIVQHAGLAQPLRVELESPAKSSVLVVGIVIGVLLLTAAAVGGALLWRRMRSGLPAPWISLRGDDTGVLLPTPGEAQDADLKDVNVIPATA

SEQ ID NO: 1555 - protein, 390 aa, unidentified
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHILIPTILGLFLLALLGLVVKRAVERRKALSRRARRLAVRMRALESSQRPRGSPRPRSQNNIYSACPRRARGADAAGTGEAPVPGPGAPLPPAPLQVSESPWLHAPSLKTSCEYVSLYHQPAAMMEDSDSDDYINVPA

SEQ ID NO: 1556 - protein, 326 aa, unidentified
MELSGATMARGLAVLLVLFLHIKNLPAQAADTCPEVKVVGLEGSDKLTILRGCPGLPGAPGPKGEAGVIGERGERGLPGAPGKAGPVGPKGDRGEKGMRGEKGDAGQSQSCATGPRNCKDLLDRGYFLSGWHTIYLPDCRPLTVLCDMDTDGGGWTVFQRRMDGSVDFYRDWAAYKQGFGSQLGEFWLGNDNIHALTAQGSSELRVDLVDFEGNHQFAKYKSFKVADEAEKYKLVLGAFVGGSAGNSLTGHNNNFFSTKDQDNDVSSSNCAEKFQGAWWYADCHASNLNGLYLMGPHESYANGINWSAAKGYKYSYKVSEMKVRPA

SEQ ID NO: 1557 - protein, 429 aa, unidentified
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 1558 - protein, 508 aa, unidentified
MLLWSLLVIFDAVTEQADSLTLVAPSSVFEGDSIVLKCQGEQNWKIQKMAYHKDNKELSVFKKFSDFLIQSAVLSDSGNYFCSTKGQLFLWDKTSNIVKIKVQELFQRPVLTASSFQPIEGGPVSLKCETRLSPQRLDVQLQFCFFRENQVLGSGWSSSPELQISAVWSEDTGSYWCKAETVTHRIRKQSLQSQIHVQRIPISNVSLEIRAPGGQVTEGQKLILLCSVAGGTGNVTFSWYREATGTSMGKKTQRSLSAELEIPAVKESDAGKYYCRADNGHVPIQSKVVNIPVRIPVSRPVLTLRSPGAQAAVGDLLELHCEALRGSPPILYQFYHEDVTLGNSSAPSGGGASFNLSLTAEHSGNYSCEANNGLGAQCSEAVPVSISGPDGYRRDLMTAGVLWGLFGVLGFTGVALLLYALFHKISGESSATNEPRGASRPNPQEFTYSSPTPDMEELQPVYVNVGSVDVDVVYSQVWSMQQPESSANIRTLLENKDSQVIYSSVKKS

SEQ ID NO: 1559 - protein, 734 aa, unidentified
MLLWLLLLILTPGREQSGVAPKAVLLLNPPWSTAFKGEKVALICSSISHSLAQGDTYWYHDEKLLKIKHDKIQITEPGNYQCKTRGSSLSDAVHVEFSPDWLILQALHPVFEGDNVILRCQGKDNKNTHQKVYYKDGKQLPNSYNLEKITVNSVSRDNSKYHCTAYRKFYILDIEVTSKPLNIQVQELFLHPVLRASSSTPIEGSPMTLTCETQLSPQRPDVQLQFSLFRDSQTLGLGWSRSPRLQIPAMWTEDSGSYWCEVETVTHSIKKRSLRSQIRVQRVPVSNVNLEIRPTGGQLIEGENMVLICSVAQGSGTVTFSWHKEGRVRSLGRKTQRSLLAELHVLTVKESDAGRYYCAADNVHSPILSTWIRVTVRIPVSHPVLTFRAPRAHTVVGDLLELHCESLRGSPPILYRFYHEDVTLGNSSAPSGGGASFNLSLTAEHSGNYSCDADNGLGAQHSHGVSLRVTVPVSRPVLTLRAPGAQAVVGDLLELHCESLRGSFPILYWFYHEDDTLGNISAHSGGGASFNLSLTTEHSGNYSCEADNGLGAQHSKVVTLNVTGTSRNRTGLTAAGITGLVLSILVLAAAAALLHYARARRKPGGLSATGTSSHSPSECQEPSSSRPSRIDPQEPTHSKPLAPMELEPMYSNVNPGDSNPIYSQIWSIQHTKENSANCPMMHQEHEELTVLYSELKKTHPDDSAGEASSRGRAHEEDDEENYENVPRVLLASDH

SEQ ID NO: 1560 - protein, 515 aa, unidentified
MLLWASLLAFAPVCGQSAAAHKPVISVHPPWTTFFKGERVTLTCNGFQFYATEKTTWYHRHYWGEKLTLTPGNTLEVRESGLYRCQARGSPRSNPVRLLFSSDSLILQAPYSVFEGDTLVLRCHRRRKEKLTAVKYTWNGNILSISNKSWDLLIPQASSNNNGNYRCIGYGDENDVFRSNFKIIKIQELFPHPELKATDSQPTEGNSVNLSCETQLPPERSDTPLHFNFFRDGEVILSDWSTYPELQLPTVWRENSGSYWCGAETVRGNIHKHSPSLQIHVQRIPVSGVLLETQPSGGQAVEGEMLVLVCSVAEGTGDTTFSWHREDMQESLGRKTQRSLRAELELPAIRQSHAGGYYCTADNSYGPVQSMVLNVTVRETPGNRDGLVAAGATGGLLSALLLAVALLFHCWRRRKSGVGFLGDETRLPPAPGPGESSHSICPAQVELQSLYVDVHPKKGDLVYSEIQTTQLGEEEEANTSRTLLEDKDVSVVYSEVKTQHPDNSAGKISSKDEES

SEQ ID NO: 1561 - protein, 977 aa, unidentified
MLLWVILLVLAPVSGQFARTPRPIIFLQPPWTTVFQGERVTLTCKGFRFYSPQKTKWYHRYLGKEILRETPDNILEVQESGEYRCQAQGSPLSSPVHLDFSSASLILQAPLSVFEGDSVVLRCRAKAEVTLNNTIYKNDNVLAFLNKRTDFHIPHACLKDNGAYRCTGYKESCCPVSSNTVKIQVQEPFTRPVLRASSFQPISGNPVTLTCETQLSLERSDVPLRFRFFRDDQTLGLGWSLSPNFQITAMWSKDSGFYWCKAATMPYSVISDSPRSWIQVQIPASHPVLTLSPEKALNFEGTKVTLHCETQEDSLRTLYRFYHEGVPLRHKSVRCERGASISFSLTTENSGNYYCTADNGLGAKPSKAVSLSVTVPVSHPVLNLSSPEDLIFEGAKVTLHCEAQRGSLPILYQFHHEGAALERRSANSAGGVAISFSLTAEHSGNYYCTADNGFGPQRSKAVSLSVTVPVSHPVLTLSSAEALTFEGATVTLHCEVQRGSPQILYQFYHEDMPLWSSSTPSVGRVSFSFSLTEGHSGNYYCTADNGFGPQRSEVVSLFVTVPVSRPILTLRVPRAQAVVGDLLELHCEAPRGSPPILYWFYHEDVTLGSSSAPSGGEASFNLSLTAEHSGNYSCEANNGLVAQHSDTISLSVIVPVSRPILTFRAPRAQAVVGDLLELHCEALRGSSPILYWFYHEDVTLGKISAPSGGGASFNLSLTTEHSGIYSCEADNGLEAQRSEMVTLKVAVPVSRPVLTLRAPGTHAAVGDLLELHCEALRGSPLILYRFFHEDVTLGNRSSPSGGASLNLSLTAEHSGNYSCEADNGLGAQRSETVTLYITGLTANRSGPFATGVAGGLLSIAGLAAGALLLYCWLSRKAGRKPASDPARSPSDSDSQEPTYHNVPAWEELQPVYTNANPRGENVVYSEVRIIQEKKKHAVASDPRHLRNKGSPIIYSEVKVASTPVSGSLFLASSAPHR

SEQ ID NO: 1562 - protein, 434 aa, unidentified
MLLWTAVLLFVPCVGKTVWLYLQAWPNPVFEGDALTLRCQGWKNTPLSQVKFYRDGKFLHFSKENQTLSMGAATVQSRGQYSCSGQVMYIPQTFTQTSETAMVQVQELFPPPVLSAIPSPEPREGSLVTLRCQTKLHPLRSALRLLFSFHKDGHTLQDRGPHPELCIPGAKEGDSGLYWCEVAPEGGQVQKQSPQLEVRVQAPVSRPVLTLHHGPADPAVGDMVQLLCEAQRGSPPILYSFYLDEKIVGNHSAPCGGTTSLLFPVKSEQDAGNYSCEAENSVSRERSEPKKLSLKGSQVLFTPASNWLVPWLPASLLGLMVIAAALLVYVRSWRKAGPLPSQIPPTAPGGEQCPLYANVHHQKGKDEGVVYSVVHRTSKRSEARSAEFTVGRKDSSIICAEVRCLQPSEVSSTEVNMRSRTLQEPLSDCEEVLC

SEQ ID NO: 1563 - protein, 359 aa, unidentified
MKLGCVLMAWALYLSLGVLWVAQMLLAASFETLQCEGPVCTEESSCHTEDDLTDAREAGFQVKAYTFSEPFHLIVSYDWLILQGPAKPVFEGDLLVLRCQAWQDWPLTQVTFYRDGSALGPPGPNREFSITVVQKADSGHYHCSGIFQSPGPGIPETASVVAITVQELFPAPILRAVPSAEPQAGSPMTLSCQTKLPLQRSAARLLFSFYKDGRIVQSRGLSSEFQIPTASEDHSGSYWCEAATEDNQVWKQSPQLEIRVQGASSSAAPPTLNPAPQKSAAPGTAPEEAPGPLPPPPTPSSEDPGFSSPLGMPDPHLYHQMGLLLKHMQDVRVLLGHLLMELRELSGHRKPGTTKATAE

SEQ ID NO: 1564 - protein, 417 aa, unidentified
MEFVKCLGHPEEFYNLVRFRIGGKRKVMPKMDQDSLSSSLKTCYKYLNQTSRSFAAVIQALDGEMRNAVCIFYLVLRALDTLEDDMTISVEKKVPLLHNFHSFLYQPDWRFMESKEKDRQVLEDFPTISLEFRNLAEKYQTVIADICRRMGIGMAEFLDKHVTSEQEWDKYCHYVAGLVGIGLSRLFSASEFEDPLVGEDTERANSMGLFLQKTNIIRDYLEDQQGGREFWPQEVWSRYVKKLGDFAKPENIDLAVQCLNELITNALHHIPDVITYLSRLRNQSVFNFCAIPQVMAIATLAACYNNQQVFKGAVKIRKGQAVTLMMDATNMPAVKAIIYQYMEEIYHRIPDSDPSSSKTRQIISTIRTQNLPNCQLISRSHYSPIYLSFVMLLAALSWQYLTTLSQVTEDYVQTGEH

SEQ ID NO: 1565 - protein, 1857 aa, unidentified
MFGLKVKKKRNKAEKGLILANKAAKDSQGDTEALQEEPSHQEGPRGDLVHDDASIFPVPSASPKRRSKLLTKIHDGEVRSQNYQIAITITEARQLVGENIDPVVTIEIGDEKKQSTVKEGTNSPFYNEYFVFDFIGPQVHLFDKIIKISVFHHKLIGSVLIGSFKVDLGTVYNQPGHQFCNKWALLTDPGDIRTGTKGYLKCDISVMGKGDVLKTSPKTSDTEEPIEKNLLIPNGFPLERPWARFYVRLYKAEGLPKMNSSIMANVTKAFVGDSKDLVDPFVEVSFAGQMGRTTVQKNCADPVWHEQVIFKEMFPPLCRRVKIQVWDEGSMNDVALATHFIDLKKISNEQDGDKGFLPTFGPAWINLYGSPRNHSLMDDYQEMNEGFGEGVSFRGRILVEIAVEILSGRAQESKFSKALKELKLPSKDKDSKSSKGKDKADKTEDGKSQQASNKTNSTEVEVESFDVPPEIVPEKNEEFLLFGAFFEATMIDRKIGDKPISFEVSIGNFGNLIDGGSHHGSKKSAESAEEDLLPLLHEGQGDVAHDVPIPMASTTHPEKPLVTEGNRNYNYLPFEAKKPCVYFISSWGDQTFRLHWSNMLEKMADFLEESIEEVRELIKISQEAPEEKMKTVLSDFISRSSAFISEAEKKPKMLNQTTLDKKRLTLCWQELEAMCKEAKGIIQQQKKKLSVDEMIHEAQNFVEKIRFLVDEPQHTIPDVFIWMLSNNRRVAYARIASKDLLYSPVAGQMGKHCGKIKTHFLKPPGKRPAGWSVQAKVDVYLWLGSIKHASAILDNLPVGYEAEMSSKGAGTNHPPSNLLYQEQHVFQLRAHMYQARGLIAADSNGLSDPFAKVTFLSHCQTTKIISQTLSPTWNQMLLFNDLVLHGDVKELAESPPLVVVELYDSDAVGKPEYLGATVAAPVVKLADQDYEPPRLCYHPIFCGNLSGGDLLAVFELLQVPPSGLQGLPPVEPPDITQIYPVPANIRPVLSKYRVEVLFWGVREMKKVQLLSVDRPQALIECGGQGVKSCVIQSYKNNPNFSIQADAFEVELPENELLHPPLSICVVDWRAFGRSTLVGTYTINYLKQFLCKLREPLAPITQVDGTQPGHDISDSLTATESSGAHSSSQDPPADHIYVDVEPPPTVVPDSAQAQPAILVDVPDSSPMLEPEHTPVAQEPPKDGKPKDPRKPSRRSTKRRKRTIADESAENVIDWWSKYYASLKKAQKAKERNPKGKKGNTEAKPDEVVVDIEDGPKKKKDKMLKKKPKDDGIPNLAILQIYDGDLESEFNNFEDWVKTFELFRGKSTEDDHGLDGDRVIGKFKGSFCIYKSPQDSSSEDSGQLRIQQGIPPNHPVTVLIRVYIVAAFNLSPADPDGKSDPYIVIKLGKTEIKDRDKYIPKQLNPVFGRSFEIQATFPKESLLSILIYDHDMIGTDDLIGETKIDLENRFYSKHRAICGLQSQYEIEGYNAWRDTSKPTEILTKLCKDNKLDGPYFHPGKIQIGNQVFSGKTIFTEEDTDETVESYEHLALKVLHSWEDIPEVGCRLVPEHIETRPLYHKDKPGMEQGRLQMWVDMFPKDMPQPGPPVDISPRRPKGYELRVTIWNTEDVILEDENIFTGQKSSDIYVKGWLKGLEDDKQETDVHYNSLTGEGNFNWRFLFPFQYLPAEKQMVITKRENIFSLEKMECKTPAVLVLQVWDFERLSSDDFLGTLEMNLNSFPRAAKSAKACDLAKFENASEETKISIFQQKRVRGWWPFSKSKELTGKVEAEFHLVTAEEAEKNPVGKARKEPEPLAKPNRPDTSFSWFMSPFKCLYYLIWKNYKKYIIIAFILIILIIFLVLFIYTLPGAISRRIVVGS

SEQ ID NO: 1566 - protein, 300 aa, unidentified
MDLPPQLSFGLYVAAFALGFPLNVLAIRGATAHARLRLTPSLVYALNLGCSDLLLTVSLPLKAVEALASGAWPLPASLCPVFAVAHFFPLYAGGGFLAALSAGRYLGAAFPLGYQAFRRPCYSWGVCAAIWALVLCHLGLVFGLEAPGGWLDHSNTSLGINTPVNGSPVCLEAWDPASAGPARFSLSLLLFFLPLAITAFCYVGCLRALARSGLTHRRKLRAAWVAGGALLTLLLCVGPYNASNVASFLYPNLGGSWRKLGLITGAWSVVLNPLVTGYLGRGPGLKTVCAARTQGGKSQK

SEQ ID NO: 1567 - protein, 330 aa, unidentified
MLPDWKSSLILMAYIIIFLTGLPANLLALRAFVGRIRQPQPAPVHILLLSLTLADLLLLLLLPFKIIEAASNFRWYLPKVVCALTSFGFYSSIYCSTWLLAGISIERYLGVAFPVQYKLSRRPLYGVIAALVAWVMSFGHCTIVIIVQYLNTTEQVRSGNEITCYENFTDNQLDVVLPVRLELCLVLFFIPMAVTIFCYWRFVWIMLSQPLVGAQRRRRAVGLAVVTLLNFLVCFGPYNVSHLVGYHQRKSPWWRSIAVVFSSLNASLDPLLFYFSSSVVRRAFGRGLQVLRNQGSSLLGRRGKDTAEGTNEDRGVGQGEGMPSSDFTTE

SEQ ID NO: 1568 - protein, 346 aa, unidentified
MDTGPDQSYFSGNHWFVFSVYLLTFLVGLPLNLLALVVFVGKLQRRPVAVDVLLLNLTASDLLLLLFLPFRMVEAANGMHWPLPFILCPLSGFIFFTTIYLTALFLAAVSIERFLSVAHPLWYKTRPRLGQAGLVSVACWLLASAHCSVVYVIEFSGDISHSQGTNGTCYLEFRKDQLAILLPVRLEMAVVLFVVPLIITSYCYSRLVWILGRGGSHRRQRRVAGLLAATLLNFLVCFGPYNVSHVVGYICGESPAWRIYVTLLSTLNSCVDPFVYYFSSSGFQADFHELLRRLCGLWGQWQQESSMELKEQKGGEEQRADRPAERKTSEHSQGCGTGGQVACAES

SEQ ID NO: 1569 - protein, 377 aa, unidentified
MSPECARAAGDAPLRSLEQANRTRFPFFSDVKGDHRLVLAAVETTVLVLIFAVSLLGNVCALVLVARRRRRGATACLVLNLFCADLLFISAIPLVLAVRWTEAWLLGPVACHLLFYVMTLSGSVTILTLAAVSLERMVCIVHLQRGVRGPGRRARAVLLALIWGYSAVAALPLCVFFRVVPQRLPGADQEISICTLIWPTIPGEISWDVSFVTLNFLVPGLVIVISYSKILQTSEHLLDARAVVTHSEITKASRKRLTVSLAYSESHQIRVSQQDFRLFRTLFLLMVSFFIMWSPIIITILLILIQNFKQDLVIWPSLFFWVVAFTFANSALNPILYNMTLCRNEWKKIFCCFWFPEKGAILTDTSVKRNDLSIISG

SEQ ID NO: 1570 - protein, 822 aa, unidentified [sequence omitted]

SEQ ID NO: 1571 - protein, 821 aa, unidentified
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 1572 - protein, 806 aa, unidentified
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 1573 - protein, 802 aa, unidentified
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 1574 - protein, 504 aa, unidentified
MTPSPLLLLLLPPLLLGAFPPAAAARGPPKMADKVVPRQVARLGRTVRLQCPVEGDPPPLTMWTKDGRTIHSGWSRFRVLPQGLKVKQVEREDAGVYVCKATNGFGSLSVNYTLVVLDDISPGKESLGPDSSSGGQEDPASQQWARPRFTQPSKMRRRVIARPVGSSVRLKCVASGHPRPDITWMKDDQALTRPEAAEPRKKKWTLSLKNLRPEDSGKYTCRVSNRAGAINATYKVDVIQRTRSKPVLTGTHPVNTTVDFGGTTSFQCKVRSDVKPVIQWLKRVEYGAEGRHNSTIDVGGQKFVVLPTGDVWSRPDGSYLNKLLITRARQDDAGMYICLGANTMGYSFRSAFLTVLPDPKPPGPPVASSSSATSLPWPVVIGIPAGAVFILGTLLLWLCQAQKKPCTPAPAPPLPGHRPPGTARDRSGDKDLPSLAALSAGPGVGLCEEHGSPAAPQHLLGPGPVAGPKLYPKLYTDIHTHTHTHSHTHSHVEGKVHQHIHYQC

SEQ ID NO: 1575 - protein, 907 aa, unidentified
MPTAAAPIISSVQKLVLYETRARYFLVGSNNAETKYRVLKIDRTEPKDLVIIDDRHVYTQQEVRELLGRLDLGNRTKMGQKGSSGLFRAVSAFGVVGFVRFLEGYYIVLITKRRKMADIGGHAIYKVEDTNMIYIPNDSVRVTHPDEARYLRIFQNVDLSSNFYFSYSYDLSHSLQYNLTVLRMPLEMLKSEMTQNRQESFDIFEDEGLITQGGSGVFGICSEPYMKYVWNGELLDIIKSTVHRDWLLYIIHGFCGQSKLLIYGRPVYVTLIARRSSKFAGTRFLKRGANCEGDVANEVETEQILCDASVMSFTAGSYSSYVQVRGSVPLYWSQDISTMMPKPPITLDQADPFAHVAALHFDQMFQRFGSPIIILNLVKEREKRKHERILSEELVAAVTYLNQFLPPEHTIVYIPWDMAKYTKSKLCNVLDRLNVIAESVVKKTGFFVNRPDSYCSILRPDEKWNELGGCVIPTGRLQTGILRTNCVDCLDRTNTAQFMVGKCALAYQLYSLGLIDKPNLQFDTDAVRLFEELYEDHGDTLSLQYGGSQLVHRVKTYRKIAPWTQHSKDIMQTLSRYYSNAFSDADRQDSINLFLGVFHPTEGKPHLWELPTDFYLHHKNTMRLLPTRRSYTYWWTPEVIKHLPLPYDEVICAVNLKKLIVKKFHKYEEEIDIHNEFFRPYELSSFDDTFCLAMTSSARDFMPKTVGIDPSPFTVRKPDETGKSVLGNKSNREEAVLQRKTAASAPPPPSEEAVSSSSEDDSGTDREEEGSVSQRSTPVKMTDAGDSAKVTENVVQPMKELYGINLSDGLSEEDFSIYSRFVQLGQSQHKQDKNSQQPCSRCSDGVIKLTPISAFSQDNIYEVQPPRVDRKSTEIFQAHIQASQGIMQPLGKEDSSMYREYIRNRYL

SEQ ID NO: 1576 - protein, 152 aa, unidentified
MEAVLNELVSVEDLLKFEKKFQSEKAAGSVSKSTQFEYAWCLVRSKYNDDIRKGIVLLEELLPKGSKEEQRDYVFYLAVGNYRLKEYEKALKYVRGLLQTEPQNNQAKELERLIDKAMKKDGLVGMAIVGGMALGVAGLAGLIGLAVSKSKS

SEQ ID NO: 1577 - protein, 292 aa, unidentified
MERGPVVGAGLGAGARIQALLGCLLKVLLWVASALLYFGSEQAARLLGSPCLRRLYHAWLAAVVIFGPLLQFHVNPRTIFASHGNFFNIKFVNSAWGWTCTFLGGFVLLVVFLATRRVAVTARHLSRLVVGAAVWRGAGRAFLLIEDLTGSCFEPLPQGLLLHELPDRRSCLAAGHQWRGYTVSSHTFLLTFCCLLMAEEAAVFAKYLAHGLPAGAPLRLVFLLNVLLLGLWNFLLLCTVIYFHQYTHKVVGAAVGTFAWYLTYGSWYHQPWSPGSPGHGLFPRPHSSRKHN

SEQ ID NO: 1578 - protein, 262 aa, unidentified
MEHLERCEWLLRGTLVRAAVRRYLPWALVASMLAGSLLKELSPLPESYLSNKRNVLNVYFVKVAWAWTFCLLLPFIALTNYHLTGKAGLVLRRLSTLLVGTAIWYICTSIFSNIEHYTGSCYQSPALEGVRKEHQSKQQCHQEGGFWHGFDISGHSFLLTFCALMIVEEMSVLHEVKTDRSHCLHTAITTLVVALGILTFIWVLMFLCTAVYFHNLSQKVFGTLFGLLSWYGTYGFWYPKAFSPGLPPQSCSLNLKQDSYKK

SEQ ID NO: 1579 - protein, 201 aa, unidentified
MTLRPSLLPLHLLLLLLLSAAVCRAEAGLETESPVRTLQVETLVEPPEPCAEPAAFGDTLHIHYTGSLVDGRIIDTSLTRDPLVIELGQKQVIPGLEQSLLDMCVGEKRRAIIPSHLAYGKRGFPPSVPADAVVQYDVELIALIRANYWLKLVKGILPLVGMAMVPALLGLIGYHLYRKANRPKVSKKKLKEEKRNKSKKK

SEQ ID NO: 1580 - protein, 108 aa, unidentified
MGVQVETISPGDGRTFPKRGQTCVVHYTGMLEDGKKFDSSRDRNKPFKFMLGKQEVIRGWEEGVAQMSVGQRAKLTISPDYAYGATGHPGIIPPHATLVFDVELLKLE

SEQ ID NO: 1581 - protein, 412 aa, unidentified
MASCAEPSEPSAPLPAGVPPLEDFEVLDGVEDAEGEEEEEEEEEEEDDLSELPPLEDMGQPPAEEAEQPGALAREFLAAMEPEPAPAPAPEEWLDILGNGLLRKKTLVPGPPGSSRPVKGQVVTVHLQTSLENGTRVQEEPELVFTLGDCDVIQALDLSVPLMDVGETAMVTADSKYCYGPQGRSPYIPPHAALCLEVTLKTAVDGPDLEMLTGQERVALANRKRECGNAHYQRADFVLAANSYDLAIKAITSSAKVDMTFEEEAQLLQLKVKCLNNLAASQLKLDHYRAALRSCSLVLEHQPDNIKALFRKGKVLAQQGEYSEAIPILRAALKLEPSNKTIHAELSKLVKKHAAQRSTETALYRKMLGNPSRLPAKCPGKGAWSIPWKWLFGATAVALGGVALSVVIAARN

SEQ ID NO: 1582 - protein, 495 aa, unidentified
MRLTRCQAALAAAITLNLLVLFYVSWLQHQPRNSRARGPRRASAAGPRVTVLVREFEAFDNAVPELVDSFLQQDPAQPVVVAADTLPYPPLALPRIPNVRLALLQPALDRPAAASRPETYVATEFVALVPDGARAEAPGLLERMVEALRAGSARLVAAPVATANPARCLALNVSLREWTARYGAAPAAPRCDALDGDAVVLLRARDLFNLSAPLARPVGTSLFLQTALRGWAVQLLDLTFAAARQPPLATAHARWKAEREGRARRAALLRALGIRLVSWEGGRLEWFGCNKETTRCFGTVVGDTPAYLYEERWTPPCCLRALRETARYVVGVLEAAGVRYWLEGGSLLGAARHGDIIPWDYDVDLGIYLEDVGNCEQLRGAEAGSVVDERGFVWEKAVEGDFFRVQYSESNHLHVDLWPFYPRNGVMTKDTWLDHRQDVEFPEHFLQPLVPLPFAGFVAQAPNNYRRFLELKFGPGVIENPQYPNPALLSLTGSG

SEQ ID NO: 1583 - protein, 646 aa, unidentified
MDLRDWLFLCYGLIAFLTEVIDSTTCPSVCRCDNGFIYCNDRGLTSIPADIPDDATTLYLQNNQINNAGIPQDLKTKVNVQVIYLYENDLDEFPINLPRSLRELHLQDNNVRTIARDSLARIPLLEKLHLDDNSVSTVSIEEDAFADSKQLKLLFLSRNHLSSIPSGLPHTLEELRLDDNRISTIPLHAFKGLNSLRRLVLDGNLLANQRIADDTFSRLQNLTELSLVRNSLAAPPLNLPSAHLQKLYLQDNAISHIPYNTLAKMRELERLDLSNNNLTTLPRGLFDDLGNLAQLLLRNNPWFCGCNLMWLRDWVKARAAVVNVRGLMCQGPEKVRGMAIKDITSEMDECFETGPQGGVANAAAKTTASNHASATTPQGSLFTLKAKRPGLRLPDSNIDYPMATGDGAKTLAIHVKALTADSIRITWKATLPASSFRLSWLRLGHSPAVGSITETLVQGDKTEYLLTALEPKSTYIICMVTMETSNAYVADETPVCAKAETADSYGPTTTLNQEQNAGPMASLPLAGIIGGAVALVFLFLVLGAICWYVHQAGELLTRERAYNRGSRKKDDYMESGTKKDNSILEIRGPGLQMLPINPYRAKEEYVVHTIFPSNGSSLCKATHTIGYGTTRGYRDGGIPDIDYSYT

SEQ ID NO: 1584 - protein, 660 aa, unidentified
MGLQTTKWPSHGAFFLKSWLIISLGLYSQVSKLLACPSVCRCDRNFVYCNERSLTSVPLGIPEGVTVLYLHNNQINNAGFPAELHNVQSVHTVYLYGNQLDEFPMNLPKNVRVLHLQENNIQTISRAALAQLLKLEELHLDDNSISTVGVEDGAFREAISLKLLFLSKNHLSSVPVGLPVDLQELRVDENRIAVISDMAFQNLTSLERLIVDGNLLTNKGIAEGTFSHLTKLKEFSIVRNSLSHPPPDLPGTHLIRLYLQDNQINHIPLTAFSNLRKLERLDISNNQLRMLTQGVFDNLSNLKQLTARNNPWFCDCSIKWVTEWLKYIPSSLNVRGFMCQGPEQVRGMAVRELNMNLLSCPTTTPGLPLFTPAPSTASPTTQPPTLSIPNPSRSYTPPTPTTSKLPTIPDWDGRERVTPPISERIQLSIHFVNDTSIQVSWLSLFTVMAYKLTWVKMGHSLVGGIVQERIVSGEKQHLSLVNLEPRSTYRICLVPLDAFNYRAVEDTICSEATTHASYLNNGSNTASSHEQTTSHSMGSPFLLAGLIGGAVIFVLVVLLSVFCWHMHKKGRYTSQKWKYNRGRRKDDYCEAGTKKDNSILEMTETSFQIVSLNNDQLLKGDFRLQPIYTPNGGINYTDCHIPNNMRYCNSSVPDLEHCHT

SEQ ID NO: 1585 - protein, 649 aa, unidentified
MISAAWSIFLIGTKIGLFLQVAPLSVMAKSCPSVCRCDAGFIYCNDRFLTSIPTGIPEDATTLYLQNNQINNAGIPSDLKNLLKVERIYLYHNSLDEFPTNLPKYVKELHLQENNIRTITYDSLSKIPYLEELHLDDNSVSAVSIEEGAFRDSNYLRLLFLSRNHLSTIPWGLPRTIEELRLDDNRISTISSPSLQGLTSLKRLVLDGNLLNNHGLGDKVFFNLVNLTELSLVRNSLTAAPVNLPGTNLRKLYLQDNHINRVPPNAFSYLRQLYRLDMSNNNLSNLPQGIFDDLDNITQLILRNNPWYCGCKMKWVRDWLQSLPVKVNVRGLMCQAPEKVRGMAIKDLNAELFDCKDSGIVSTIQITTAIPNTVYPAQGQWPAPVTKQPDIKNPKLTKDHQTTGSPSRKTITITVKSVTSDTIHISWKLALPMTALRLSWLKLGHSPAFGSITETIVTGERSEYLVTALEPDSPYKVCMVPMETSNLYLFDETPVCIETETAPLRMYNPTTTLNREQEKEPYKNPNLPLAAIIGGAVALVTIALLALVCWYVHRNGSLFSRNCAYSKGRRRKDDYAEAGTKKDNSILEIRETSFQMLPISNEPISKEEFVIHTIFPPNGMNLYKNNHSESSSNRSYRDSGIPDSDHSHS

SEQ ID NO: 1586 - protein, 1338 aa, unidentified
MVSYWDTGVLLCALLSCLLLTGSSSGSKLKDPELSLKGTQHIMQAGQTLHLQCRGEAAHKWSLPEMVSKESERLSITKSACGRNGKQFCSTLTLNTAQANHTGFYSCKYLAVPTSKKKETESAIYIFISDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVQISTPRPVKLLRGHTLVLNCTATTPLNTRVQMTWSYPDEKNKRASVRRRIDQSNSHANIFYSVLTIDKMQNKDKGLYTCRVRSGPSFKSVNTSVHIYDKAFITVKHRKQQVLETVAGKRSYRLSMKVKAFPSPEVVWLKDGLPATEKSARYLTRGYSLIIKDVTEEDAGNYTILLSIKQSNVFKNLTATLIVNVKPQIYEKAVSSFPDPALYPLGSRQILTCTAYGIPQPTIKWFWHPCNHNHSEARCDFCSNNEESFILDADSNMGNRIESITQRMAIIEGKNKMASTLVVADSRISGIYICIASNKVGTVGRNISFYITDVPNGFHVNLEKMPTEGEDLKLSCTVNKFLYRDVTWILLRTVNNRTMHYSISKQKMAITKEHSITLNLTIMNVSLQDSGTYACRARNVYTGEEILQKKEITIRDQEAPYLLRNLSDHTVAISSSTTLDCHANGVPEPQITWFKNNHKIQQEPGIILGPGSSTLFIERVTEEDEGVYHCKATNQKGSVESSAYLTVQGTSDKSNLELITLTCTCVAATLFWLLLTLFIRKMKRSSSEIKTDYLSIIMDPDEVPLDEQCERLPYDASKWEFARERLKLGKSLGRGAFGKVVQASAFGIKKSPTCRTVAVKMLKEGATASEYKALMTELKILTHIGHHLNVVNLLGACTKQGGPLMVIVEYCKYGNLSNYLKSKRDLFFLNKDAALHMEPKKEKMEPGLEQGKKPRLDSVTSSESFASSGFQEDKSLSDVEEEEDSDGFYKEPITMEDLISYSFQVARGMEFLSSRKCIHRDLAARNILLSENNVVKICDFGLARDIYKNPDYVRKGDTRLPLKWMAPESIFDKIYSTKSDVWSYGVLLWEIFSLGGSPYPGVQMDEDFCSRLREGMRMRAPEYSTPEIYQIMLDCWHRDPKERPRFAELVEKLGDLLQANVQQDGKDYIPINAILTGNSGFTYSTPAFSEDFFKESISAPKFNSGSSDDVRYVNAFKFMSLERIKTFEELLPNATSMFDDYQGDSSTLLASPMLKRFTWTDSKPKASLKIDLRVTSKSKESGLSDVSRPSFCHSSCGHVSEGKRRFTYDHAELERKIACCSPPPDYNSVVLYSTPPI

SEQ ID NO: 1587 - protein, 993 aa, unidentified
MPALARDGGQLPLLVVFSAMIFGTITNQDLPVIKCVLINHKNNDSSVGKSSSYPMVSESPEDLGCALRPQSSGTVYEAAAVEVDVSASITLQVLVDAPGNISCLWVFKHSSLNCQPHFDLQNRGVVSMVILKMTETQAGEYLLFIQSEATNYTILFTVSIRNTLLYTLRRPYFRKMENQDALVCISESVPEPIVEWVLCDSQGESCKEESPAVVKKEEKVLHELFGTDIRCCARNELGRECTRLFTIDLNQTPQTTLPQLFLKVGEPLWIRCKAVHVNHGFGLTWELENKALEEGNYFEMSTYSTNRTMIRILFAFVSSVARNDTGYYTCSSSKHPSQSALVTIVEKGFINATNSSEDYEIDQYEEFCFSVRFKAYPQIRCTWTFSRKSFPCEQKGLDNGYSISKFCNHKHQPGEYIFHAENDDAQFTKMFTLNIRRKPQVLAEASASQASCFSDGYPLPSWTWKKCSDKSPNCTEEITEGVWNRKANRKVFGQWVSSSTLNMSEAIKGFLVKCCAYNSLGTSCETILLNSPGPFPFIQDNISFYATIGVCLLFIVVLTLLICHKYKKQFRYESQLQMVQVTGSSDNEYFYVDFREYEYDLKWEFPRENLEFGKVLGSGAFGKVMNATAYGISKTGVSIQVAVKMLKEKADSSEREALMSELKMMTQLGSHENIVNLLGACTLSGPIYLIFEYCCYGDLLNYLRSKREKFHRTWTEIFKEHNFSFYPTFQSHPNSSMPGSREVQIHPDSDQISGLHGNSFHSEDEIEYENQKRLEEEEDLNVLTFEDLLCFAYQVAKGMEFLEFKSCVHRDLAARNVLVTHGKVVKICDFGLARDIMSDSNYVVRGNARLPVKWMAPESLFEGIYTIKSDVWSYGILLWEIFSLGVNPYPGIPVDANFYKLIQNGFKMDQPFYATEEIYIIMQSCWAFDSRKRPSFPNLTSFLGCQLADAEEAMYQNVDGRVSECPHTYQNRRPFSREMDLGLLSPQAQVEDS

SEQ ID NO: 1588 - protein, 235 aa, unidentified
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 1589 - protein, 1363 aa, unidentified
MQRGAALCLRLWLCLGLLDGLVSGYSMTPPTLNITEESHVIDTGDSLSISCRGQHPLEWAWPGAQEAPATGDKDSEDTGVVRDCEGTDARPYCKVLLLHEVHANDTGSYVCYYKYIKARIEGTTAASSYVFVRDFEQPFINKPDTLLVNRKDAMWVPCLVSIPGLNVTLRSQSSVLWPDGQEVVWDDRRGMLVSTPLLHDALYLQCETTWGDQDFLSNPFLVHITGNELYDIQLLPRKSLELLVGEKLVLNCTVWAEFNSGVTFDWDYPGKQAERGKWVPERRSQQTHTELSSILTIHNVSQHDLGSYVCKANNGIQRFRESTEVIVHENPFISVEWLKGPILEATAGDELVKLPVKLAAYPPPEFQWYKDGKALSGRHSPHALVLKEVTEASTGTYTLALWNSAAGLRRNISLELVVNVPPQIHEKEASSPSIYSRHSRQALTCTAYGVPLPLSIQWHWRPWTPCKMFAQRSLRRRQQQDLMPQCRDWRAVTTQDAVNPIESLDTWTEFVEGKNKTVSKLVIQNANVSAMYKCVVSNKVGQDERLIYFYVTTIPDGFTIESKPSEELLEGQPVLLSCQADSYKYEHLRWYRLNLSTLHDAHGNPLLLDCKNVHLFATPLAASLEEVAPGARHATLSLSIPRVAPEHEGHYVCEVQDRRSHDKHCHKKYLSVQALEAPRLTQNLTDLLVNVSDSLEMQCLVAGAHAPSIVWYKDERLLEEKSGVDLADSNQKLSIQRVREEDAGRYLCSVCNAKGCVNSSASVAVEGSEDKGSMEIVILVGTGVIAVFFWVLLLLIFCNMRRPAHADIKTGYLSIIMDPGEVPLEEQCEYLSYDASQWEFPRERLHLGRVLGYGAFGKVVEASAFGIHKGSSCDTVAVKMLKEGATASEHRALMSELKILIHIGNHLNVVNLLGACTKPQGPLMVIVEFCKYGNLSNFLRAKRDAFSPCAEKSPEQRGRFRAMVELARLDRRRPGSSDRVLFARFSKTEGGARRASPDQEAEDLWLSPLTMEDLVCYSFQVARGMEFLASRKCIHRDLAARNILLSESDVVKICDFGLARDIYKDPDYVRKGSARLPLKWMAPESIFDKVYTTQSDVWSFGVLLWEIFSLGASPYPGVQINEEFCQRLRDGTRMRAPELATPAIRRIMLNCWSGDPKARPAFSELVEILGDLLQGRGLQEEEEVCMAPRSSQSSEEGSFSQVSTMALHIAQADAEDSPPSLQRHSLAARYYNWVSFPGCLARGAETRGSSRMKTFEEFPMTPTTYKGSVDNQTDSGMVLASEEFEQIESRHRQESGFSCKGPGQNVAVTRAHPDSQGRRRRPERGARGGQVFYNSEYGELSEPSEEDHCSPSARVTFFTDNSY

SEQ ID NO: 1590 - protein, 555 aa, unidentified
MARPDDEEGAAVAPGHPLAKGYLPLPRGAPVGKESVELQNGPKAGTFPVNGAPRDSLAAASGVLGGPQTPLAPEEETQARLLPAGAGAETPGAESSPLPLTALSPRRFVVLLIFSLYSLVNAFQWIQYSIISNVFEGFYGVTLLHIDWLSMVYMLAYVPLIFPATWLLDTRGLRLTALLGSGLNCLGAWIKCGSVQQHLFWVTMLGQCLCSVAQVFILGLPSRIASVWFGPKEVSTACATAVLGNQLGTAVGFLLPPVLVPNTQNDTNLLACNISTMFYGTSAVATLLFILTAIAFKEKPRYPPSQAQAALQDSPPEEYSYKKSIRNLFKNIPFVLLLITYGIMTGAFYSVSTLLNQMILTYYEGEEVNAGRIGLTLVVAGMVGSILCGLWLDYTKTYKQTTLIVYILSFIGMVIFTFTLDLRYIIIVFVTGGVLGFFMTGYLPLGFEFAVEITYPESEGTSSGLLNASAQIFGILFTLAQGKLTSDYGPKAGNIFLCVWMFIGIILTALIKSDLRRHNINIGITNVDVKAIPADSPTDQEPKTVMLSKQSESAI

SEQ ID NO: 1591 - protein, 526 aa, unidentified
MVNEGPNQEESDDTPVPESALQADPSVSVHPSVSVHPSVSINPSVSVHPSSSAHPSALAQPSGLAHPSSSGPEDLSVIKVSRRRWAVVLVFSCYSMCNSFQWIQYGSINNIFMHFYGVSAFAIDWLSMCYMLTYIPLLLPVAWLLEKFGLRTIALTGSALNCLGAWVKLGSLKPHLFPVTVVGQLICSVAQVFILGMPSRIASVWFGANEVSTACSVAVFGNQLGIAIGFLVPPVLVPNIEDRDELAYHISIMFYIIGGVATLLLILVIIVFKEKPKYPPSRAQSLSYALTSPDASYLGSIARLFKNLNFVLLVITYGLNAGAFYALSTLLNRMVIWHYPGEEVNAGRIGLTIVIAGMLGAVISGIWLDRSKTYKETTLVVYIMTLVGMVVYTFTLNLGHLWVVFITAGTMGFFMTGYLPLGFEFAVELTYPESEGISSGLLNISAQVFGIIFTISQGQIIDNYGTKPGNIFLCVFLTLGAALTAFIKADLRRQKANKETLENKLQEEEEESNTSKVPTAVSEDHL

SEQ ID NO: 1592 - protein, 1100 aa, unidentified
MGNAAGSAEQPAGPAAPPPKQPAPPKQPMPAAGELEERFNRALNCMNLPPDKVQLLSQYDNEKKWELICDQERFQVKNPPAAYIQKLKSYVDTGGVSRKVAADWMSNLGFKRRVQESTQVLRELETSLRTNHIGWVQEFLNEENRGLDVLLEYLAFAQCSVTYDMESTDNGASNSEKNKPLEQSVEDLSKGPPSSVPKSRHLTIKLTPAHSRKALRNSRIVSQKDDVHVCIMCLRAIMNYQSGFSLVMNHPACVNEIALSLNNKNPRTKALVLELLAAVCLVRGGHDIILAAFDNFKEVCGEQHRFEKLMEYFRNEDSNIDFMVACMQFINIVVHSVENMNFRVFLQYEFTHLGLDLYLERLRLTESDKLQVQIQAYLDNIFDVGALLEDTETKNAVLEHMEELQEQVALLTERLRDAENESMAKIAELEKQLSQARKELETLRERFSESTAMGPSRRPPEPEKAPPAAPTRPSALELKVEELEEKGLIRILRGPGDAVSIEILPVAVATPSGGDAPTPGVPTGSPSPDLAPAAEPAPGAAPPPPPPLPGLPSPQEAPPSAPPQAPPLPGSPEPPPAPPLPGDLPPPPPPPPPPPGTDGPVPPPPPPPPPPPGGPPDALGRRDSELGPGVKAKKPIQTKFRMPLLNWVALKPSQITGTVFTELNDEKVLQELDMSDFEEQFKTKSQGPSLDLSALKSKAAQKAPSKATLIEANRAKNLAITLRKGNLGAERICQAIEAYDLQALGLDFLELLMRFLPTEYERSLITRFEREQRPMEELSEEDRFMLCFSRIPRLPERMTTLTFLGNFPDTAQLLMPQLNAIIAASMSIKSSDKLRQILEIVLAFGNYMNSSKRGAAYGFRLQSLDALLEMKSTDRKQTLLHYLVKVIAEKYPQLTGFHSDLHFLDKAGSVSLDSVLADVRSLQRGLELTQREFVRQDDCMVLKEFLRANSPTMDKLLADSKTAQEAFESVVEYFGENPKTTSPGLFFSLFSRFIKAYKKAEQEVEQWKKEAAAQEAGADTPGKGEPPAPKSPPKARRPQMDLISELKRRQQKEPLIYESDRDGAIEDIITVIKTVPFTARTGKRTSRLLCEASLGEEMPL

SEQ ID NO: 1593 - protein, 532 aa, unidentified
MAKRVAIVGAGVSGLASIKCCLEEGLEPTCFERSDDLGGLWRFTEHVEEGRASLYKSVVSNSCKEMSCYSDFPFPEDYPNYVPNSQFLEYLKMYANHFDLLKHIQFKTKVCSVTKCSDSAVSGQWEVVTMHEEKQESAIFDAVMVCTGFLTNPYLPLDSFPGINAFKGQYFHSRQYKHPDIFKDKRVLVIGMGNSGTDIAVEASHLAEKVFLSTTGGGWVISRIFDSGYPWDMVFMTRFQNMLRNSLPTPIVTWLMERKINNWLNHANYGLIPEDRTQLKEFVLNDELPGRIITGKVFIRPSIKEVKENSVIFNNTSKEEPIDIIVFATGYTFAFPFLDESVVKVEDGQASLYKYIFPAHLQKPTLAIIGLIKPLGSMIPTGETQARWAVRVLKGVNKLPPPSVMIEEINARKENKPSWFGLCYCKALQSDYITYIDELLTYINAKPNLFSMLLTDPHLALTVFFGPCSPYQFRLTGPGKWEGARNAIMTQWDRTFKVIKARVVQESPSPFESFLKVFSFLALLVAIFLIFL

SEQ ID NO: 1594 - protein, 535 aa, unidentified [sequence omitted]

SEQ ID NO: 1595 - protein, 532 aa, unidentified
MGKKVAIIGAGVSGLASIRSCLEEGLEPTCFEKSNDIGGLWKFSDHAEEGRASIYKSVFSNSSKEMMCFPDFPFPDDFPNFMHNSKIQEYIIAFAKEKNLLKYIQFKTFVSSVNKHPDFATTGQWDVTTERDGKKESAVFDAVMVCSGHHVYPNLPKESFPGLNHFKGKCFHSRDYKEPGVFNGKRVLVVGLGNSGCDIATELSRTAEQVMISSRSGSWVMSRVWDNGYPWDMLLVTRFGTFLKNNLPTAISDWLYVKQMNARFKHENYGLMPLNGVLRKEPVFNDELPASILCGIVSVKPNVKEFTETSAIFEDGTIFEGIDCVIFATGYSFAYPFLDESIIKSRNNEIILFKGVFPPLLEKSTIAVIGFVQSLGAAIPTVDLQSRWAAQVIKGTCTLPSMEDMMNDINEKMEKKRKWFGKSETIQTDYIVYMDELSSFIGAKPNIPWLFLTDPKLAMEVYFGPCSPYQFRLVGPGQWPGARNAILTQWDRSLKPMQTRVVGRLQKPCFFFHWLKLFAIPILLIAVFLVLT

SEQ ID NO: 1596 - protein, 558 aa, unidentified
MAKKVAVIGAGVSGLSSIKCCVDEDLEPTCFERSDDIGGLWKFTESSKDGMTRVYKSLVTNVCKEMSCYSDFPFHEDYPNFMNHEKFWDYLQEFAEHFDLLKYIQFKTTVCSITKRPDFSETGQWDVVTETEGKQNRAVFDAVMVCTGHFLNPHLPLEAFPGIHKFKGQILHSQEYKIPEGFQGKRVLVIGLGNTGGDIAVELSRTAAQVLLSTRTGTWVLGRSSDWGYPYNMMVTRRCCSFIAQVLPSRFLNWIQERKLNKRFNHEDYGLSITKGKKAKFIVNDELPNCILCGAITMKTSVIEFTETSAVFEDGTVEENIDVVIFTTGYTFSFPFFEEPLKSLCTKKIFLYKQVFPLNLERATLAIIGLIGLKGSILSGTELQARWVTRVFKGLCKIPPSQKLMMEATEKEQLIKRGVFKDTSKDKFDYIAYMDDIAACIGTKPSIPLLFLKDPRLAWEVFFGPCTPYQYRLMGPGKWDGARNAILTQWDRTLKPLKTRIVPDSSKPASMSHYLKAWGAPVLLASLLLICKSSLFLKLVRDKLQDRMSPYLVSLWRG

SEQ ID NO: 1597 - protein, 533 aa, unidentified
MTKKRIAVIGGGVSGLSSIKCCVEEGLEPVCFERTDDIGGLWRFQENPEEGRASIYKSVIINTSKEMMCFSDYPIPDHYPNFMHNAQVLEYFRMYAKEFDLLKYIRFKTTVCSVKKQPDFATSGQWEVVTESEGKKEMNVFDGVMVCTGHHTNAHLPLESFPGIEKFKGQYFHSRDYKNPEGFTGKRVIIIGIGNSGGDLAVEISQTAKQVFLSTRRGAWILNRVGDYGYPADVLFSSRLTHFIWKICGQSLANKYLEKKINQRFDHEMFGLKPKHRALSQHPTLNDDLPNRIISGLVKVKGNVKEFTETAAIFEDGSREDDIDAVIFATGYSFDFPFLEDSVKVVKNKISLYKKVFPPNLERPTLAIIGLIQPLGAIMPISELQGRWATQVFKGLKTLPSQSEMMAEISKAQEEIDKRYVESQRHTIQGDYIDTMEELADLVGVRPNLLSLAFTDPKLALHLLLGPCTPIHYRVQGPGKWDGARKAILTTDDRIRKPLMTRVVERSSSMTSTMTIGKFMLALAFFAIIIAYF

SEQ ID NO: 1598 - protein, 255 aa, unidentified
MSSHRRKAKGRNRRSHRAMRVAHLELATYELAATESNPESSHPGYEAAMADRPQPGWRESLKMRVSKPFGMLMLSIWILLFVCYYLSYYLCSGSSYFVLANGHILPNSENAHGQSLEEDSALEALLNFFFPTTCNLRENQVAKPCNELQDLSESECLRHKCCFSSSGTTSFKCFAPFRDVPKQMMQMFGLGAISLILVCLPIYCRSLFWRSEPADDLQRQDNRVVTGLKKQRRKRKRKSEMLQKAARGREEHGDE

SEQ ID NO: 1599 - protein, 226 aa, unidentified
MRAPPLLLLLAACAPPPCAAAAPTPPGWEPTPDAPWCPYKVLPEGPEAGGGRLCFRSPARGFRCQAPGCVLHAPAGRSLRASVLRNRSVLLQWRLAPAAARRVRAFALNCSWRGAYTRFPCERVLLGASCRDYLLPDVHDSVLYRLCLQPLPLRAGPAAAAPETPEPAECVEFTAEPAGMQDIVVAMTAVGGSICVMLVVICLLVAYITENLMRPALARPGLRRHP

SEQ ID NO: 1600 - protein, 1198 aa, unidentified
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEKDEETKAFEALLSNIVKPVASDIQARTVVLTWSPPSSLINGETDESSVPELYGYEVLISSTGKDGKYKSVYVGEETNITLNDLKPAMDYHAKVQAEYNSIKGTPSEAEIFTTLSCEPDIPNPPRIANRTKNSLTLQWKAPSDNGSKIQNFVLEWDEGKGNGEFCQCYMGSQKQFKITKLSPAMGCKFRLSARNDYGTSGFSEEVLYYTSGCAPSMPASPVLTKAGITWLSLQWSKPSGTPSDEGISYILEMEEETSGYGFKPKYDGEDLAYTVKNLRRSTKYKFKVIAYNSEGKSNPSEVVEFTTCPDKPGIPVKPSVKGKIHSHSFKITWDPPKDNGGATINKYVVEMAEGSNGNKWEMIYSGATREHLCDRLNPGCFYRLRVYCISDGGQSAVSESLLVQTPAVPPGPCLPPRLQGRPKAKEIQLRWGPPLVDGGSPISCYSVEMSPIEKDEPREVYQGSEVECTVSSLLPGKTYSFRLRAANKMGFGPFSEKCDITTAPGPPDQCKPPQVTCRSATCAQVNWEVPLSNGTDVTEYRLEWGGVEGSMQICYCGPGLSYEIKGLSPATTYYCRVQALSVVGAGPFSEVVACVTPPSVPGIVTCLQEISDDEIENPHYSPSTCLAISWEKPCDHGSEILAYSIDFGDKQSLTVGKVTSYIINNLQPDTTYRIRIQALNSLGAGPFSHMIKLKTKPLPPDPPRLECVAFSHQNLKLKWGEGTPKTLSTDSIQYHLQMEDKNGRFVSLYRGPCHTYKVQRLNESTSYKFCIQACNEAGEGPLSQEYIFTTPKSVPAALKAPKIEKVNDHICEITWECLQPMKGDPVIYSLQVMLGKDSEFKQIYKGPDSSFRYSSLQLNCEYRFRVCAIRQCQDSLGHQDLVGPYSTTVLFISQRTEPPASTNRDTVESTRTRRALSDEQCAAVILVLFAFFSILIAFIIQYFVIK

SEQ ID NO: 1601 - protein, 1204 aa, unidentified
MYVTMMMTDQIPLELPPLLNGEVAMMPHLVNGDAAQQVILVQVNPGETFTIRAEDGTLQCIQGPAEVPMMSPNGSIPPIHVPPGYISQVIEDSTGVRRVVVTPQSPECYPPSYPSAMSPTHHLPPYLTHHPHFIHNSHTAYYPPVTGPGDMPPQFFPQHHLPHTIYGEQEIIPFYGMSTYITREDQYSKPPHKKLKDRQIDRQNRLNSPPSSIYKSSCTTVYNGYGKGHSGGSGGGGSGSGPGIKKTERRARSSPKSNDSDLQEYELEVKRVQDILSGIEKPQVSNIQARAVVLSWAPPVGLSCGPHSGLSFPYSYEVALSDKGRDGKYKIIYSGEELECNLKDLRPATDYHVRVYAMYNSVKGSCSEPVSFTTHSCAPECPFPPKLAHRSKSSLTLQWKAPIDNGSKITNYLLEWDEGKRNSGFRQCFFGSQKHCKLTKLCPAMGYTFRLAARNDIGTSGYSQEVVCYTLGNIPQMPSAPRLVRAGITWVTLQWSKPEGCSPEEVITYTLEIQEDENDNLFHPKYTGEDLTCTVKNLKRSTQYKFRLTASNTEGKSCPSEVLVCTTSPDRPGPPTRPLVKGPVTSHGFSVKWDPPKDNGGSEILKYLLEITDGNSEANQWEVAYSGSATEYTFTHLKPGTLYKLRACCISTGGHSQCSESLPVRTLSIAPGQCRPPRVLGRPKHKEVHLEWDVPASESGCEVSEYSVEMTEPEDVASEVYHGPELECTVGNLLPGTVYRFRVRALNDGGYGPYSDVSEITTAAGPPGQCKAPCISCTPDGCVLVGWESPDSSGADISEYRLEWGEDEESLELIYHGTDTRFEIRDLLPAAQYCCRLQAFNQAGAGPYSELVLCQTPASAPDPVSTLCVLEEEPLDAYPDSPSACLVLNWEEPCNNGSEILAYTIDLGDTSITVGNTTMHVMKDLLPETTYRIRIQAINEIGAGPFSQFIKAKTRPLPPLPPRLECAAAGPQSLKLKWGDSNSKTHAAEDIVYTLQLEDRNKRFISIYRGPSHTYKVQRLTEFTCYSFRIQAASEAGEGPFSETYTFSTTKSVPPTIKAPRVTQLEGNSCEILWETVPSMKGDPVNYILQVLVGRESEYKQVYKGEEATFQISGLQTNTDYRFRVCACRRCLDTSQELSGAFSPSAAFVLQRSEVMLTGDMGSLDDPKMKSMMPTDEQFAAIIVLGFATLSILFAFILQYFLMK

SEQ ID NO: 1602 - protein, 234 aa, unidentified
MPSGCHSSPPSGLRGDMASLVPLSPYLSPTVLLLVSCDLGFVRADRPPSPVNVTVTHLRANSATVSWDVPEGNIVIGYSISQQRQNGPGQRVIREVNTTTRACALWGLAEDSDYTVQVRSIGLRGESPPGPRVHFRTLKGSDRLPSNSSSPGDITVEGLDGERPLQTGEVVIIVVVLLMWAAVIGLFCRQYDIIKDNDSNNNPKEKGKGPEQSPQGRPVGTRQKKSPSINTIDV

SEQ ID NO: 1603 - protein, 212 aa, unidentified
MHPGSPSAWPPRARAALRLWLGCVCFALVQADSPSAPVNVTVRHLKANSAVVSWDVLEDEVVIGFAISQQKKDVRMLRFIQEVNTTTRSCALWDLEEDTEYIVHVQAISIQGQSPASEPVLFKTPREAEKMASKNKDEVTMKEMGRNQQLRTGEVLIIVVVLFMWAGVIALFCRQYDIIKDNEPNNNKEKTKSASETSTPEHQGGGLLRSKI

SEQ ID NO: 1604 - protein, 224 aa, unidentified
MNIEVGNISYTGAIISWSSSEPCLEDYYHIMYRPNWNSIFSGYLRYSFHHEEKVPRTISSVVLEHLAPSTLYFLCISCKKAAFPYRHYCTMFHTLDKSPLAPGSSLVDPQISLWVLMAILLACFTAVLAFICLQFWCVRCHEPRWSYRAGHMEEANGLVRWPEEAPDLGQREEDLQGLPLVEMPRKNSRDGAELDPEANQDAPDAGALQRGGGDPPAILPHCGE

SEQ ID NO: 1605 - protein, 1801 aa, unidentified
MSDDIRKRFEFPNSLIQSQAVGHLIAAVLKENGFSEKIHQSTNQTPALNLLWEKCCSDNVVVRTACCEGLVALVAQDHAEFSYVLNGILNLIPSTRNTHGLIKAIMHLLQMQALKEGQGGEKNIQSIYTIRNHPHPLITVLEHRPDCWPVFLQQLTAFFQQCPERLEVSCIQIMAPFLWYLYCEPSQLQEYAKLRLALLKVLLQPQVLCDKDQPSILEQQILQLCCDIVPCLQVKDLIQTTEAMMFIEEVCLSLLRHPVFWKIQLTQMSLQLLCVSEVSLKITGECSSSIHLLEHSVELLKEDFPVELVIIGIALLLLQTPASQQKPILNLALKLLSVTEDQKIPKSSLLLVMPILQILSSTALEDCISVDEEGPSRQQLALNLLEMIQQECYRDDHQKLSYKLVCPVTSMYGTIFTAWRILEVMTDSSAASDWLASVESLLPITAVIPAPAFLLLAHLLVEDKGQNLHQILKVTTELAQADSSQVPNLIPVLMFKLGRPLEPILYNDILYTLPKLGVHKVCIGQILRIIQLLGTTPRLRAVTLRLLTSLWEKQDRVYPELQRFMAVSDVPSLSVGKEVQWEKLIAKAASIRDICKQRPYQHGADMLAAISQVLNECTKPDQATPAALVLQGLHALCQAEVVCIRSTWNALSPKLSCDTRPLILKTLSELFSLVPSLTVNTTEYENFKVQVLSFLWTHTQNKDPIVANAAYRSLANFTAGEHTILHLPEKIRPEIPIPEELDDDEDVEDVDLSVPGSCYLKLLSLTPPLVLPALEEFFTSLVKQEMVNMPRGIYHSALKGGARSDQGKTVAGIPNFILKMYETNKQPGLKPGLAGGMLFCYDVSMYQSKDGKPLNRLMASRGRSFKQTSLALVHEVHIQLSEWHRAIFLPQAWLAYMNRAYHAILQGRLGELELQLKHGKEEPEEVQYKKSTAWLWVRDMLTDEITKAAAKESPVVKGNALLALSSLAVVVSRHEASLSSDSDGLLEVQPNFLSMKEWVSMVLDTLLVIVDSHYQPRGQLLSWFYYKSYSGENTASAIARSAAATALSLLVPVFIISCKEKVEEILNMLTARLPGKPSADESQAVQIHMGLALGMFLSRLCEEKLSDISGQEMNLLLMKSLDALENCCFDTSLEYNTGCILGVGLVLSLMSHSSQMQSRVHVAALLRKLSAHVDDSGSQSRTFQEVLAYTLSCVCTSAFSAGIIEATEAEDVMNKLRLLVENSQQTSGFALALGNIVHGLSVCGHGKAEDLGSKLLPAWIRIVLTEGTPTMLCLAALHGMVALVGSEGDVMQLKSEAIQTSHFQGRLNEVIRTLTQVISVSGVIGLQSNAVWLLGHLHLSTLSSSQSRASVPTDYSYLPESSFIGAAIGFFITGGKKGPESVPPSLLKVVMKPIATVGESYQYPPVNWAALLSPLMRLNFGEEIQQLCLEIMVTQAQSSQNAAALLGLWVTPPLIHSLSLNTKRYLLISAPLWIKHISDEQILGFVENLMVAVFKAASPLGSPELCPSALHGLSQAMKLPSPAHHLWSLLSEATGKIFDLLPNKIRRKDLELYISIAKCLLEMTDDDANRIAQVTKSNIEKAAFVKLYLVSQGRFPLVNLTDMLSVAVQHREKEVLAWMILHSLYQARIVSHANTGVLKRMEWLLELMGYIRNVAYQSTSFHNTALDKALDFFLLIFATAVVAWADHTAPLLLGLSASWLPWHQENGPAGPVPSFLGRSPMHRVTLQEVLTLLPNSMALLLQKEPWKEQTQKFIDWLFSIMESPKEALSAQSRDLLKATLLSLRVLPEFKKKAVWTRAYGW

SEQ ID NO: 1606 - protein, 750 aa, unidentified
MWNLLHETDSAVATARRPRWLCAGALVLAGGFFLLGFLFGWFIKSSNEATNITPKHNMKAFLDELKAENIKKFLYNFTQIPHLAGTEQNFQLAKQIQSQWKEFGLDSVELAHYDVLLSYPNKTHPNYISIINEDGNEIFNTSLFEPPPPGYENVSDIVPPFSAFSPQGMPEGDLVYVNYARTEDFFKLERDMKINCSGKIVIARYGKVFRGNKVKNAQLAGAKGVILYSDPADYFAPGVKSYPDGWNLPGGGVQRGNILNLNGAGDPLTPGYPANEYAYRRGIAEAVGLPSIPVHPIGYYDAQKLLEKMGGSAPPDSSWRGSLKVPYNVGPGFTGNFSTQKVKMHIHSTNEVTRIYNVIGTLRGAVEPDRYVILGGHRDSWVFGGIDPQSGAAVVHEIVRSFGTLKKEGWRPRRTILFASWDAEEFGLLGSTEWAEENSRLLQERGVAYINADSSIEGNYTLRVDCTPLMYSLVHNLTKELKSPDEGFEGKSLYESWTKKSPSPEFSGMPRISKLGSGNDFEVFFQRLGIASGRARYTKNWETNKFSGYPLYHSVYETYELVEKFYDPMFKYHLTVAQVRGGMVFELANSIVLPFDCRDYAVVLRKYADKIYSISMKHPQEMKTYSVSFDSLFSAVKNFTEIASKFSERLQDFDKSNPIVLRMMNDQLMFLERAFIDPLGLPDRPFYRHVIYAPSSHNKYAGESFPGIYDALFDIESKVDPSKAWGEVKRQIYVAAFTVQAAAETLSEVA

SEQ ID NO: 1607 - protein, 257 aa, unidentified
MAQRMTTQLLLLLVWVAVVGEAQTRIAWARTELLNVCMNAKHHKEKPGPEDKLHEQCRPWRKNACCSTNTSQEAHKDVSYLYRFNWNHCGEMAPACKRHFIQDTCLYECSPNLGPWIQQVDQSWRKERVLNVPLCKEDCEQWWEDCRTSYTCKSNWHKGWNWTSGFNKCAVGAACQPFHFYFPTPTVLCNEIWTHSYKVSNYSRGSGRCIQMWFDPAQGNPNEEVARFYAAAMSGAGPWAAWPFLLSLALMLLWLLS

SEQ ID NO: 1608 - protein, 255 aa, unidentified
MVWKWMPLLLLLVCVATMCSAQDRTDLLNVCMDAKHHKTKPGPEDKLHDQCSPWKKNACCTASTSQELHKDTSRLYNFNWDHCGKMEPACKRHFIQDTCLYECSPNLGPWIQQVNQSWRKERFLDVPLCKEDCQRWWEDCHTSHTCKSNWHRGWDWTSGVNKCPAGALCRTFESYFPTPAALCEGLWSHSYKVSNYSRGSGRCIQMWFDSAQGNPNEEVARFYAAAMHVNAGEMLHGTGGLLLSLALMLQLWLLG

SEQ ID NO: 1609 - protein, 350 aa, unidentified
METNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPLRVLSFVAAAFFLCWSPYQVVALIATVRIRELLQGMYKEIGIAVDVTSALAFFNSCLNPMLYVFMGQDFRERLIHALPASLERALTEDSTQTSDTATNSTLPSAEVELQAK

SEQ ID NO: 1610 - protein, 351 aa, unidentified
METNFSTPLNEYEEVSYESAGYTVLRILPLVVLGVTFVLGVLGNGLVIWVAGFRMTRTVTTICYLNLALADFSFTATLPFLIVSMAMGEKWPFGWFLCKLIHIVVDINLFGSVFLIGFIALDRCICVLHPVWAQNHRTVSLAMKVIVGPWILALVLTLPVFLFLTTVTIPNGDTYCTFNFASWGGTPEERLKVAITMLTARGIIRFVIGFSLPMSIVAICYGLIAAKIHKKGMIKSSRPLRVLTAVVASFFICWFPFQLVALLGTVWLKEMLFYGKYKIIDILVNPTSSLAFFNSCLNPMLYVFVGQDFRERLIHSLPTSLERALSEDSAPTNDTAANSASPPAETELQAM

SEQ ID NO: 1611 - protein, 353 aa, unidentified
METNFSIPLNETEEVLPEPAGHTVLWIFSLLVHGVTFVFGVLGNGLVIWVAGFRMTRTVNTICYLNLALADFSFSAILPFRMVSVAMREKWPFGSFLCKLVHVMIDINLFVSVYLITIIALDRCICVLHPAWAQNHRTMSLAKRVMTGLWIFTIVLTLPNFIFWTTISTTNGDTYCIFNFAFWGDTAVERLNVFITMAKVFLILHFIIGFSVPMSIITVCYGIIAAKIHRNHMIKSSRPLRVFAAVVASFFICWFPYELIGILMAVWLKEMLLNGKYKIILVLINPTSSLAFFNSCLNPILYVFMGRNFQERLIRSLPTSLERALTEVPDSAQTSNTDTTSASPPEETELQAM

SEQ ID NO: 1612 - protein, 4008 aa, unidentified
MGVLKVWLGLALALAEFAVLPHHSEGACVYQDSLLADATIWKPDSCQSCRCHGDIVICKPAVCRNPQCAFEKGEVLQIAANQCCPECVLRTPGSCHHEKKIHEHGTEWASSPCSVCSCNHGEVRCTPQPCPPLSCGHQELAFIPEGSCCPVCVGLGKPCSYEGHVFQDGEDWRLSRCAKCLCRNGVAQCFTAQCQPLFCNQDETVVRVPGKCCPQCSARSCSAAGQVYEHGEQWSENACTTCICDRGEVRCHKQACLPLRCGKGQSRARRHGQCCEECVSPAGSCSYDGVVRYQDEMWKGSACEFCMCDHGQVTCQTGECAKVECARDEELIHLDGKCCPECISRNGYCVYEETGEFMSSNASEVKRIPEGEKWEDGPCKVCECRGAQVTCYEPSCPPCPVGTLALEVKGQCCPDCTSVHCHPDCLTCSQSPDHCDLCQDPTKLLQNGWCVHSCGLGFYQAGSLCLACQPQCSTCTSGLECSSCQPPLLMRHGQCVPTCGDGFYQDRHSCAVCHESCAGCWGPTEKHCLACRDPLHVLRDGGCESSCGKGFYNRQGTCSACDQSCDSCGPSSPRCLTCTEKTVLHDGKCMSECPGGYYADATGRCKVCHNSCASCSGPTPSHCTACSPPKALRQGHCLPRCGEGFYSDHGVCKACHSSCLACMGPAPSHCTGCKKPEEGLQVEQLSDVGIPSGECLAQCRAHFYLESTGICEACHQSCFRCAGKSPHNCTDCGPSHVLLDGQCLSQCPDGYFHQEGSCTECHPTCRQCHGPLESDCISCYPHISLTNGNCRTSCREEQFLNLVGYCADCHHLCQHCAADLHNTGSICLRCQNAHYLLLGDHCVPDCPSGYYAERGACKKCHSSCRTCQGRGPFSCSSCDTNLVLSHTGTCSTTCFPGHYLDDNHVCQPCNTHCGSCDSQASCTSCRDPNKVLLFGECQYESCAPQYYLDFSTNTCKECDWSCSACSGPLKTDCLQCMDGYVLQDGACVEQCLSSFYQDSGLCKNCDSYCLQCQGPHECTRCKGPFLLLEAQCVQECGKGYFADHAKHKCTACPQGCLQCSHRDRCHLCDHGFFLKSGLCVYNCVPGFSVHTSNETCSGKIHTPSLHVNGSLILPIGSIKPLDFSLLNVQDQEGRVEDLLFHVVSTPTNGQLVLSRNGKEVQLDKAGRFSWKDVNEKKVRFVHSKEKLRKGYLFLKISDQQFFSEPQLINIQAFSTQAPYVLRNEVLHISRGERATITTQMLDIRDDDNPQDVVIEIIDPPLHGQLLQTLQSPATPIYQFQLDELSRGLLHYAHDGSDSTSDVAVLQANDGHSFHNILFQVKTVPQNDRGLQLVANSMVWVPEGGMLQITNRILQAEAPGASAEEIIYKITQDYPQFGEVVLLVNMPADSPADEGQHLPDGRTATPTSTFTQQDINEGIVWYRHSGAPAQSDSFRFEVSSASNAQTRLESHMFNIAILPQTPEAPKVSLEASLHMTAREDGLTVIQPHSLSFINSEKPSGKIVYNITLPLHPNQGIIEHRDHPHSPIRYFTQEDINQGKVMYRPPPAAPHLQELMAFSFAGLPESVKFHFTVSDGEHTSPEMVLTIHLLPSDQQLPVFQVTAPRLAVSPGGSTSVGLQVVVRDAETAPKELFFELRRPPQHGVLLKHTAEFRRPMATGDTFTYEDVEKNALQYIHDGSSTREDSMEISVTDGLTVTMLEVRVEVSLSEDRGPRLAAGSSLSITVASKSTAIITRSHLAYVDDSSPDPEIWIQLNYLPSYGTLLRISGSEVEELSEVSNFTMEDINNKKIRYSAVFETDGHLVTDSFYFSVSDMDHNHLDNQIFTIMITPAENPPPVIAFADLITVDEGGRAPLSFHHFFATDDDDNLQRDAIIKLSALPKYGCIENTGTGDRFGPETASDLEASFPIQDVLENYIYYFQSVHESIEPTHDIFSFYVSDGTSRSEIHSINITIERKNDEPPRMTLQPLRVQLSSGVVISNSSLSLQDLDTPDNELIFVLTKKPDHGHVLWRQTASEPLENGRVLVQGSTFTYQDILAGLVGYVPSVPGMVVDEFQFSLTDGLHVDTGRMKIYTELPASDTPHLAINQGLQLSAGSVARITEQHLKVTDIDSDDHQVMYIMKEDPGAGRLQMMKHGNLEQISIKGPIRSFTQADISQGQPEYSHGTGEPGGSFAFKFDVVDGEGNRLIDKSFSISISEDKSPPVITTNKGLVLDENSVKKITTLQLSATDQDSGPTELIYRITRQPQLGHLEHAASPGIQISSFTQADLTSRNVQYVHSSEAEKHSDAFSFTLSDGVSEVTQTFHITLHPVDDSLPVVQNLGMRVQEGMRKTITEFELKAVDADTEAESVTFTIVQPPRHGTIERTSNGQHFHLTSTFTMKDIYQNRVSYSHDGSNSLKDRFTFTVSDGTNPFFIIEEGGKEIMTAAPQPFRVDILPVDDGTPRIVTNLGLQWLEYMDGKATNLITKKELLTMDPDTEDAQLVYEITTGPKHGFVENKLQPGRAAATFTQEDVNLGLIRYVLHKEKIREMMDSFQFLVKDSKPNVVSDNVFHIQWSLISFKYTSYNVSEKAGSVSVTVQRTGNLNQYAIVLCRTEQGTASSSSQPGQQDYVEYAGQVQFDEREDTKSCTIVINDDDVFENVESFTVELSMPAYALLGEFTQAKVIINDTEDEPTLEFDKKIYWVNESAGFLFAPIERKGDASSIVSAICYTVPKSAMGSLFYALESGSDFKSRGMSAASRVIFGPGVTMSTCDVMLIDDSEYEEEEEFEIALADASDNARIGRVATAKVLISGPNDASTVSLGNTAFTVSEDAGTVKIPVIRHGTDLSTFASVWCATRPSDPASATPGVDYVPSSRKVEFGPGVIEQYCTLTILDDTQYPVIEGLETFVVFLSSAQGAELTKPFQAVIAINDTFQDVPSMQFAKDLLLVKEKEGVLHVPITRSGDLSYESSVRCYTQSHSAQVMEDFEERQNADSSRITFLKGDKVKNCTVYIHDDSMFEPEEQFRVYLGLPLGNHWSGARIGKNNMATITISNDEDAPTIEFEEAAYQVREPAGPDAIAILNIKVIRRGDQNRTSKVRCSTRDGSAQSGVDYYPKSRVLKFSPGVDHIFFKVEILSNEDREWHESFSLVLGPDDPVEAVLGDVTTATVTILDQEAAGSLILPAPPIVVTLADYDHVEEVTKEGVKKSPSPGYPLVCVTPCDPHFPRYAVMKERCSEAGINQTSVQFSWEVAAPTDGNGARSPFETITDNTPFTSVNHMVLDSIYFSRRFHVRCVAKAVDKVGHVGTPLRSNIVTIGTDSAICHTPVVAGTSRGFQAQSFIATLKYLDVKHKEHPNRIHISVQIPHQDGMLPLISTMPLHNLHFLLSESIYRHQHVCSNLVTTYDLRGLAEAGFLDDVVYDSTALGPGYDRPFQFDPSVREPKTIQLYKHLNLKSCVWTFDAYYDMTELIDVCGGSVTADFQVRDSAQSFLTVHVPLYVSYIYVTAPRGWASLEHHTEMEFSFFYDTVLWRTGIQTDSVLSARLQIIRIYIREDGRLVIEFKTHAKFRGQFVMEHHTLPEVKSFVLTPDHLGGIEFDLQLLWSAQTFDSPHQLWRATSSYNRKDYSGEYTIYLIPCTVQPTQPWVDPGEKPLACTAHAPERFLIPIAFQQTNRPVPVVYSLNTEFQLCNNEKVFLMDPNTSDMSLAEMDYKGAFSKGQILYGRVLWNPEQNLNSAYKLQLEKVYLCTGKDGYVPFFDPTGTIYNEGPQYGCIQPNKHLKHRFLLLDRNQPEVTDKYFHDVPFEAHFASELPDFHVVSNMPGVDGFTLKVDALYKVEAGHQWYLQVIYIIGPDTISGPRVQRSLTAPLRRNRRDLVEPDGQLILDDSLIYDNEGDQVKNGTNMKSLNLEMQELAVAASLSQTGASIGSALAAIMLLLLVFLVACFINRKCQKQRKKKPAEDILEEYPLNTKVEVPKRHPDRVEKNVNRHYCTVRNVNILSEPEAAYTFKGAKVKRLNLEVRVHNNLQDGTEV

SEQ ID NO: 1613 - protein, 3169 aa, unidentified
MHSAGTPGLSSRRTGNSTSFQPGPPPPPRLLLLLLLLLSLVSRVPAQPAAFGRALLSPGLAGAAGVPAEEAIVLANRGLRVPFGREVWLDPLHDLVLQVQPGDRCAVSVLDNDALAQRPGRLSPKRFPCDFGPGEVRYSHLGARSPSRDRVRLQLRYDAPGGAVVLPLVLEVEVVFTQLEVVTRNLPLVVEELLGTSNALDARSLEFAFQPETEECRVGILSGLGALPRYGELLHYPQVPGGAREGGAPETLLMDCKAFQELGVRYRHTAASRSPNRDWIPMVVELRSRGAPVGSPALKREHFQVLVRIRGGAENTAPKPSFVAMMMMEVDQFVLTALTPDMLAAEDAESPSDLLIFNLTSPFQPGQGYLVSTDDRSLPLSSFTQRDLRLLKIAYQPPSEDSDQERLFELELEVVDLEGAASDPFAFMVVVKPMNTMAPVVTRNTGLILYEGQSRPLTGPAGSGPQNLVISDEDDLEAVRLEVVAGLRHGHLVILGASSGSSAPKSFTVAELAAGQVVYQHDDRDGSLSDNLVLRMVDGGGRHQVQFLFPITLVPVDDQPPVLNANTGLTLAEGETVPILPLSLSATDMDSDDSLLLFVLESPFLTTGHLLLRQTHPPHEKQELLRGLWRKEGAFYERTVTEWQQQDITEGRLFYRHSGPHSPGPVTDQFTFRVQDNHDPPNQSGLQRFVIRIHPVDRLPPELGSGCPLRMVVQESQLTPLRKKWLRYTDLDTDDRELRYTVTQSPTDTDENHLPAPLGTLVLTDNPSVVVTHFTQAQINHHKIAYRPPGQELGVATRVAQFQFQVEDRAGNVAPGTFTLYLHPVDNQPPEILNTGFTIQEKGHHILSETELHVNDVDTDVAHISFTLTQAPKHGHMRVSGQILHVGGLFHLEDIKQGRVSYAHNGDKSLTDSCSLEVSDRHHVVPITLRVNVRPVDDEVPILSHPTGTLESYLDVLENGATEITANVIKGTNEETDDLMLTFLLEDPPLYGEILVNGIPAEQFTQRDILEGSVVYTHTSGEIGLLPKADSFNLSLSDMSQEWRIGGNTIQGVTIWVTILPVDSQAPEIFVGEQLIVMEGDKSVITSVHISAEDVDSLNDDILCTIVIQPTSGYVENISPAPGSEKSRAGIAISAFNLKDLRQGHINYVQSVHKGVEPVEDRFVFRCSDGINFSERQFFPIVIIPTNDEQPEMFMREFMVMEGMSLVIDTPILNAADADVPLDDLTFTITQFPTHGHIMNQLINGTVLVESFTLDQIIESSSIIYEHDDSETQEDSFVIKLTDGKHSVEKTVLIIVIPVDDETPRMTINNGLEIEIGDTKIINNKILMATDLDSEDKSLVYIIRYGPGHGLLQRRKPTGAFENITLGMNFTQDEVDRNLIQYVHLGQEGIRDLIKFDVTDGINPLIDRYFYVSIGSIDIVFPDVISKGVSLKEGGKVTLTTDLLSTSDLNSPDENLVFTITRAPMRGHLECTDQPGVSITSFTQLQLAGNKIYYIHTADDEVKMDSFEFQVTDGRNPVFRTFRISISDVDNKKPVVTIHKLVVSESENKLITPFELTVEDRDTPDKLLKFTITQVPIHGHLLFNNTRPVMVFTKQDLNENLISYKHDGTESSEDSFSFTVTDGTHTDFYVFPDTVFETRRPQVMKIQVLAVDNSVPQIAVNKGASTLRTLATGHLGFMITSKILKVEDRDSLHISLRFIVTEAPQHGYLLNLDKGNHSITQFTQADIDDMKICYVLREGANATSDMFYFAVEDGGGNKLTYQNFRLNWAWISFEKEYYLVNEDSKFLDVVLKRRGYLGETSFISIGTRDRTAEKDKDFKGKAQKQVQFNPGQTRATWRVRILSDGEHEQSETFQVVLSEPVLAALEFPTVATVEIVDPGDEPTVFIPQSKYSVEEDVGELFIPIRRSGDVSQELMVVCYTQQGTATGTVPTSVLSYSDYISRPEDHTSVVRFDKDEREKLCRIVIIDDSLYEEEETFHVLLSMPMGGRIGSEFPGAQVTIVPDKDDEPIFYFGDVEYSVDESAGYVEVQVWRTGTDLSKSSSVTVRSRKTDPPSADAGTDYVGISRNLDFAPGVNMQPVRVVILDDLGQPALEGIEKFELVLRMPMNAALGEPSKATVSINDSVSDLPKMQFKERIYTGSESDGQIVTMIHRTGDVQYRSSVRCYTRQGSAQVMMDFEERPNTDTSIITFLPGETEKPCILELMDDVLYEEVEELRLVLGTPQSNSPFGAAVGEQNETLIRIRDDADKTVIKFGETKFSVTEPKEPGESVVIRIPVIRQGDTSKVSIVRVHTKDGSATSGEDYHPVSEEIEFKEGETQHVVEIEVTFDGVREMREAFTVHLKPDENMIAEMQLTKAIVYIEEMSSMADVTFPSVPQIVSLLMYDDTSKAKESAEPMSGYPVICITACNPKYSDYDKTGSICASENINDTLTRYRWLISAPAGPDGVTSPMREVDFDTFFTSSKMVTLDSIYFQPGSRVQCAARAVNTNGDEGLELMSPIVTISREEGLCQPRVPGVVGAEPFSAKLRYTGPEDADYTNLIKLTVTMPHIDGMLPVISTRELSNFELTLSPDGTRVGNHKCSNLLDYTEVKTHYGFLTDATKNPEIIGETYPYQYSLSIRGSTTLRFYRNLNLEACLWEFVSYYDMSELLADCGGTIGTDGQVLNLVQSYVTLRVPLYVSYVFHSPVGVGGWQHFDLKSELRLTFVYDTAILWNDGIGSPPEAELQGSLYPTSMRIGDEGRLAVHFKTEAQFHGLFVLSHPASFTSSVIMSADHPGLTFSLRLIRSEPTYNQPVQQWSFVSDFAVRDYSGTYTVKLVPCTAPSHQEYRLPVTCNPREPVTFDLDIRFQQVSDPVAAEFSLNTQMYLLSKKSLWLSDGSMGFGQESDVAFAEGDIIYGRVMVDPVQNLGDSFYCSIEKVFLCTGADGYVPKYSPMNAEYGCLADSPSLLYRFKIVDKAQPETQATSFGNVLFNAKLAVDDPEAILLVNQPGSDGFKVDSTPLFQVALGREWYIHTIYTVRSKDNANRGIGKRSVEYHSLVSQGKPQSTTKSRKKREIRSTPSLAWEIGAENSRGTNIQHIALDRTKRQIPHGRAPPDGILPWELNSPSSAVSLVTVVGGTTVGLLTICLTVIAVLMCRGKESFRGKDAPKGSSSSEPMVPPQSHHNDSSEV

SEQ ID NO: 1614 - protein, 597 aa, unidentified
MFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHLIKWPDVCKLKFEGKTFYVIGTQKEKKAMLAFHTSTPAACKHLWKCGVENQAFYKYAKSSQIKTVSSSKIFFKGSRFRYSGKVAKEVVEASSKIQREPPEVHRANITQSRSSHSLNKQLIINMEPLQPLLPSPSEQEEELPLGEGVPLPKEENISAPLISSSPVKAAREYEDPPSEEEDKIKEEPLTISELVYNPSASLLPTPVDDDEIDMLFDCPSRLELEREDTDSFEDLEADENAFLIAEEEELKEARRALSWSYDILTGHIRVNPLVKSFSRLLVVGLGLLLFVFPLLLLLLESGIDLSFLCEIRQTPEFEQFHYEYYCPLKEWVAGKVHLILYMLGCS

SEQ ID NO: 1615 - protein, 414 aa, unidentified
MCFRVKFYPADPAALKEEITRYLVFLQIKRDLYHGRLLCKTSDAALLAAYILQAEIGDYDSGKHPEGYSSKFQFFPKHSEKLERKIAEIHKTELSGQTPATSELNFLRKAQTLETYGVDPHPCKDVSGNAAFLAFTPFGFVVLQGNKRVHFIKWNEVTKLKFEGKTFYLYEKKIILTYFAPTPEACKHLWKCGIENQAFYKLEKSSQVRTVSSSNLFFKGSRFRYSGRVAKEVMESSAKIKREPPEIHRAGMVPSRSCPSITHGPRLSSVPRTRRRAVHISIMEGLESLRDSAHSTPVRSTSHGDTFLPHVRSSRTDSNERVAVIADEAYSPADSVLPTPVAEHSLELMLLSRQINGATCSIEEEKESEASTPTATEVEALGGELRALCQGHSGPEEEQAMVCLQNPLSGEPAH

SEQ ID NO: 1616 - protein, 592 aa, unidentified
MAVSGFTLGTCILLLHISYVANYPNGKVTQSCHGMIPEHGHSPQSVPVHDIYVSQMTFRPGDQIEVTLSGHPFKGFLLEARNAEDLNGPPIGSFTLIDSEVSQLLTCEDIQGSAVSHRSASKKTEIKVYWNAPSSAPNHTQFLVTVVEKYKIYWVKIPGPIISQPNAFPFTTPKATVVPLPTLPPVSHLTKPFSASDCGNKKFCIRSPLNCDPEKEASCVFLSFTRDDQSVMVEMSGPSKGYLSFALSHDQWMGDDDAYLCIHEDQTVYIQPSHLTGRSHPVMDSRDTLEDMAWRLADGVMQCSFRRNITLPGVKNRFDLNTSYYIFLADGAANDGRIYKHSQQPLITYEKYDVTDSPKNIGGSHSVLLLKVHGALMFVAWMTTVSIGVLVARFFKPVWSKAFLLGEAAWFQVHRMLMFTTTVLTCIAFVMPFIYRGGWSRHAGYHPYLGCIVMTLAVLQPLLAVFRPPLHDPRRQMFNWTHWSMGTAARIIAVAAMFLGMDLPGLNLPDSWKTYAMTGFVAWHVGTEVVLEVHAYRLSRKVEILDDDRIQILQSFTAVETEGHAFKKAVLAIYVCGNVTFLIIFLSAINHL

SEQ ID NO: 1617 - protein, 344 aa, unidentified
MRRPRQGGGGAGGSAAARARAGGLGGGSVPARARGAPAAARAAWLRDLCARMARPPRQHPGVWASLLLLLLTGPAACAASPADDGAGPGGRGPRGRARGDTGADEAVPRHDSSYGTFAGEFYDLRYLSEEGYPFPTAPPVDPFAKIKVDDCGKTKGCFRYGKPGCNAETCDYFLSYRMIGADVEFELSADTDGWVAVGFSSDKKMGGDDVMACVHDDNGRVRIQHFYNVGQWAKEIQRNPARDEEGVFENNRVTCRFKRPVNVPRDETIVDLHLSWYYLFAWGPAIQGSITRHDIDSPPASERVVSIYKYEDIFMPSAAYQTFSSPFCLLLIVALTFYLLMGTP

SEQ ID NO: 1618 - protein, 530 aa, unidentified
MDSQKYCFKENENVTVDKACFLISNITIGPESINLQQEALQRIISTLANKNDEIQNFIDTLHHTLKGVQENSSNILSELDEEFDSLYSILDEVKESMINCIKQEQARKSQELQSQISQCNNALENSEELLEFATRSLDIKEPEEFSKAARQIKDRVTMASAFRLSLKPKVSDNMTHLMVDFSQERQMLQTLKFLPVPKAPEIDPVECLVADNSVTVAWRMPEEDNKIDHFILEHRKTNFDGLPRVKDERCWEIIDNIKGTEYTLSGLKFDSKYMNFRVRACNKAVAGEYSDPVTLETKALNFNLDNSSSHLNLKVEDTCVEWDPTGGKGQESKIKGKENKGRSGTPSPKRTSVGSRPPAVRGSRDRFTGESYTVLGDTAIESGQHYWEVKAQKDCKSYSVGVAYKTLGKFDQLGKTNTSWCIHVNNWLQNTFAAKHNNKVKALDVTVPEKIGVFCDFDGGQLSFYDANSKQLLYSFKTKFTQPVLPGFMVWCGGLSLSTGMQVPSAVRTLQKSENGMTGSASSLNNVVTQ

SEQ ID NO: 1619 - protein, 695 aa, unidentified
MALLLVSLLAFLSLGSGCHHRICHCSNRVFLCQESKVTEIPSDLPRNAIELRFVLTKLRVIQKGAFSGFGDLEKIEISQNDVLEVIEADVFSNLPKLHEIRIEKANNLLYINPEAFQNLPNLQYLLISNTGIKHLPDVHKIHSLQKVLLDIQDNINIHTIERNSFVGLSFESVILWLNKNGIQEIHNCAFNGTQLDELNLSDNNNLEELPNDVFHGASGPVILDISRTRIHSLPSYGLENLKKLRARSTYNLKKLPTLEKLVALMEASLTYPSHCCAFANWRRQISELHPICNKSILRQEVDYMTQARGQRSSLAEDNESSYSRGFDMTYTEFDYDLCNEVVDVTCSPKPDAFNPCEDIMGYNILRVLIWFISILAITGNIIVLVILTTSQYKLTVPRFLMCNLAFADLCIGIYLLLIASVDIHTKSQYHNYAIDWQTGAGCDAAGFFTVFASELSVYTLTAITLERWHTITHAMQLDCKVQLRHAASVMVMGWIFAFAAALFPIFGISSYMKVSICLPMDIDSPLSQLYVMSLLVLNVLAFVVICGCYIHIYLTVRNPNIVSSSSDTRIAKRMAMLIFTDFLCMAPISFFAISASLKVPLITVSKAKILLVLFHPINSCANPFLYAIFTKNFRRDFFILLSKCGCYEMQAQIYRTETSSTVHNTHPRNGHCSSAPRVTNGSTYILVPLSHLAQN

SEQ ID NO: 1620 - protein, 794 aa, unidentified
MELRPWLLWVVAATGTLVLLAADAQGQKVFTNTWAVRIPGGPAVANSVARKHGFLNLGQIFGDYYHFWHRGVTKRSLSPHRPRHSRLQREPQVQWLEQQVAKRRTKRDVYQEPTDPKFPQQWYLSGVTQRDLNVKAAWAQGYTGHGIVVSILDDGIEKNHPDLAGNYDPGASFDVNDQDPDPQPRYTQMNDNRHGTRCAGEVAAVANNGVCGVGVAYNARIGGVRMLDGEVTDAVEARSLGLNPNHIHIYSASWGPEDDGKTVDGPARLAEEAFFRGVSQGRGGLGSIFVWASGNGGREHDSCNCDGYTNSIYTLSISSATQFGNVPWYSEACSSTLATTYSSGNQNEKQIVTTDLRQKCTESHTGTSASAPLAAGIIALTLEANKNLTWRDMQHLVVQTSKPAHLNANDWATNGVGRKVSHSYGYGLLDAGAMVALAQNWTTVAPQRKCIIDILTEPKDIGKRLEVRKTVTACLGEPNHITRLEHAQARLTLSYNRRGDLAIHLVSPMGTRSTLLAARPHDYSADGFNDWAFMTTHSWDEDPSGEWVLEIENTSEANNYGTLTKFTLVLYGTAPEGLPVPPESSGCKTLTSSQACVVCEEGFSLHQKSCVQHCPPGFAPQVLDTHYSTENDVETIRASVCAPCHASCATCQGPALTDCLSCPSHASLDPVEQTCSRQSQSSRESPPQQQPPRLPPEVEAGQRLRAGLLPSHLPEVVAGLSCAFIVLVFVTVFLVLQLRSGFSFRGVKVYTMDRGLISYKGLPPEAWQEECPSDSEEDEGRGERTAFIKDQSAL

SEQ ID NO: 1621 - protein, 365 aa, unidentified
MWLRSHRQLCLAFLLVCVLSVIFFLHIHQDSFPHGLGLSILCPDRRLVTPPVAIFCLPGTAMGPNASSSCPQHPASLSGTWTVYPNGRFGNQMGQYATLLALAQLNGRRAFILPAMHAALAPVFRITLPVLAPEVDSRTPWRELQLHDWMSEEYADLRDPFLKLSGFPCSWTFFHHLREQIRREFTLHDHLREEAQSVLGQLRLGRTGDRPRTFVGVHVRRGDYLQVMPQRWKGVVGDSAYLRQAMDWFRARHEAPVFVVTSNGMEWCKENIDTSQGDVTFAGDGQEATPWKDFALLTQCNHTIMTIGTFGFWAAYLAGGDTVYLANFTLPDSEFLKIFKPEAAFLPEWVGINADLSPLWTLAKP

SEQ ID NO: 1622 - protein, 343 aa, unidentified
MLVVQMPFSFPMAHFILFVFTVSTIFHVQQRLAKIQAMWELPVQIPVLASTSKALGPSQLRGMWTINAIGRLGNQMGEYATLYALAKMNGRPAFIPAQMHSTLAPIFRITLPVLHSATASRIPWQNYHLNDWMEEEYRHIPGEYVRFTGYPCSWTFYHHLRQEILQEFTLHDHVREEAQKFLRGLQVNGSRPGTFVGVHVRRGDYVHVMPKVWKGVVADRRYLQQALDWFRARYSSLIFVVTSNGMAWCRENIDTSHGDVVFAGDGIEGSPAKDFALLTQCNHTIMTIGTFGIWAAYLTGGDTIYLANYTLPDSPFLKIFKPEAAFLPEWTGIAADLSPLLKH

SEQ ID NO: 1623 - protein, 361 aa, unidentified
MDPLGAAKPQWPWRRCLAALLFQLLVAVCFFSYLRVSRDDATGSPRAPSGSSRQDTTPTRPTLLILLWTWPFHIPVALSRCSEMVPGTADCHITADRKVYPQADTVIVHHWDIMSNPKSRLPPSPRPQGQRWIWFNLEPPPNCQHLEALDRYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALDFCKACWKLQQESRYQTVRSIAAWFT

SEQ ID NO: 1624 - protein, 530 aa, unidentified
MRRLWGAARKPSGAGWEKEWAEAPQEAPGAWSGRLGPGRSGRKGRAVPGWASWPAHLALAARPARHLGGAGQGPRPLHSGTAPFHSRASGERQRRLEPQLQHESRCRSSTPADAWRAEAALPVRAMGAPWGSPTAAAGGRRGWRRGRGLPWTVCVLAAAGLTCTALITYACWGQLPPLPWASPTPSRPVGVLLWWEPFGGRDSAPRPPPDCRLRFNISGCRLLTDRASYGEAQAVLFHHRDLVKGPPDWPPPWGIQAHTAEEVDLRVLDYEEAAAAAEALATSSPRPPGQRWVWMNFESPSHSPGLRSLASNLFNWTLSYRADSDVFVPYGYLYPRSHPGDPPSGLAPPLSRKQGLVAWVVSHWDERQARVRYYHQLSQHVTVDVFGRGGPGQPVPEIGLLHTVARYKFYLAFENSQHLDYITEKLWRNALLAGAVPVVLGPDRANYERFVPRGAFIHVDDFPSASSLASYLLFLDRNPAVYRRYFHWRRSYAVHITSFWDEPWCRVCQAVQRAGDRPKSIRNLASWFER

SEQ ID NO: 1625 - protein, 374 aa, unidentified
MDPLGPAKPQWLWRRCLAGLLFQLLVAVCFFSYLRVSRDDATGSPRPGLMAVEPVTGAPNGSRCQDSMATPAHPTLLILLWTWPFNTPVALPRCSEMVPGAADCNITADSSVYPQADAVIVHHWDIMYNPSANLPPPTRPQGQRWIWFSMESPSNCRHLEALDGYFNLTMSYRSDSDIFTPYGWLEPWSGQPAHPPLNLSAKTELVAWAVSNWKPDSARVRYYQSLQAHLKVDVYGRSHKPLPKGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQQESRYQTVRSIAAWFT

SEQ ID NO: 1626 - protein, 359 aa, unidentified
MDPLGPAKPQWSWRCCLTTLLFQLLMAVCFFSYLRVSQDDPTVYPNGSRFPDSTGTPAHSIPLILLWTWPFNKPIALPRCSEMVPGTADCNITADRKVYPQADAVIVHHREVMYNPSAQLPRSPRRQGQRWIWFSMESPSHCWQLKAMDGYFNLTMSYRSDSDIFTPYGWLEPWSGQPAHPPLNLSAKTELVAWAVSNWGPNSARVRYYQSLQAHLKVDVYGRSHKPLPQGTMMETLSRYKFYLAFENSLHPDYITEKLWRNALEAWAVPVVLGPSRSNYERFLPPDAFIHVDDFQSPKDLARYLQELDKDHARYLSYFRWRETLRPRSFSWALAFCKACWKLQEESRYQTRGIAAWFT

SEQ ID NO: 1627 - protein, 575 aa, unidentified
MRPWTGSWRWIMLILFAWGTLLFYIGGHLVRDNDHPDHSSRELSKILAKLERLKQQNEDLRRMAESLRIPEGPIDQGPAIGRVRVLEEQLVKAKEQIENYKKQTRNGLGKDHEILRRRIENGAKELWFFLQSELKKLKNLEGNELQRHADEFLLDLGHHERSIMTDLYYLSQTDGAGDWREKEAKDLTELVQRRITYLQNPKDCSKAKKLVCNINKGCGYGCQLHHVVYCFMIAYGTQRTLILESQNWRYATGGWETVFRPVSETCTDRSGISTGHWSGEVKDKNVQVVELPIVDSLHPRPPYLPLAVPEDLADRLVRVHGDPAVWWVSQFVKYLIRPQPWLEKEIEEATKKLGFKHPVIGVHVRRTDKVGTEAAFHPIEEYMVHVEEHFQLLARRMQVDKKRVYLATDDPSLLKEAKTKYPNYEFISDNSISWSAGLHNRYTENSLRGVILDIHFLSQADFLVCTFSSQVCRVAYEIMQTLHPDASANFHSLDDIYYFGGQNAHNQIAIYAHQPRTADEIPMEPGDIIGVAGNHWDGYSKGVNRKLGRTGLYPSYKVREKIETVKYPTYPEAEK

SEQ ID NO: 1628 - protein, 359 aa, unidentified
MTSTSKGILRPFLIVCIILGCFMACLLIYIKPTNSWIFSPMESASSVLKMKNFFSTKTDYFNETTILVWVWPFGQTFDLTSCQAMFNIQGCHLTTDRSLYNKSHAVLIHHRDISWDLTNLPQQARPPFQKWIWMNLESPTHTPQKSGIEHLFNLTLTYRRDSDIQVPYGFLTVSTNPFVFEVPSKEKLVCWVVSNWNPEHARVKYYNELSKSIEIHTYGQAFGEYVNDKNLIPTISTCKFYLSFENSIHKDYITEKLYNAFLAGSVPVVLGPSRENYENYIPADSFIHVEDYNSPSELAKYLKEVDKNNKLYLSYFNWRKDFTVNLPRFWESHACLACDHVKRHQEYKSVGNLEKWFWN

SEQ ID NO: 1629 - protein, 418 aa, unidentified
MGEEGTGGTVHLLCLAASSGVPLFCRSSRGGAPARQQLPFSVIGSLNGVHMFGQNLEVQLSSARTENTTVVWKSFHDSITLIVLSSEVGISELRLERLLQMVFGAMVLLVGLEELTNIRNVERLKKDLRASYCLIDSFLGDSELIGDLTQCVDCVIPPEGSLLQEALSGFAEAAGTTFVSLVVSGRVVAATEGWWRLGTPEAVLLPWLVGSLPPQTARDYPVYLPHGSPTVPHRLLTLTLLPSLELCLLCGPSPPLSQLYPQLLERWWQPLLDPLRACLPLGPRALPSGFPLHTDILGLLLLHLELKRCLFTVEPLGDKEPSPEQRRRLLRNFYTLVTSTHFPPEPGPPEKTEDEVYQAQLPRACYLVLGTEEPGTGVRLVALQLGLRRLLLLLSPQSPTHGLRSLATHTLHALTPLL

SEQ ID NO: 1630 - protein, 92 aa, unidentified
MASLGHILVFCVGLLTMAKAESPKEHDPFTYDYQSLQIGGLVIAGILFILGILIVLSRRCRCKFNQQQRTGEPDEEEGTFRSSIRRLSTRRR

SEQ ID NO: 1631 - protein, 66 aa, unidentified
MTGLSMDGGGSPKGDVDPFYYDYETVRNGGLIFAGLAFIVGLLILLSRRFRCGGNKKRRQINEDEP

SEQ ID NO: 1632 - protein, 87 aa, unidentified
MQKVTLGLLVFLAGFPVLDANDLEDKNSPFYYDWHSLQVGGLICAGVLCAMGIIIVMSAKCKCKFGQKSGHHPGETPPLITPGSAQS

SEQ ID NO: 1633 - protein, 89 aa, unidentified
MERVTLALLLLAGLTALEANDPFANKDDPFYYDWKNLQLSGLICGGLLAIAGIAAVLSGKCKCKSSQKQHSPVPEKAIPLITPGSATTC

SEQ ID NO: 1634 - protein, 178 aa, unidentified
MSPSGRLCLLTIVGLILPTRGQTLKDTTSSSSADSTIMDIQVPTRAPDAVYTELQPTSPTPTWPADETPQPQTQTQQLEGTDGPLVTDPETHKSTKAAHPTDDTTTLSERPSPSTDVQTDPQTLKPSGFHEDDPFFYDEHTLRKRGLLVAAVLFITGIIILTSGKCRQLSRLCRNRCR

SEQ ID NO: 1635 - protein, 95 aa, unidentified
MELVLVFLCSLLAPMVLASAAEKEKEMDPFHYDYQTLRIGGLVFAVVLFSVGILLILSRRCKCSFNQKPRAPGDEEAQVENLITANATEPQKAEN

SEQ ID NO: 1636 - protein, 80 aa, unidentified
MATPTQTPTKAPEEPDPFYYDYNTVQTVGMTLATILFLLGILIVISKKVKCRKADSRSESPTCKSCKSELPSSAPGGGGV

SEQ ID NO: 1637 - protein, 647 aa, unidentified
MAEEEAPKKSRAAGGGASWELCAGALSARLAEEGSGDAGGRRRPPVDPRRLARQLLLLLWLLEAPLLLGVRAQAAGQGPGQGPGPGQQPPPPPQQQQSGQQYNGERGISVPDHGYCQPISIPLCTDIAYNQTIMPNLLGHTNQEDAGLEVHQFYPLVKVQCSAELKFFLCSMYAPVCTVLEQALPPCRSLCERARQGCEALMNKFGFQWPDTLKCEKFPVHGAGELCVGQNTSDKGTPTPSLLPEFWTSNPQHGGGGHRGGFPGGAGASERGKFSCPRALKVPSYLNYHFLGEKDCGAPCEPTKVYGLMYFGPEELRFSRTWIGIWSVLCCASTLFTVLTYLVDMRRFSYPERPIIFLSGCYTAVAVAYIAGFLLEDRVVCNDKFAEDGARTVAQGTKKEGCTILFMMLYFFSMASSIWWVILSLTWFLAAGMKWGHEAIEANSQYFHLAAWAVPAIKTITILALGQVDGDVLSGVCFVGLNNVDALRGFVLAPLFVYLFIGTSFLLAGFVSLFRIRTIMKHDGTKTEKLEKLMVRIGVFSVLYTVPATIVIACYFYEQAFRDQWERSWVAQSCKSYAIPCPHLQAGGGAPPHPPMSPDFTVFMIKYLMTLIVGITSGFWIWSGKTLNSWRKFYTRLTNSKQGETTV

SEQ ID NO: 1638 - protein, 581 aa, unidentified
MQRPGPRLWLVLQVMGSCAAISSMDMERPGDGKCQPIEIPMCKDIGYNMTRMPNLMGHENQREAAIQLHEFAPLVEYGCHGHLRFFLCSLYAPMCTEQVSTPIPACRVMCEQARLKCSPIMEQFNFKWPDSLDCRKLPNKNDPNYLCMEAPNNGSDEPTRGSGLFPPLFRPQRPHSAQEHPLKDGGPGRGGCDNPGKFHHVEKSASCAPLCTPGVDVYWSREDKRFAVVWLAIWAVLCFFSSAFTVLTFLIDPARFRYPERPIIFLSMCYCVYSVGYLIRLFAGAESIACDRDSGQLYVIQEGLESTGCTLVFLVLYYFGMASSLWWVVLTLTWFLAAGKKWGHEAIEANSSYFHLAAWAIPAVKTILILVMRRVAGDELTGVCYVGSMDVNALTGFVLIPLACYLVIGTSFILSGFVALFHIRRVMKTGGENTDKLEKLMVRIGLFSVLYTVPATCVIACYFYERLNMDYWKILAAQHKCKMNNQTKTLDCLMAASIPAVEIFMVKIFMLLVVGITSGMWIWTSKTLQSWQQVCSRRLKKKSRRKPASVITSGGIYKKAQHPQKTHHGKYEIPAQSPTCV

SEQ ID NO: 1639 - protein, 565 aa, unidentified
MRPRSALPRLLLPLLLLPAAGPAQFHGEKGISIPDHGFCQPISIPLCTDIAYNQTIMPNLLGHTNQEDAGLEVHQFYPLVKVQCSPELRFFLCSMYAPVCTVLEQAIPPCRSICERARQGCEALMNKFGFQWPERLRCEHFPRHGAEQICVGQNHSEDGAPALLTTAPPPGLQPGAGGTPGGPGGGGAPPRYATLEHPFHCPRVLKVPSYLSYKFLGERDCAAPCEPARPDGSMFFSQEETRFARLWILTWSVLCCASTFFTVTTYLVDMQRFRYPERPIIFLSGCYTMVSVAYIAGFVLQERVVCNERFSEDGYRTVVQGTKKEGCTILFMMLYFFSMASSIWWVILSLTWFLAAGMKWGHEAIEANSQYFHLAAWAVPAVKTITILAMGQIDGDLLSGVCFVGLNSLDPLRGFVLAPLFVYLFIGTSFLLAGFVSLFRIRTIMKHDGTKTEKLERLMVRIGVFSVLYTVPATIVIACYFYEQAFREHWERSWVSQHCKSLAIPCPAHYTPRMSPDFTVYMIKYLMTLIVGITSGFWIWSGKTLHSWRKFYTRLTNSRHGETTV

SEQ ID NO: 1640 - protein, 666 aa, unidentified
MAMTWIVFSLWPLTVFMGHIGGHSLFSCEPITLRMCQDLPYNTTFMPNLLNHYDQQTAALAMEPFHPMVNLDCSRDFRPFLCALYAPICMEYGRVTLPCRRLCQRAYSECSKLMEMFGVPWPEDMECSRFPDCDEPYPRLVDLNLAGEPTEGAPVAVQRDYGFWCPRELKIDPDLGYSFLHVRDCSPPCPNMYFRREELSFARYFIGLISIICLSATLFTFLTFLIDVTRFRYPERPIIFYAVCYMMVSLIFFIGFLLEDRVACNASIPAQYKASTVTQGSHNKACTMLFMILYFFTMAGSVWWVILTITWFLAAVPKWGSEAIEKKALLFHASAWGIPGTLTIILLAMNKIEGDNISGVCFVGLYDVDALRYFVLAPLCLYVVVGVSLLLAGIISLNRVRIEIPLEKENQDKLVKFMIRIGVFSILYLVPLLVVIGCYFYEQAYRGIWETTWIQERCREYHIPCPYQVTQMSRPDLILFLMKYLMALIVGIPSVFWVGSKKTCFEWASFFHGRRKKEIVNESRQVLQEPDFAQSLLRDPNTPIIRKSRGTSTQGTSTHASSTQLAMVDDQRSKAGSIHSKVSSYHGSLHRSRDGRYTPCSYRGMEERLPHGSMSRLTDHSRHSSSHRLNEQSRHSSIRDLSNNPMTHITHGTSMNRVIEEDGTSA

SEQ ID NO: 1641 - protein, 537 aa, unidentified
MAWRGAGPSVPGAPGGVGLSLGLLLQLLLLLGPARGFGDEEERRCDPIRISMCQNLGYNVTKMPNLVGHELQTDAELQLTTFTPLIQYGCSSQLQFFLCSVYVPMCTEKINIPIGPCGGMCLSVKRRCEPVLKEFGFAWPESLNCSKFPPQNDHNHMCMEGPGDEEVPLPHKTPIQPGEECHSVGTNSDQYIWVKRSLNCVLKCGYDAGLYSRSAKEFTDIWMAVWASLCFISTAFTVLTFLIDSSRFSYPERPIIFLSMCYNIYSIAYIVRLTVGRERISCDFEEAAEPVLIQEGLKNTGCAIIFLLMYFFGMASSIWWVILTLTWFLAAGLKWGHEAIEMHSSYFHIAAWAIPAVKTIVILIMRLVDADELTGLCYVGNQNLDALTGFVVAPLFTYLVIGTLFIAAGLVALFKIRSNLQKDGTKTDKLERLMVKIGVFSVLYTVPATCVIACYFYEISNWALFRYSADDSNMAVEMLKIFMSLLVGITSGMWIWSAKTLHTWQKCSNRLVNSGKVKREKRGNGWVKPGKGSETVV

SEQ ID NO: 1642 - protein, 585 aa, unidentified
MARPDPSAPPSLLLLLLAQLVGRAAAASKAPVCQEITVPMCRGIGYNLTHMPNQFNHDTQDEAGLEVHQFWPLVEIQCSPDLRFFLCSMYTPICLPDYHKPLPPCRSVCERAKAGCSPLMRQYGFAWPERMSCDRLPVLGRDAEVLCMDYNRSEATTAPPRPFPAKPTLPGPPGAPASGGECPAGGPFVCKCREPFVPILKESHPLYNKVRTGQVPNCAVPCYQPSFSADERTFATFWIGLWSVLCFISTSTTVATFLIDMERFRYPERPIIFLSACYLCVSLGFLVRLVVGHASVACSREHNHIHYETTGPALCTIVFLLVYFFGMASSIWWVILSLTWFLAAGMKWGNEAIAGYAQYFHLAAWLIPSVKSITALALSSVDGDPVAGICYVGNQNLNSLRGFVLGPLVLYLLVGTLFLLAGFVSLFRIRSVIKQGGTKTDKLEKLMIRIGIFTLLYTVPASIVVACYLYEQHYRESWEAALTCACPGHDTGQPRAKPEYWVLMLKYFMCLVVGITSGVWIWSGKTVESWRRFTSRCCCRPRRGHKSGGAMAAGDYPEASAALTGRTGPPGPAATYHKQVSLSHV

SEQ ID NO: 1643 - protein, 706 aa, unidentified
MEMFTFLLTCIFLPLLRGHSLFTCEPITVPRCMKMAYNMTFFPNLMGHYDQSIAAVEMEHFLPLANLECSPNIETFLCKAFVPTCIEQIHVVPPCRKLCEKVYSDCKKLIDTFGIRWPEELECDRLQYCDETVPVTFDPHTEFLGPQKKTEQVQRDIGFWCPRHLKTSGGQGYKFLGIDQCAPPCPNMYFKSDELEFAKSFIGTVSIFCLCATLFTFLTFLIDVRRFRYPERPIIYYSVCYSIVSLMYFIGFLLGDSTACNKADEKLELGDTVVLGSQNKACTVLFMLLYFFTMAGTVWWVILTITWFLAAGRKWSCEAIEQKAVWFHAVAWGTPGFLTVMLLAMNKVEGDNISGVCFVGLYDLDASRYFVLLPLCLCVFVGLSLLLAGIISLNHVRQVIQHDGRNQEKLKKFMIRIGVFSGLYLVPLVTLLGCYVYEQVNRITWEITWVSDHCRQYHIPCPYQAKAKARPELALFMIKYLMTLIVGISAVFWVGSKKTCTEWAGFFKRNRKRDPISESRRVLQESCEFFLKHNSKVKHKKKHYKPSSHKLKVISKSMGTSTGATANHGTSAVAITSHDYLGQETLTEIQTSPETSMREVKADGASTPRLREQDCGEPASPAASISRLSGEQVDGKGQAGSVSESARSEGRISPKSDITDTGLAQSNNLQVPSSSEPSSLKGSTSLLVHPVSGVRKEQGGGCHSDT

SEQ ID NO: 1644 - protein, 574 aa, unidentified
MRDPGAAAPLSSLGLCALVLALLGALSAGAGAQPYHGEKGISVPDHGFCQPISIPLCTDIAYNQTILPNLLGHTNQEDAGLEVHQFYPLVKVQCSPELRFFLCSMYAPVCTVLDQAIPPCRSLCERARQGCEALMNKFGFQWPERLRCENFPVHGAGEICVGQNTSDGSGGPGGGPTAYPTAPYLPDLPFTALPPGASDGRGRPAFPFSCPRQLKVPPYLGYRFLGERDCGAPCEPGRANGLMYFKEEERRFARLWVGVWSVLCCASTLFTVLTYLVDMRRFSYPERPIIFLSGCYFMVAVAHVAGFLLEDRAVCVERFSDDGYRTVAQGTKKEGCTILFMVLYFFGMASSIWWVILSLTWFLAAGMKWGHEAIEANSQYFHLAAWAVPAVKTITILAMGQVDGDLLSGVCYVGLSSVDALRGFVLAPLFVYLFIGTSFLLAGFVSLFRIRTIMKHDGTKTEKLEKLMVRIGVFSVLYTVPATIVLACYFYEQAFREHWERTWLLQTCKSYAVPCPPGHFPPMSPDFTVFMIKYLMTMIVGITTGFWIWSGKTLQSWRRFYHRLSHSSKGETAV

SEQ ID NO: 1645 - protein, 694 aa, unidentified
MEWGYLLEVTSLLAALALLQRSSGAAAASAKELACQEITVPLCKGIGYNYTYMPNQFNHDTQDEAGLEVHQFWPLVEIQCSPDLKFFLCSMYTPICLEDYKKPLPPCRSVCERAKAGCAPLMRQYGFAWPDRMRCDRLPEQGNPDTLCMDYNRTDLTTAAPSPPRRLPPPPPGEQPPSGSGHGRPPGARPPHRGGGRGGGGGDAAAPPARGGGGGGKARPPGGGAAPCEPGCQCRAPMVSVSSERHPLYNRVKTGQIANCALPCHNPFFSQDERAFTVFWIGLWSVLCFVSTFATVSTFLIDMERFKYPERPIIFLSACYLFVSVGYLVRLVAGHEKVACSGGAPGAGGAGGAGGAAAGAGAAGAGAGGPGGRGEYEELGAVEQHVRYETTGPALCTVVFLLVYFFGMASSIWWVILSLTWFLAAGMKWGNEAIAGYSQYFHLAAWLVPSVKSIAVLALSSVDGDPVAGICYVGNQSLDNLRGFVLAPLVIYLFIGTMFLLAGFVSLFRIRSVIKQQDGPTKTHKLEKLMIRLGLFTVLYTVPAAVVVACLFYEQHNRPRWEATHNCPCLRDLQPDQARRPDYAVFMLKYFMCLVVGITSGVWVWSGKTLESWRSLCTRCCWASKGAAVGGGAGATAAGGGGGPGGGGGGGPGGGGGPGGGGGSLYSDVSTGLTWRSGTASSVSYPKQMPLSQV

SEQ ID NO: 1646 - protein, 591 aa, unidentified
MAVAPLRGALLLWQLLAAGGAALEIGRFDPERGRGAAPCQAVEIPMCRGIGYNLTRMPNLLGHTSQGEAAAELAEFAPLVQYGCHSHLRFFLCSLYAPMCTDQVSTPIPACRPMCEQARLRCAPIMEQFNFGWPDSLDCARLPTRNDPHALCMEAPENATAGPAEPHKGLGMLPVAPRPARPPGDLGPGAGGSGTCENPEKFQYVEKSRSCAPRCGPGVEVFWSRRDKDFALVWMAVWSALCFFSTAFTVLTFLLEPHRFQYPERPIIFLSMCYNVYSLAFLIRAVAGAQSVACDQEAGALYVIQEGLENTGCTLVFLLLYYFGMASSLWWVVLTLTWFLAAGKKWGHEAIEAHGSYFHMAAWGLPALKTIVILTLRKVAGDELTGLCYVASTDAAALTGFVLVPLSGYLVLGSSFLLTGFVALFHIRKIMKTGGTNTEKLEKLMVKIGVFSILYTVPATCVIVCYVYERLNMDFWRLRATEQPCAAAAGPGGRRDCSLPGGSVPTVAVFMLKIFMSLVVGITSGVWVWSSKTFQTWQSLCYRKIAAGRARAKACRAPGSYGRGTHCHYKAPTVVLHMTKTDPSLENPTHL

SEQ ID NO: 1647 - protein, 357 aa, unidentified
MEEGMNVLHDFGIQSTHYLQVNYQDSQDWFILVSVIADLRNAFYVLFPIWFHLQEAVGIKLLWVAVIGDWLNLVFKWILFGQRPYWWVLDTDYYSNTSVPLIKQFPVTCETGPGSPSGHAMGTAGVYYVMVTSTLSIFQGKIKPTYRFRCLNVILWLGFWAVQLNVCLSRIYLAAHFPHQVVAGVLSGIAVAETFSHIHSIYNASLKKYFLITFFLFSFAIGFYLLLKGLGVDLLWTLEKAQRWCEQPEWVHIDTTPFASLLKNLGTLFGLGLALNSSMYRESCKGKLSKWLPFRLSSIVASLVLLHVFDSLKPPSQVELVFYVLSFCKSAVVPLASVSVIPYCLAQVLGQPHKKSL

SEQ ID NO: 1648 - protein, 355 aa, unidentified
MDFLHRNGVLIIQHLQKDYRAYYTFLNFMSNVGDPRNIFFIYFPLCFQFNQTVGTKMIWVAVIGDWLNLIFKWILFGHRPYWWVQETQIYPNHSSPCLEQFPTTCETGPGSPSGHAMGASCVWYVMVTAALSHTVCGMDKFSITLHRLTWSFLWSVFWLIQISVCISRVFIATHFPHQVILGVIGGMLVAEAFEHTPGIQTASLGTYLKTNLFLFLFAVGFYLLLRVLNIDLLWSVPIAKKWCANPDWIHIDTTPFAGLVRNLGVLFGLGFAINSEMFLLSCRGGNNYTLSFRLLCALTSLTILQLYHFLQIPTHEEHLFYVLSFCKSASIPLTVVAFIPYSVHMLMKQSGKKSQ

SEQ ID NO: 1649 - protein, 346 aa, unidentified
MESTLGAGIVIAEALQNQLAWLENVWLWITFLGDPKILFLFYFPAAYYASRRVGIAVLWISLITEWLNLIFKWFLFGDRPFWWVHESGYYSQAPAQVHQFPSSCETGPGSPSGHCMITGAALWPIMTALSSQVATRARSRWVRVMPSLAYCTFLLAVGLSRIFILAHFPHQVLAGLITGAVLGWLMTPRVPMERELSFYGLTALALMLGTSLIYWTLFTLGLDLSWSISLAFKWCERPEWIHVDSRPFASLSRDSGAALGLGIALHSPCYAQVRRAQLGNGQKIACLVLAMGLLGPLDWLGHPPQISLFYIFNFLKYTLWPCLVLALVPWAVHMFSAQEAPPIHSS

SEQ ID NO: 1650 - protein, 961 aa, unidentified
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 1651 - protein, 941 aa, unidentified
MASPRSSGQPGPPPPPPPPPARLLLLLLLPLLLPLAPGAWGWARGAPRPPPSSPPLSIMGLMPLTKEVAKGSIGRGVLPAVELAIEQIRNESLLRPYFLDLRLYDTECDNAKGLKAFYDAIKYGPNHLMVFGGVCPSVTSIIAESLQGWNLVQLSFAATTPVLADKKKYPYFFRTVPSDNAVNPAILKLLKHYQWKRVGTLTQDVQRFSEVRNDLTGVLYGEDIEISDTESFSNDPCTSVKKLKGNDVRIILGQFDQNMAAKVFCCAYEENMYGSKYQWIIPGWYEPSWWEQVHTEANSSRCLRKNLLAAMEGYIGVDFEPLSSKQIKTISGKTPQQYEREYNNKRSGVGPSKFHGYAYDGIWVIAKTLQRAMETLHASSRHQRIQDFNYTDHTLGRIILNAMNETNFFGVTGQVVFRNGERMGTIKFTQFQDSREVKVGEYNAVADTLEIINDTIRFQGSEPPKDKTIILEQLRKISLPLYSILSALTILGMIMASAFLFFNIKNRNQKLIKMSSPYMNNLIILGGMLSYASIFLFGLDGSFVSEKTFETLCTVRTWILTVGYTTAFGAMFAKTWRVHAIFKNVKMKKKIIKDQKLLVIVGGMLLIDLCILICWQAVDPLRRTVEKYSMEPDPAGRDISIRPLLEHCENTHMTIWLGIVYAYKGLLMLFGCFLAWETRNVSIPALNDSKYIGMSVYNVGIMCIIGAAVSFLTRDQPNVQFCIVALVIIFCSTITLCLVFVPKLITLRTNPDAATQNRRFQFTQNQKKEDSKTSTSVTSVNQASTSRLEGLQSENHRLRMKITELDKDLEEVTMQLQDTPEKTTYIKQNHYQELNDILNLGNFTESTDGGKAILKNHLDQNPQLQWNTTEPSRTCKDPIEDINSPEHIQRRLSLQLPILHHAYLPSIGGVDASCVSPCVSPTASPRHRHVPPSFRVMVSGL

SEQ ID NO: 1652 - protein, 456 aa, unidentified
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGYAWDGKSVVPEKPKKVKDPLIKKNNTYAPTATSYTPNLARGDPGLATIAKSATIEPKEVKPETKPPEPKKTFNSVSKIDRLSRIAFPLLFGIFNLVYWATYLNREPQLKAPTPHQ

SEQ ID NO: 1653 - protein, 451 aa, unidentified
MKTKLNIYNMQFLLFVFLVWDPARLVLANIQEDEAKNNITIFTRILDRLLDGYDNRLRPGLGDSITEVFTNIYVTSFGPVSDTDMEYTIDVFFRQKWKDERLKFKGPMNILRLNNLMASKIWTPDTFFHNGKKSVAHNMTMPNKLLRIQDDGTLLYTMRLTVQAECPMHLEDFPMDAHSCPLKFGSYAYTTSEVTYIWTYNASDSVQVAPDGSRLNQYDLLGQSIGKETIKSSTGEYTVMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKSVVNDKKKEKASVMIQNNAYAVAVANYAPNLSKDPVLSTISKSATTPEPNKKPENKPAEAKKTFNSVSKIDRMSRIVFPVLFGTFNLVYWATYLNREPVLGVSP

SEQ ID NO: 1654 - protein, 492 aa, unidentified
MIITQTSHCYMTSLGILFLINILPGTTGQGESRRQEPGDFVKQDIGGLSPKHAPDIPDDSTDNITIFTRILDRLLDGYDNRLRPGLGDAVTEVKTDIYVTSFGPVSDTDMEYTIDVFFRQTWHDERLKFDGPMKILPLNNLLASKIWTPDTFFHNGKKSVAHNMTTPNKLLRLVDNGTLLYTMRLTIHAECPMHLEDFPMDVHACPLKFGSYAYTTAEVVYSWTLGKNKSVEVAQDGSRLNQYDLLGHVVGTEIIRSSTGEYVVMTTHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRSWAWEGKKVPEALEMKKKTPAAPAKKTSTTFNIVGTTYPINLAKDTEFSTISKGAAPSASSTPTIIASPKATYVQDSPTETKTYNSVSKVDKISRIIFPVLFAIFNLVYWATYVNRESAIKGMIRKQ

SEQ ID NO: 1655 - protein, 554 aa, unidentified [sequence omitted]

SEQ ID NO: 1656 - protein, 462 aa, unidentified
MDNGMFSGFIMIKNLLLFCISMNLSSHFGFSQMPTSSVKDETNDNITIFTRILDGLLDGYDNRLRPGLGERITQVRTDIYVTSFGPVSDTEMEYTIDVFFRQSWKDERLRFKGPMQRLPLNNLLASKIWTPDTFFHNGKKSIAHNMTTPNKLLRLEDDGTLLYTMRLTISAECPMQLEDFPMDAHACPLKFGSYAYPNSEVVYVWTNGSTKSVVVAEDGSRLNQYHLMGQTVGTENISTSTGEYTIMTAHFHLKRKIGYFVIQTYLPCIMTVILSQVSFWLNRESVPARTVFGVTTVLTMTTLSISARNSLPKVAYATAMDWFIAVCYAFVFSALIEFATVNYFTKRGWAWDGKKALEAAKIKKKREVILNKSTNAFTTGKMSHPPNIPKEQTPAGTSNTTSVSVKPSEEKTSESKKTYNSISKIDKMSRIVFPVLFGTFNLVYWATYLNREPVIKGAASPK

SEQ ID NO: 1657 - protein, 453 aa, unidentified
MASSLPWLCIILWLENALGKLEVEGNFYSENVSRILDNLLEGYDNRLRPGFGGAVTEVKTDIYVTSFGPVSDVEMEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTVILSQVSFWINKESVPARTVFGITTVLTMTTLSISARHSLPKVSYATAMDWFIAVCFAFVFSALIEFAAVNYFTNLQTQKAKRKAQFAAPPTVTISKATEPLEAEIVLHPDSKYHLKKRITSLSLPIVSSSEANKVLTRAPILQSTPVTPPPLSPAFGGTSKIDQYSRILFPVAFAGFNLVYWVVYLSKDTMEVSSSVE

SEQ ID NO: 1658 - protein, 474 aa, unidentified
MWTVQNRESLGLLSFPVMITMVCCAHSTNEPSNMSYVKETVDRLLKGYDIRLRPDFGGPPVDVGMRIDVASIDMVSEVNMDYTLTMYFQQSWKDKRLSYSGIPLNLTLDNRVADQLWVPDTYFLNDKKSFVHGVTVKNRMIRLHPDGTVLYGLRITTTAACMMDLRRYPLDEQNCTLEIESYGYTTDDIEFYWNGGEGAVTGVNKIELPQFSIVDYKMVSKKVEFTTGAYPRLSLSFRLKRNIGYFILQTYMPSTLITILSWVSFWINYDASAARVALGITTVLTMTTISTHLRETLPKIPYVKAIDIYLMGCFVFVFLALLEYAFVNYIFFGKGPQKKGASKQDQSANEKNKLEMNKVQVDAHGNILLSTLEIRNETSGSEVLTSVSDPKATMYSYDSASIQYRKPLSSREAYGRALDRHGVPSKGRIRRRASQLKVKIPDLTDVNSIDKWSRMFFPITFSLFNVVYWLYYVH

SEQ ID NO: 1659 - protein, 512 aa, unidentified
MWRVRKRGYFGIWSFPLIIAAVCAQSVNDPSNMSLVKETVDRLLKGYDIRLRPDFGGPPVAVGMNIDIASIDMVSEVNMDYTLTMYFQQAWRDKRLSYNVIPLNLTLDNRVADQLWVPDTYFLNDKKSFVHGVTVKNRMIRLHPDGTVLYGLRITTTAACMMDLRRYPLDEQNCTLEIESYGYTTDDIEFYWRGDDNAVTGVTKIELPQFSIVDYKLITKKVVFSTGSYPRLSLSFKLKRNIGYFILQTYMPSILITILSWVSFWINYDASAARVALGITTVLTMTTINTHLRETLPKIPYVKAIDMYLMGCFVFVFMALLEYALVNYIFFGRGPQRQKKAAEKAASANNEKMRLDVNKIFYKDIKQNGTQYRSLWDPTGNLSPTRRTTNYDFSLYTMDPHENILLSTLEIKNEMATSEAVMGLGDPRSTMLAYDASSIQYRKAGLPRHSFGRNALERHVAQKKSRLRRRASQLKITIPDLTDVNAIDRWSRIFFPVVFSFFNIVYWLYYVN

SEQ ID NO: 1660 - protein, 473 aa, unidentified [sequence omitted]

SEQ ID NO: 1661 - protein, 452 aa, unidentified [sequence omitted]

SEQ ID NO: 1662 - protein, 506 aa, unidentified
MLSKVLPVLLGILLILQSRVEGPQTESKNEASSRDVVYGPQPQPLENQLLSEETKSTETETGSRVGKLPEASRILNTILSNYDHKLRPGIGEKPTVVTVEISVNSLGPLSILDMEYTIDIIFSQTWYDERLCYNDTFESLVLNGNVVSQLWIPDTFFRNSKRTHEHEITMPNQMVRIYKDGKVLYTIRMTIDAGCSLHMLRFPMDSHSCPLSFSSFSYPENEMIYKWENFKLEINEKNSWKLFQFDFTGVSNKTEIITTPVGDFMVMTIFFNVSRRFGYVAFQNYVPSSVTTMLSWVSFWIKTESAPARTSLGITSVLTMTTLGTFSRKNFPRVSYITALDFYIAICFVFCFCALLEFAVLNFLIYNQTKAHASPKLRHPRINSRAHARTRARSRACARQHQEAFVCQIVTTEGSDGEERPSCSAQQPPSPGSPEGPRSLCSKLACCEWCKRFKKYFCMVPDCEGSTWQQGRLCIHVYRLDNYSRVVFPVTFFFFNVLYWLVCLNL

SEQ ID NO: 1663 - protein, 465 aa, unidentified
MGPLKAFLFSPFLLRSQSRGVRLVFLLLTLHLGNCVDKADDEDDEDLTVNKTWVLAPKIHEGDITQILNSLLQGYDNKLRPDIGVRPTVIETDVYVNSIGPVDPINMEYTIDIIFAQTWFDSRLKFNSTMKVLMLNSNMVGKIWIPDTFFRNSRKSDAHWITTPNRLLRIWNDGRVLYTLRLTINAECYLQLHNFPMDEHSCPLEFSSYGYPKNEIEYKWKKPSVEVADPKYWRLYQFAFVGLRNSTEITHTISGDYVIMTIFFDLSRRMGYFTIQTYIPCILTVVLSWVSFWINKDAVPARTSLGITTVLTMTTLSTIARKSLPKVSYVTAMDLFVSVCFIFVFAALMEYGTLHYFTSNQKGKTATKDRKLKNKASMTPGLHPGSTLIPMNNISVPQEDDYGYQCLEGKDCASFFCCFEDCRTGSWREGRIHIRIAKIDSYSRIFFPTAFALFNLVYWVGYLYL

SEQ ID NO: 1664 - protein, 467 aa, unidentified
MSSPNIWSTGSSVYSTPVFSQKMTVWILLLLSLYPGFTSQKSDDDYEDYASNKTWVLTPKVPEGDVTVILNNLLEGYDNKLRPDIGVKPTLIHTDMYVNSIGPVNAINMEYTIDIFFAQTWYDRRLKFNSTIKVLRLNSNMVGKIWIPDTFFRNSKKADAHWITTPNRMLRIWNDGRVLYTLRLTIDAECQLQLHNFPMDEHSCPLEFSSYGYPREEIVYQWKRSSVEVGDTRSWRLYQFSFVGLRNTTEVVKTTSGDYVVMSVYFDLSRRMGYFTIQTYIPCTLIVVLSWVSFWINKDAVPARTSLGITTVLTMTTLSTIARKSLPKVSYVTAMDLFVSVCFIFVFSALVEYGTLHYFVSNRKPSKDKDKKKKNPAPTIDIRPRSATIQMNNATHLQERDEEYGYECLDGKDCASFFCCFEDCRTGAWRHGRIHIRIAKMDSYARIFFPTAFCLFNLVYWVSYLYL

SEQ ID NO: 1665 - protein, 467 aa, unidentified
MAPKLLLLLCLFSGLHARSRKVEEDEYEDSSSNQKWVLAPKSQDTDVTLILNKLLREYDKKLRPDIGIKPTVIDVDIYVNSIGPVSSINMEYQIDIFFAQTWTDSRLRFNSTMKILTLNSNMVGLIWIPDTIFRNSKTAEAHWITTPNQLLRIWNDGKILYTLRLTINAECQLQLHNFPMDEHSCPLIFSSYGYPKEEMIYRWRKNSVEAADQKSWRLYQFDFMGLRNTTEIVTTSAGDYVVMTIYFELSRRMGYFTIQTYIPCILTVVLSWVSFWIKKDATPARTALGITTVLTMTTLSTIARKSLPRVSYVTAMDLFVTVCFLFVFAALMEYATLNYYSSCRKPTTTKKTTSLLHPDSSRWIPERISLQAPSNYSLLDMRPPPTAMITLNNSVYWQEFEDTCVYECLDGKDCQSFFCCYEECKSGSWRKGRIHIDILELDSYSRVFFPTSFLLFNLVYWVGYLYL

SEQ ID NO: 1666 - protein, 440 aa, unidentified
MNYSLHLAFVCLSLFTERMCIQGSQFNVEVGRSDKLSLPGFENLTAGYNKFLRPNFGGEPVQIALTLDIASISSISESNMDYTATIYLRQRWMDQRLVFEGNKSFTLDARLVEFLWVPDTYIVESKKSFLHEVTVGNRLIRLFSNGTVLYALRITTTVACNMDLSKYPMDTQTCKLQLESWGYDGNDVEFTWLRGNDSVRGLEHLRLAQYTIERYFTLVTRSQQETGNYTRLVLQFELRRNVLYFILETYVPSTFLVVLSWVSFWISLDSVPARTCIGVTTVLSMTTLMIGSRTSLPNTNCFIKAIDVYLGICFSFVFGALLEYAVAHYSSLQQMAAKDRGTTKEVEEVSITNIINSSISSFKRKISFASIEISSDNVDYSDLTMKTSDKFKFVFREKMGRIVDYFTIQNPSNVDHYSKLLFPLIFMLANVFYWAYYMYF

SEQ ID NO: 1667 - protein, 479 aa, unidentified
MLAVPNMRFGIFLLWWGWVLATESRMHWPGREVHEMSKKGRPQRQRREVHEDAHKQVSPILRRSPDITKSPLTKSEQLLRIDDHDFSMRPGFGGPAIPVGVDVQVESLDSISEVDMDFTMTLYLRHYWKDERLSFPSTNNLSMTFDGRLVKKIWVPDMFFVHSKRSFIHDTTTDNVMLRVQPDGKVLYSLRVTVTAMCNMDFSRFPLDTQTCSLEIESYAYTEDDLMLYWKKGNDSLKTDERISLSQFLIQEFHTTTKLAFYSSTGWYNRLYINFTLRRHIFFFLLQTYFPATLMVMLSWVSFWIDRRAVPARVPLGITTVLTMSTIITGVNASMPRVSYIKAVDIYLWVSFVFVFLSVLEYAAVNYLTTVQERKEQKLREKLPCTSGLPPPRTAMLDGNYSDGEVNDLDNYMPENGEKPDRMMVQLTLASERSSPQRKSQRSSYVSMRIDTHAIDKYSRIIFPAAYILFNLIYWSIFS

SEQ ID NO: 1668 - protein, 465 aa, unidentified
MPYFTRLILFLFCLMVLVESRKPKRKRWTGQVEMPKPSHLYKKNLDVTKIRKGKPQQLLRVDEHDFSMRPAFGGPAIPVGVDVQVESLDSISEVDMDFTMTLYLRHYWKDERLAFSSASNKSMTFDGRLVKKIWVPDVFFVHSKRSFTHDTTTDNIMLRVFPDGHVLYSMRITVTAMCNMDFSHFPLDSQTCSLELESYAYTDEDLMLYWKNGDESLKTDEKISLSQFLIQKFHTTSRLAFYSSTGWYNRLYINFTLRRHIFFFLLQTYFPATLMVMLSWVSFWIDRRAVPARVSLGITTVLTMTTIITGVNASMPRVSYVKAVDIYLWVSFVFVFLSVLEYAAVNYLTTVQERKERKLREKFPCMCGMLHSKTMMLDGSYSESEANSLAGYPRSHILTEEERQDKIVVHLGLSGEANAARKKGLLKGQTGFRIFQNTHAIDKYSRLIFPASYIFFNLIYWSVFS

SEQ ID NO: 1669 - protein, 486 aa, unidentified
MGPLSPARTLRLWGPRSLGVALGVFMTIGFALQLLGGPFQRRLPGLQLRQPSAPSLRPALPSCPPRQRLVFLKTHKSGSSSVLSLLHRYGDQHGLRFALPARYQFGYPKLFQASRVKGYRPQGGGTQLPFHILCHHMRFNLKEVLQVMPSDSFFFSIVRDPAALARSAFSYYKSTSSAFRKSPSLAAFLANPRGFYRPGARGDHYARNLLWFDFGLPFPPEKRAKRGNIHPPRDPNPPQLQVLPSGAGPRAQTLNPNALIHPVSTVTDHRSQISSPASFDLGSSSFIQWGLAWLDSVFDLVMVAEYFDESLVLLADALCWGLDDVVGFMHNAQAGHKQGLSTVSNSGLTAEDRQLTARARAWNNLDWALYVHFNRSLWARIEKYGQGRLQTAVAELRARREALAKHCLVGGEASDPKYITDRRFRPFQFGSAKVLGYILRSGLSPQDQEECERLATPELQYKDKLDAKQFPPTVSLPLKTSRPLSP

SEQ ID NO: 1670 - protein, 685 aa, unidentified
MAEWLLSASWQRRAKAMTAAAGSAGRAAVPLLLCALLAPGGAYVLDDSDGLGREFDGIGAVSGGGATSRLLVNYPEPYRSQILDYLFKPNFGASLHILKVEIGGDGQTTDGTEPSHMHYALDENYFRGYEWWLMKEAKKRNPNITLIGLPWSFPGWLGKGFDWPYVNLQLTAYYVVTWIVGAKRYHDLDIDYIGIWNERSYNANYIKILRKMLNYQGLQRVKIIASDNLWESISASMLLDAELFKVVDVIGAHYPGTHSAKDAKLTGKKLWSSEDFSTLNSDMGAGCWGRILNQNYINGYMTSTIAWNLVASYYEQLPYGRCGLMTAQEPWSGHYVVESPVWVSAHTTQFTQPGWYYLKTVGHLEKGGSYVALTDGLGNLTIIIETMSHKHSKCIRPFLPYFNVSQQFATFVLKGSFSEIPELQVWYTKLGKTSERFLFKQLDSLWLLDSDGSFTLSLHEDELFTLTTLTTGRKGSYPLPPKSQPFPSTYKDDFNVDYPFFSEAPNFADQTGVFEYFTNIEDPGEHHFTLRQVLNQRPITWAADASNTISIIGDYNWTNLTIKCDVYIETPDTGGVFIAGRVNKGGILIRSARGIFFWIFANGSYRVTGDLAGWIIYALGRVEVTAKKWYTLTLTIKGHFTSGMLNDKSLWTDIPVNFPKNGWAAIGTHSFEFAQFDNFLVEATR

SEQ ID NO: 1671 - protein, 559 aa, unidentified
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMTYGGFNWKLNFRWYPVPQREMDRRKGDRTLPVRTPTMAGGLFSIDRDYFQEIGTYDAGMDIWGGENLEISFRIWQCGGTLEIVTCSHVGHVFRKATPYTFPGGTGQIINKNNRRLAEVWMDEFKNFFYIISPGVTKVDYGDISSRVGLRHKLQCKPFSWYLENIYPDSQIPRHYFSLGEIRNVETNQCLDNMARKENEKVGIFNCHGMGGNQVFSYTANKEIRTDDLCLDVSKLNGPVTMLKCHHLKGNQLWEYDPVKLTLQHVNSNQCLDKATEEDSQVPSIRDCNGSRSQQWLLRNVTLPEIF

SEQ ID NO: 1672 - protein, 608 aa, unidentified
MGSVTVRYFCYGCLFTSATWTVLLFVYFNFSEVTQPLKNVPVKGSGPHGPSPKKFYPRFTRGPSRVLEPQFKANKIDDVIDSRVEDPEEGHLKFSSELGMIFNERDQELRDLGYQKHAFNMLISDRLGYHRDVPDTRNAACKEKFYPPDLPAASVVICFYNEAFSALLRTVHSVIDRTPAHLLHEIILVDDDSDFDDLKGELDEYVQKYLPGKIKVIRNTKREGLIRGRMIGAAHATGEVLVFLDSHCEVNVMWLQPLLAAIREDRHTVVCPVIDIISADTLAYSSSPVVRGGFNWGLHFKWDLVPLSELGRAEGATAPIKSPTMAGGLFAMNRQYFHELGQYDSGMDIWGGENLEISFRIWMCGGKLFIIPCSRVGHIFRKRRPYGSPEGQDTMTHNSLRLAHVWLDEYKEQYFSLRPDLKTKSYGNISERVELRKKLGCKSFKWYLDNVYPEMQISGSHAKPQQPIFVNRGPKRPKVLQRGRLYHLQTNKCLVAQGRPSQKGGLVVLKACDYSDPNQIWIYNEEHELVLNSLLCLDMSETRSSDPPRLMKCHGSGGSQQWTFGKNNRLYQVSVGQCLRAVDPLGQKGSVAMAICDGSSSQQWHLEG

SEQ ID NO: 1673 - protein, 552 aa, unidentified
MRRLTRRLVLPVFGVLWITVLLFFWVTKRKLEVPTGPEVQTPKPSDADWDDLWDQFDERRYLNAKKWRVGDDPYKLYAFNQRESERISSNRAIPDTRHLRCTLLVYCTDLPPTSIIITFHNEARSTLLRTIRSVLNRTPTHLIREIILVDDFSNDPDDCKQLIKLPKVKCLRNNERQGLVRSRIRGADIAQGTTLTFLDSHCEVNRDWLQPLLHRVKEDYTRVVCPVIDIINLDTFTYIESASELRGGFDWSLHFQWEQLSPEQKARRLDPTEPIRTPIIAGGLFVIDKAWFDYLGKYDMDMDIWGGENFEISFRVWMCGGSLEIVPCSRVGHVFRKKHPYVFPDGNANTYIKNTKRTAEVWMDEYKQYYYAARPFALERPFGNVESRLDLRKNLRCQSFKWYLENIYPELSIPKESSIQKGNIRQRQKCLESQRQNNQETPNLKLSPCAKVKGEDAKSQVWAFTYTQQILQEELCLSVITLFPGAPVVLVLCKNGDDRQQWTKTGSHIEHIASHLCLDTDMFGDGTENGKEIVVNPCESSLMSQHWDMVSS

SEQ ID NO: 1674 - protein, 607 aa, unidentified
MVCTRKTKTLVSTCVILSGMTNIICLLYVGWVTNYIASVYVRGQEPAPDKKLEEDKGDTLKIIERLDHLENVIKQHIQEAPAKPEEAEAEPFTDSSLFAHWGQELSPEGRRVALKQFQYYGYNAYLSDRLPLDRPLPDLRPSGCRNLSFPDSLPEVSIVFIFVNEALSVLLRSIHSAMERTPPHLLKEIILVDDNSSNEELKEKLTEYVDKVNSQKPGFIKVVRHSKQEGLIRSRVSGWRAATAPVVALFDAHVEFNVGWAEPVLTRIKENRKRIISPSFDNIKYDNFEIEEYPLAAQGFDWELWCRYLNPPKAWWKLENSTAPIRSPALIGCFIVDRQYFQEIGLLDEGMEVYGGENVELGIRVWQCGGSVEVLPCSRIAHIERAHKPYTEDLTAHVRRNALRVAEVWMDEFKSHVYMAWNIPQEDSGIDIGDITARKALRKQLQCKTFRWYLVSVYPEMRMYSDIIAYGVLQNSLKTDLCLDQGPDTENVPIMYICHGMTPQNVYYTSSQQIHVGILSPTVDDDDNRCLVDVNSRPRLIECSYAKAKRMKLHWQFSQGGPIQNRKSKRCLELQENSDLEFGFQLVLQKCSGQHWSITNVLRSLAS

SEQ ID NO: 1675 - protein, 633 aa, unidentified
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERKGLITARLLGATVATAETLTFLDAHCECFYGWLEPLLARIAENYTAVVSPDIASIDLNTFEFNKPSPYGSNHNRGNFDWSLSFGWESLPDHEKQRRKDETYPIKTPTFAGGLFSISKEYFEYIGSYDEEMEIWGGENIEMSFRVWQCGGQLEIMPCSVVGHVFRSKSPHSFPKGTQVIARNQVRLAEVWMDEYKEIFYRRNTDAAKIVKQKAFGDLSKRFEIKHRLQCKNFTWYLNNIYPEVYVPDLNPVISGYIKSVGQPLCLDVGENNQGGKPLIMYTCHGLGGNQYFEYSAQHEIRHNIQKELCLHAAQGLVQLKACTYKGHKTVVTGEQIWEIQKDQLLYNPFLKMCLSANGEHPSLVSCNPSDPLQKWILSQND

SEQ ID NO: 1676 - protein, 637 aa, unidentified
MMFWRKLPKALFIGLTLAIAVNLLLVFSSKGTLQNLFTGGLHRELPLHLNKRYGAVIKRLSHLEVELQDLKESMKLALRQQENVNSTLKRAKDEVRPLLKAMETKVNETKKHKTQMKLFPHSQLFRQWGEDLSEAQQKAAQDLFRKFGYNAYLSNQLPLNRTIPDTRDYRCLRKTYPSQLPSLSVILIFVNEALSIIQRAITSIINRTPSRLLKEIILVDDFSSNGELKVHLDEKIKLYNQKYPGLLKIIRHPERKGLAQARNTGWEAATADVVAILDAHIEVNVGWAEPILARIQEDRTVIVSPVFDNIRFDTFKLDKYELAVDGFNWELWCRYDALPQAWIDLHDVTAPVKSPSIMGILAANRHFLGEIGSLDGGMLIYGGENVELSLRVWQCGGKVEILPCSRIAHLERHHKPYALDLTAALKRNALRVAEIWMDEHKHMVYLAWNIPLQNSGIDFGDVSSRMALREKLKCKTFDWYLKNVYPLLKPLHTIVGYGRMKNLLDENVCLDQGPVPGNTPIMYYCHEFSSQNVYYHLTGELYVGQLIAEASASDRCLTDPGKAEKPTLEPCSKAAKNRLHIYWDFKPGGAVINRDTKRCLEMKKDLLGSHVLVLQTCSTQVWEIQHTVRDWGQTNSQ

SEQ ID NO: 1677 - protein, 603 aa, unidentified
MAVARKIRTLLTVNILVFVGIVLFSVYCRLQGRSQELVRIVSGDRRVRSRHAKVGTLGDREAILQRLDHLEEVVYNQLNGLAKPIGLVEGPGGLGQGGLAATLRDDGQEAEGKYEEYGYNAQLSDRISLDRSIPDYRPRKCRQMSYAQDLPQVSVVFIFVNEALSVILRSVHSVVNHTPSQLLKEVILVDDNSDNVELKFNLDQYVNKRYPGLVKIVRNSRREGLIRARLQGWKAATAPVVGFFDAHVEFNTGWAEPALSRIREDRRRIVLPAIDNIKYSTFEVQQYANAAHGYNWGLRCMYIIPPQDWLDRGDESAPIRTPAMIGCSFVVDREYFGDIGLLDPGMEVYGGENVELGMRVWQCGGSMEVLPCSRVAHIERTRKPYNNDIDYYAKRNALRAAEVWMDDFKSHVYMAWNIPMSNPGVDFGDVSERLALRQRLKCRSFKWYLENVYPEMRVYNNTLTYGEVRNSKASAYCLDQGAEDGDRAILYPCHGMSSQLVRYSADGLLQLGPLGSTAFLPDSKCLVDDGTGRMPTLKKCEDVARPTQRLWDFTQSGPIVSRATGRCLEVEMSKDANFGLRLVVQRCSGQKWMIRNWIKHARH

SEQ ID NO: 1678 - protein, 443 aa, unidentified
MRNAIIQGLFYGSLTFGIWTALLFIYLHHNHVSSWQKKSQEPLSAWSPGKKVHQQIIYGSEQIPKPHVIVKRTDEDKAKSMLGTDFNHTNPELHKELLKYGFNVIISRSLGIEREVPDTRSKMCLQKHYPARLPTASIVICFYNEECNALFQTMSSVTNLTPHYFLEEIILVDDMSKVDDLKEKLDYHLETFRGKVKIIRNKKREGLIRARLIGASHASGDVLVFLDSHCEVNRVWLEPLLHAIAKDPKMVVCPLIDVIDDRTLEYKPSPLVRGTFDWNLQFKWDNVFSYEMDGPEGSTKPIRSPAMSGGIFAIRRHYFNEIGQYDKDMDFWGRENLELSLRIWMCGGQLFIIPCSRVGHISKKQTGKPSTIISAMTHNYLRLVHVWLDEYKEQFFLRKPGLKYVTYGNIRERVELRKRLGCKSFQWYLDNVFPELEASVNSL

SEQ ID NO: 1679 - protein, 349 aa, unidentified
MELAVGNLSEGNASWPEPPAPEPGPLFGIGVENFVTLVVFGLIFALGVLGNSLVITVLARSKPGKPRSTTNLFILNLSIADLAYLLFCIPFQATVYALPTWVLGAFICKFIHYFFTVSMLVSIFTLAAMSVDRYVAIVHSRRSSSLRVSRNALLGVGCIWALSIAMASPVAYHQGLFHPRASNQTFCWEQWPDPRHKKAYVVCTFVFGYLLPLLLICFCYAKVLNHLHKKLKNMSKKSEASKKKTAQTVLVVVVVFGISWLPHHIIHLWAEFGVFPLTPASFLFRITAHCLAYSNSSVNPIIYAFLSENFRKAYKQVFKCHIRKDSHLSDTKESKSRIDTPPSTNCTHV

SEQ ID NO: 1680 - protein, 387 aa, unidentified
MNVSGCPGAGNASQAGGGGGWHPEAVIVPLLFALIFLVGTVGNTLVLAVLLRGGQAVSTTNLFILNLGVADLCFILCCVPFQATIYTLDGWVFGSLLCKAVHFLIFLTMHASSFTLAAVSLDRYLAIRYPLHSRELRTPRNALAAIGLIWGLSLLFSGPYLSYYRQSQLANLTVCHPAWSAPRRRAMDICTFVFSYLLPVLVLGLTYARTLRYLWRAVDPVAAGSGARRAKRKVTRMILIVAALFCLCWMPHHALILCVWFGQFPLTRATYALRILSHLVSYANSCVNPIVYALVSKHFRKGFRTICAGLLGRAPGRASGRVCAAARGTHSGSVLERESSDLLHMSEAAGALRPCPGASQPCILEPCPGPSWQGPKAGDSILTVDVA

SEQ ID NO: 1681 - protein, 368 aa, unidentified
MADAQNISLDSPGSVGAVAVPVVFALIFLLGTVGNGLVLAVLLQPGPSAWQEPGSTTDLFILNLAVADLCFILCCVPFQATIYTLDAWLFGALVCKAVHLLIYLTMYASSFTLAAVSVDRYLAVRHPLRSRALRTPRNARAAVGLVWLLAALFSAPYLSYYGTVRYGALELCVPAWEDARRRALDVATFAAGYLLPVAVVSLAYGRTLRFLWAAVGPAGAAAAEARRRATGRAGRAMLAVAALYALCWGPHHALILCFWYGRFAFSPATYACRLASHCLAYANSCLNPLVYALASRHFRARFRRLWPCGRRRRHRARRALRRVRPASSGPPGCPGDARPSGRLLAGGGQGPEPREGPVHGGEAARGPE

SEQ ID NO: 1682 - protein, 477 aa, unidentified
MPPCQPQRPLLLLLLLLACQPQVPSAQVMDFLFEKWKLYGDQCHHNLSLLPPPTELVCNRTFDKYSCWPDTPANTTANISCPWYLPWHHKVQHRFVFKRCGPDGQWVRGPRGQPWRDASQCQMDGEEIEVQKEVAKMYSSFQVMYTVGYSLSLGALLLALAILGGLSKLHCTRNAIHANLFASFVLKASSVLVIDGLLRTRYSQKIGDDLSVSTWLSDGAVAGCRVAAVFMQYGIVANYCWLLVEGLYLHNLLGLATLPERSFFSLYLGIGWGAPMLFVVPWAVVKCLFENVQCWTSNDNMGFWWILRFPVFLAILINFFIFVRIVQLLVAKLRARQMHHTDYKFRLAKSTLTLIPLLGVHEVVFAFVTDEHAQGTLRSAKLFFDLFLSSFQGLLVAVLYCFLNKEVQSELRRRWHRWRLGKVLWEERNTSNHRASSSPGHGPPSKELQFGRGGGSQDSSAETPLAGGLPRLAESPF

SEQ ID NO: 1683 - protein, 637 aa, unidentified
MGLLSQGSPLSWEETKRHADHVRRHGILQFLHIYHAVKDRHKDVLKWGDEVEYMLVSFDHENKKVRLVLSGEKVLETLQEKGERTNPNHPTLWRPEYGSYMIEGTPGQPYGGTMSEFNTVEANMRKRRKEATSILEENQALCTITSFPRLGCPGFTLPEVKPNPVEGGASKSLFFPDEAINKHPRFSTLTRNIRHRRGEKVVINVPIFKDKNTPSPFIETFTEDDEASRASKPDHIYMDAMGFGMGNCCLQVTFQACSISEARYLYDQLATICPIVMALSAASPFYRGYVSDIDCRWGVISASVDDRTREERGLEPLKNNNYRISKSRYDSIDSYLSKCGEKYNDIDLTIDKEIYEQLLQEGIDHLLAQHVAHLFIRDPLTLFEEKIHLDDANESDHFENIQSTNWQTMRFKPPPPNSDIGWRVEFRPMEVQLTDFENSAYVVFVVLLTRVILSYKLDFLIPLSKVDENMKVAQKRDAVLQGMFYFRKDICKGGNAVVDGCGKAQNSTELAAEEYTLMSIDTIINGKEGVFPGLIPILNSYLENMEVDVDTRCSILNYLKLIKKRASGELMTVARWMREFIANHPDYKQDSVITDEMNYSLILKCNQIANELCECPELLGSAFRKVKYSGSKTDSSN

SEQ ID NO: 1684 - protein, 402 aa, unidentified
MMGSWKHCLFSASLISALIFVFVYNTELWENKRFLRAALSNASLLAEACHQIFEGKVFYPTENALKTTLDEATCYEYMVRSHYVTETLSEEEAGFPLAYTVTIHKDFGTFERLFRAIYMPQNVYCVHLDQKATDAFKGAVKQLLSCFPNAFLASKKESVVYGGISRLQADLNCLEDLVASEVPWKYVINTCGQDFPLKTNREIVQYLKGFKGKNITPGVLPPDHAVGRTKYVHQELLNHKNSYVIKTTKLKTPPPHDMVIYFGTAYVALTRDFANFVLQDQLALDLLSWSKDTYSPDEHFWVTLNRIPGVPGSMPNASWTGNLRAIKWSDMEDRHGGCHGHYVHGICIYGNGDLKWLVNSPSLFANKFELNTYPLTVECLELRHRERTLNQSETAIQPSWYF

SEQ ID NO: 1685 - protein, 438 aa, unidentified
MVQWKRLCQLHYLWALGCYMLLATVALKLSFRLKCDSDHLGLESRESQSQYCRNILYNFLKLPAKRSINCSGVTRGDQEAVLQAILNNLEVKKKREPFTDTHYLSLTRDCEHFKAERKFIQFPLSKEEVEFPIAYSMVIHEKIENFERLLRAVYAPQNIYCVHVDEKSPETFKEAVKAIISCFPNVFIASKLVRVVYASWSRVQADLNCMEDLLQSSVPWKYFLNTCGTDFPIKSNAEMVQALKMLNGRNSMESEVPPKHKETRWKYHFEVVRDTLHLTNKKKDPPPYNLTMFTGNAYIVASRDFVQHVLKNPKSQQLIEWVKDTYSPDEHLWATLQRARWMPGSVPNHPKYDISDMTSIARLVKWQGHEGDIDKGAPYAPCSGIHQRAICVYGAGDLNWMLQNHHLLANKFDPKVDDNALQCLEEYLRYKAIYGTEL

SEQ ID NO: 1686 - protein, 358 aa, unidentified
MAERQEEQRGSPPLRAEGKADAEVKLILYHWTHSFSSQKVRLVIAEKALKCEEHDVSLPLSEHNEPWFMRLNSTGEVPVLIHGENIICEATQIIDYLEQTFLDERTPRLMPDKESMYYPRVQHYRELLDSLPMDAYTHGCILHPELTVDSMIPAYATTRIRSQIGNTESELKKLAEENPDLQEAYIAKQKRLKSKLLDHDNVKYLKKILDELEKVLDQVETELQRRNEETPEEGQQPWLCGESFTLADVSLAVTLHRLKFLGFARRNWGNGKRPNLETYYERVLKRKTFNKVLGHVNNILISAVLPTAFRVAKKRAPKVLGTTLVVGLLAGVGYFAFMLFRKRLGSMILAFRPRPNYF

SEQ ID NO: 1687 - protein, 367 aa, unidentified
MATPNNLTPTNCSWWPISALESDAAKPAEAPDAPEAASPAHWPRESLVLYHWTQSFSSQKVRLVIAEKGLVCEERDVSLPQSEHKEPWFMRLNLGEEVPVIIHRDNIISDYDQIIDYVERTFTGEHVVALMPEVGSLQHARVLQYRELLDALPMDAYTHGCILHPELTTDSMIPKYATAEIRRHLANATTDLMKLDHEEEPQLSEPYLSKQKKLMAKILEHDDVSYLKKILGELAMVLDQIEAELEKRKLENEGQKCELWLCGCAFTLADVLLGATLHRLKFLGLSKKYWEDGSRPNLQSFFERVQRRFAFRKVLGDIHTTLLSAVIPNAFRLVKRKPPSFFGASFLMGSLGGMGYFAYWYLKKKYI

SEQ ID NO: 1688 - protein, 331 aa, unidentified
MWLWEDQGGLLGPFSFLLLVLLLVTRSPVNACLLTGSLFVLLRVFSFEPVPSCRALQVLKPRDRISAIAHRGGSHDAPENTLAAIRQAAKNGATGVELDIEFTSDGIPVLMHDNTVDRTTDGTGRLCDLTFEQIRKLNPAANHRLRNDFPDEKIPTLREAVAECLNHNLTIFFDVKGHAHKATEALKKMYMEFPQLYNNSVVCSFLPEVIYKMRQTDRDVITALTHRPWSLSHTGDGKPRYDTFWKHFIFVMMDILLDWSMHNILWYLCGISAFLMQKDFVSPAYLKKWSAKGIQVVGWTVNTFDEKSYYESHLGSSYITDSMVEDCEPHF

SEQ ID NO: 1689 - protein, 314 aa, unidentified
MSSTAAFYLLSTLGGYLVTSFLLLKYPTLLHQRKKQRFLSKHISHRGGAGENLENTMAAFQHAVKIGTDMLELDCHITKDEQVVVSHDENLKRATGVNVNISDLKYCELPPYLGKLDVSFQRACQCEGKDNRIPLLKEVFEAFPNTPINIDIKVNNNVLIKKVSELVKRYNREHLTVWGNANYEIVEKCYKENSDIPILFSLQRVLLILGLFFTGLLPFVPIREQFFEIPMPSIILKLKEPHTMSRSQKFLIWLSDLLLMRKALFDHLTARGIQVYIWVLNEEQEYKRAFDLGATGVMTDYPTKLRDFLHNFSA

SEQ ID NO: 1690 - protein, 539 aa, unidentified
MAESPGCCSVWARCLHCLYSCHWRKCPRERMQTSKCDCIWFGLLFLTFLLSLSWLYIGLVLLNDLHNFNEFLFRRWGHWMDWSLAFLLVISLLVTYASLLLVLALLLRLCRQPLHLHSLHKVLLLLIMLLVAAGLVGLDIQWQQEWHSLRVSLQATAPFLHIGAAAGIALLAWPVADTFYRIHRRGPKILLLLLFFGVVLVIYLAPLCISSPCIMEPRDLPPKPGLVGHRGAPMLAPENTLMSLRKTAECGATVFETDVMVSSDGVPFLMHDEHLSRTTNVASVFPTRITAHSSDFSWTELKRLNAGSWFLERRPFWGAKPLAGPDQKEAESQTVPALEELLEEAAALNLSIMFDLRRPPQNHTYYDTFVIQTLETVLNARVPQAMVFWLPDEDRANVQRRAPGMRQIYGRQGGNRTERPQFLNLPYQDLPLLDIKALHKDNVSVNLFVVNKPWLFSLLWCAGVDSVTTNDCQLLQQMRYPIWLITPQTYLIIWVITNCVSTMLLLWTFLLQRRFVKKRGKTGLETAVLLTRINNFMME

SEQ ID NO: 1691 - protein, 318 aa, unidentified
MSLLLYYALPALGSYAMLSIFFLRRPHLLHTPRAPTFRIRLGAHRGGSGELLENTMEAMENSMAQRSDLLELDCQLTRDRVVVVSHDENLCRQSGLNRDVGSLDFEDLPLYKEKLEVYFSPGHFAHGSDRRMVRLEDLFQRFPRTPMSVEIKGKNEELIREIAGLVRRYDRNEITIWASEKSSVMKKCKAANPEMPLSFTISRGFWVLLSYYLGLLPFIPIPEKFFFCFLPNIINRTYFPFSCSCLNQLLAVVSKWLIMRKSLIRHLEERGVQVVFWCLNEESDFEAAFSVGATGVITDYPTALRHYLDNHGPAARTS

SEQ ID NO: 1692 - protein, 623 aa, unidentified
MLLFLWIETSSEYFNFDWVTFLGTGYWFFWSIFILSLARILTAYSSLLLLLGFLLLWERIELYLHLCHKILILLVILLCVILMFIICKFWKERWLVAGLSMQIFAPYVHLVSITVMVILFWPVAFYVACLEREVRMRRYRMTHSEKKRLKQCNVITRLRGLQVPVGLPFLLILLGLYLMPLGIYSPCIQEKENLGPKPTIFGHRGAPMLGPENTMMSFEKAVEHGAHGLETDIHLSYDHVPFLMHDFDLKRTTNIGEVQPESACENPAFFNWDFLSTLNAGKWFVKPELRPFYNMKPLSEADKERARNQSIPTLADLLTLAEKERKFVIFDLHRPPPKHPLRHTFVRQVVSVILASKIEQHLIFWLPAHDRQYVRSVAPGFQHVGRLVSIETLAKNNISIINVDYKKLFPNGLRDYKAANIHINVYTVNEPWLFSLAWCSRINSVTTDNIGLLSQLDHPHFFMTPKFYVFMWLLADIISVLFIVAIFCFHWRRETEKEKLFETSSTRTDTQSGNLHIAMKPPVRVVEGPWTLAALYPALPKSGKEHQGHFNFAAPSKKLLPIKNAVTPLKPGKHEIQPPMPTVVFELTQAPTRQATSEATFQTTLPTLKVDKPTMPSIEVPYP

SEQ ID NO: 1693 - protein, 605 aa, unidentified
MVRHQPLQYYEPQLCLSCLTGIYGCRWKRYQRSHDDTTPWERLWFLLLTFTFGLTLTWLYFWWEVHNDYDEFNWYLYNRMGYWSDWPVPILVTTAAAFAYIAGLLVLALCHIAVGQQMNLHWLHKIGLVVILASTVVAMSAVAQLWEDEWEVLLISLQGTAPFLHVGAVAAVTMLSWIVAGQFARAERTSSQVTILCTFFTVVFALYLAPLTISSPCIMEKKDLGPKPALIGHRGAPMLAPEHTLMSFRKALEQKLYGLQADITISLDGVPFLMHDTTLRRTTNVEEEFPELARRPASMLNWTTLQRLNAGQWFLKTDPFWTASSLSPSDHREAQNQSICSLAELLELAKGNATLLLNLRDPPREHPYRSSFINVTLEAVLHSGFPQHQVMWLPSRQRPLVRKVAPGFQQTSGSKEAVASLRRGHIQRLNLRYTQVSRQELRDYASWNLSVNLYTVNAPWLFSLLWCAGVPSVTSDNSHALSQVPSPLWIMPPDEYCLMWVTADLVSFTLIVGIFVLQKWRLGGIRSYNPEQIMLSAAVRRTSRDVSIMKEKLIFSEISDGVEVSDVLSVCSDNSYDTYANSTATPVGPRGGGSHTKTLIERSGR

SEQ ID NO: 1694 - protein, 699 aa, unidentified
MCGIFAYLNYHVPRTRREILETLIKGLQRLEYRGYDSAGVGFDGGNDKDWEANACKIQLIKKKGKVKALDEEVHKQQDMDLDIEFDVHLGIAHTRWATHGEPSPVNSHPQRSDKNNEFIVIHNGIITNYKDLKKFLESKGYDFESETDTETIAKLVKYMYDNRESQDTSFTTLVERVIQQLEGAFALVFKSVHFPGQAVGTRRGSPLLIGVRSEHKLSTDHIPILYRTARTQIGSKFTRWGSQGERGKDKKGSCNLSRVDSTTCLFPVEEKAVEYYFASDASAVIEHTNRVIFLEDDDVAAVVDGRLSIHRIKRTAGDHPGRAVQTLQMELQQIMKGNFSSFMQKEIFEQPESVVNTMRGRVNFDDYTVNLGGLKDHIKEIQRCRRLILIACGTSYHAGVATRQVLEELTELPVMVELASDFLDRNTPVFRDDVCFFLSQSGETADTLMGLRYCKERGALTVGITNTVGSSISRETDCGVHINAGPEIGVASTKAYTSQFVSLVMFALMMCDDRISMQERRKEIMLGLKRLPDLIKEVLSMDDEIQKLATELYHQKSVLIMGRGYHYATCLEGALKIKEITYMHSEGILAGELKHGPLALVDKLMPVIMIIMRDHTYAKCQNALQQVVARQGRPVVICDKEDTETIKNTKRTIKVPHSVDCLQGILSVIPLQLLAFHLAVLRGYDVDFPRNLAKSVTVE

SEQ ID NO: 1695 - protein, 682 aa, unidentified
MCGIFAYMNYRVPRTRKEIFETLIKGLQRLEYRGYDSAGVAIDGNNHEVKERHIQLVKKRGKVKALDEELYKQDSMDLKVEFETHFGIAHTRWATHGVPSAVNSHPQRSDKGNEFVVIHNGIITNYKDLRKFLESKGYEFESETDTETIAKLIKYVFDNRETEDITFSTLVERVIQQLEGAFALVFKSVHYPGEAVATRRGSPLLIGVRSKYKLSTEQIPILYRTCTLENVKNICKTRMKRLDSSACLHAVGDKAVEFFFASDASAIIEHTNRVIFLEDDDIAAVADGKLSIHRVKRSASDDPSRAIQTLQMELQQIMKGNFSAFMQKEIFEQPESVFNTMRGRVNFETNTVLLGGLKDHLKEIRRCRRLIVIGCGTSYHAAVATRQVLEELTELPVMVELASDFLDRNTPVFRDDVCFFISQSGETADTLLALRYCKDRGALTVGVTNTVGSSISRETDCGVHINAGPEIGVASTKAYTSQFISLVMFGLMMSEDRISLQNRRQEIIRGLRSLPELIKEVLSLEEKIHDLALELYTQRSLLVMGRGYNYATCLEGALKIKEITYMHSEGILAGELKHGPLALIDKQMPVIMVIMKDPCFAKCQNALQQVTARQGRPIILCSKDDTESSKFAYKTIELPHTVDCLQGILSVIPLQLLSFHLAVLRGYDVDFPRNLAKSVTVE

SEQ ID NO: 1696 - protein, 465 aa, unidentified
MFLATLYFALPLLDLLLSAEVSGGDRLDCVKASDQCLKEQSCSTKYRTLRQCVAGKETNFSLASGLEAKDECRSAMEALKQKSLYNCRCKRGMKKEKNCLRIYWSMYQSLQGNDLLEDSPYEPVNSRLSDIFRVVPFISDVFQQVEHIPKGNNCLDAAKACNLDDICKKYRSAYITPCTTSVSNDVCNRRKCHKALRQFFDKVPAKHSYGMLFCSCRDIACTERRRQTIVPVCSYEEREKPNCLNLQDSCKTNYICRSRLADFFTNCQPESRSVSSCLKENYADCLLAYSGLIGTVMTPNYIDSSSLSVAPWCDCSNSGNDLEECLKFLNFFKDNTCLKNAIQAFGNGSDVTVWQPAFPVQTTTATTTTALRVKNKPLGPAGSENEIPTHVLPPCANLQAQKLKSNVSGNTHLCISNGNYEKEGLGASSHITTKSMAAPPSCGLSPLLVLVVTALSTLLSLTETS

SEQ ID NO: 1697 - protein, 400 aa, unidentified
MVRPLNPRPLPPVVLMLLLLLPPSPLPLAAGDPLPTESRLMNSCLQARRKCQADPTCSAAYHHLDSCTSSISTPLPSEEPSVPADCLEAAQQLRNSSLIGCMCHRRMKNQVACLDIYWTVHRARSLGNYELDVSPYEDTVTSKPWKMNLSKLNMLKPDSDLCLKFAMLCTLNDKCDRLRKAYGEACSGPHCQRHVCLRQLLTFFEKAAEPHAQGLLLCPCAPNDRGCGERRRNTIAPNCALPPVAPNCLELRRLCFSDPLCRSRLVDFQTHCHPMDILGTCATEQSRCLRAYLGLIGTAMTPNFVSNVNTSVALSCTCRGSGNLQEECEMLEGFFSHNPCLTEAIAAKMRFHSQLFSQDWPHPTFAVMAHQNENPAVRPQPWVPSLFSCTLPLILLLSLW

SEQ ID NO: 1698 - protein, 394 aa, unidentified
MIVFIFLAMGLSLENEYTSQTNNCTYLREQCLRDANGCKHAWRVMEDACNDSDPGDPCKMRNSSYCNLSIQYLVESNFQFKECLCTDDFYCTVNKLLGKKCINKSDNVKEDKFKWNLTTRSHHGFKGMWSCLEVAEACVGDVVCNAQLASYLKACSANGNPCDLKQCQAAIRFFYQNIPFNIAQMLAFCDCAQSDIPCQQSKEALHSKTCAVNMVPPPTCLSVIRSCQNDELCRRHYRTFQSKCWQRVTRKCHEDENCISTLSKQDLTCSGSDDCKAAYIDILGTVLQVQCTCRTITQSEESLCKIFQHMLHRKSCFNYPTLSNVKGMALYTRKHANKITLTGFHSPFNGEVIYAAMCMTVTCGILLLVMVKLRTSRISSKARDPSSIQIPGEL

SEQ ID NO: 1699 - protein, 758 aa, unidentified
MAVSAGSARTSPSSDKVQKDKAELISGPRQDSRIGKLLGFEWTDLSSWRRLVTLLNRPTDPASLAVFRFLFGFLMVLDIPQERGLSSLDRKYLDGLDVCRFPLLDALRPLPLDWMYLVYTIMFLGALGMMLGLCYRISCVLFLLPYWYVFLLDKTSWNNHSYLYGLLAFQLTFMDANHYWSVDGLLNAHRRNAHVPLWNYAVLRGQIFIVYFIAGVKKLDADWVEGYSMEYLSRHWLFSPFKLLLSEELTSLLVVHWGGLLLDLSAGFLLFFDVSRSIGLFFVSYFHCMNSQLFSIGMFSYVMLASSPLFCSPEWPRKLVSYCPRRLQQLLPLKAAPQPSVSCVYKRSRGKSGQKPGLRHQLGAAFTLLYLLEQLFLPYSHFLTQGYNNWTNGLYGYSWDMMVHSRSHQHVKITYRDGRTGELGYLNPGVFTQSRRWKDHADMLKQYATCLSRLLPKYNVTEPQIYFDIWVSINDRFQQRIFDPRVDIVQAAWSPFQRTSWVQPLLMDLSPWRAKLQEIKSSLDNHTEVVFIADFPGLHLENFVSEDLGNTSIQLLQGEVTVELVAEQKNQTLREGEKMQLPAGEYHKVYTTSPSPSCYMYVYVNTTELALEQDLAYLQELKEKVENGSETGPLPPELQPLLEGEVKGGPEPTPLVQTFLRRQQRLQEIERRRNTPFHERFFRFLLRKLYVFRRSFLMTCISLRNLILGRPSLEQLAQEVTYANLRPFEAVGELNPSNTDSSHSNPPESNPDPVHSEF

SEQ ID NO: 1700 - protein, 569 aa, unidentified
MKKKLVVLGLLAVVLVLVIVGLCLWLPSASKEPDNHVYTRAAVAADAKQCSKIGRDALRDGGSAVDAAIAALLCVGLMNAHSMGIGGGLFLTIYNSTTRKAEVINAREVAPRLAFATMFNSSEQSQKGGLSVAVPGEIRGYELAHQRHGRLPWARLFQPSIQLARQGFPVGKGLAAALENKRTVIEQQPVLCEVFCRDRKVLREGERLTLPQLADTYETLAIEGAQAFYNGSLTAQIVKDIQAAGGIVTAEDLNNYRAELIEHPLNISLGDVVLYMPSAPLSGPVLALILNILKGYNFSRESVESPEQKGLTYHRIVEAFRFAYAKRTLLGDPKFVDVTEVVRNMTSEFFAAQLRAQISDDTTHPISYYKPEFYTPDDGGTAHLSVVAEDGSAVSATSTINLYFGSKVRSPVSGILFNNEMDDFSSPSITNEFGVPPSPANFIQPGKQPLSSMCPTIMVGQDGQVRMVVGAAGGTQITTATALAIIYNLWFGYDVKRAVEEPRLHNQLLPNVTTVERNIDQAVTAALETRHHHTQIASTFIAVVQAIVRTAGGWAAASDSRKGGEPAGY

SEQ ID NO: 1701 - protein, 493 aa, unidentified
MERAEEPVVYQKLLPWEPSLESEEEVEEEETSEALVLNPRRHQDSSRNKAGGLPGTWARVVAALLLLAVGCSLAVRQLQNQGRSTGSLGSVAPPPGGHSHGPGVYHHGAIISPAGRELLVAGGNVVDAGVGAALCLAVVHPHATGLGAMFWGLFHDSSSGNSTALTSGPAQTLAPGLGLPAALPTLHLLHARFGRLPWPRLLVGPTTLAQEGFLVDTPLARALVARGTEGLCPLLCHADGTPLGAGARATNPQLAAVLRSAALAPTSDLAGDALLSLLAGDLGVEVPSAVPRPTLEPAEQLPVPQGILFTTPSPSAGPELLALLEAALRSGAPIPDPCPPFLQTAVSPESSALAAVDSSGSVLLLTSSLNCSFGSAHLSPSTGVLLSNLVAKSTTSAWACPLILRGSLDDTEADVLGLVASGTPDVARAMTHTLLRHLAARPPTQAQHQHQGQQEPTEHPSTCGQGTLLQVAAHTEHAHVSSVPHACCPFQGF

SEQ ID NO: 1702 - protein, 662 aa, unidentified
MAAENEASQESALGAYSPVDYMSITSFPRLPEDEPAPAAPLRGRKDEDAFLGDPDTDPDSFLKSARLQRLPSSSSEMGSQDGSPLRETRKDPFSAAAAECSCRQDGLTVIVTACLTFATGVTVALVMQIYFGDPQIFQQGAVVTDAARCTSLGIEVLSKQGSSVDAAVAAALCLGIVAPHSSGLGGGGVMLVHDIRRNESHLIDFRESAPGALREETLQRSWETKPGLLVGVPGMVKGLHEAHQLYGRLPWSQVLAFAAAVAQDGFNVTHDLARALAEQLPPNMSERFRETFLPSGRPPLPGSLLHRPDLAEVLDVLGTSGPAAFYAGGNLTLEMVAEAQHAGGVITEEDFSNYSALVEKPVCGVYRGHLVLSPPPPHTGPALISALNILEGFNLTSLVSREQALHWVAETLKIALALASRLGDPVYDSTITESMDDMLSKVEAAYLRGHINDSQAAPAPLLPVYELDGAPTAAQVLIMGPDDFIVAMVSSLNQPFGSGLITPSGILLNSQMLDFSWPNRTANHSAPSLENSVQPGKRPLSFLLPTVVRPAEGLCGTYLALGANGAARGLSGLTQVLLNVLTLNRNLSDSLARGRLHPDLQSNLLQVDSEFTEEEIEFLEARGHHVEKVDVLSWVHGSRRTNNFIIAVKDPRSPDAAGATIL

SEQ ID NO: 1703 - protein, 345 aa, unidentified
MLAARLVCLRTLPSRVFHPAFTKASPVVKNSITKNQWLLTPSREYATKTRIGIRRGRTGQELKEAALEPSMEKIFKIDQMGRWFVAGGAAVGLGALCYYGLGLSNEIGAIEKAVIWPQYVKDRIHSTYMYLAGSIGLTALSAIAISRTPVLMNFMMRGSWVTIGVTFAAMVGAGMLVRSIPYDQSPGPKHLAWLLHSGVMGAVVAPLTILGGPLLIRAAWYTAGIVGGLSTVAMCAPSEKFLNMGAPLGVGLGLVFVSSLGSMFLPPTTVAGATLYSVAMYGGLVLFSMFLLYDTQKVIKRAEVSPMYGVQKYDPINSMLSIYMDTLNIFMRVATMLATGGNRKK

SEQ ID NO: 1704 - protein, 638 aa, unidentified
MDLWQLLLTLALAGSSDAFSGSEATAAILSRAPWSLQSVNPGLKTNSSKEPKFTKCRSPERETFSCHWTDEVHHGTKNLGPIQLFYTRRNTQEWTQEWKECPDYVSAGENSCYFNSSFTSIWIPYCIKLTSNGGTVDEKCFSVDEIVQPDPPIALNWTLLNVSLTGIHADIQVRWEAPRNADIQKGWMVLEYELQYKEVNETKWKMMDPILTTSVPVYSLKVDKEYEVRVRSKQRNSGNYGEFSEVLYVTLPQMSQFTCEEDFYFPWLLIIIFGIFGLTVMLFVFLFSKQQRIKMLILPPVPVPKIKGIDPDLLKEGKLEEVNTILAIHDSYKPEFHSDDSWVEFIELDIDEPDEKTEESDTDRLLSSDHEKSHSNLGVKDGDSGRTSCCEPDILETDFNANDIHEGTSEVAQPQRLKGEADLLCLDQKNQNNSPYHDACPATQQPSVIQAEKNKPQPLPTEGAESTHQAAHIQLSNPSSLSNIDFYAQVSDITPAGSVVLSPGQKNKAGMSQCDMHPEMVSLCQENFLMDNAYFCEADAKKCIPVAPHIKVESHIQPSLNQEDIYITTESLTTAAGRPGTGEHVPGSEMPVPDYTSIHIVQSPQGLILNATALPLPDKEFLSSCGYVSTDQLNKIMP

SEQ ID NO: 1705 - protein, 423 aa, unidentified
MDRRMWGAHVFCVLSPLPTVLGHMHPECDFITQLREDESACLQAAEEMPNTTLGCPATWDGLLCWPTAGSGEWVTLPCPDFFSHFSSESGAVKRDCTITGWSEPFPPYPVACPVPLELLAEEESYFSTVKIIYTVGHSISIVALFVAITILVALRRLHCPRNYVHTQLFTTFILKAGAVFLKDAALFHSDDTDHCSFSTVLCKVSVAASHFATMTNFSWLLAEAVYLNCLLASTSPSSRRAFWWLVLAGWGLPVLFTGTWVSCKLAFEDIACWDLDDTSPYWWIIKGPIVLSVGVNFGLFLNIIRILVRKLEPAQGSLHTQSQYWRLSKSTLFLIPLFGIHYIIFNFLPDNAGLGIRLPLELGLGSFQGFIVAILYCFLNQEVRTEISRKWHGHDPELLPAWRTRAKWTTPSRSAAKVLTSMC

SEQ ID NO: 1706 - protein, 366 aa, unidentified
MWNATPSEEPGFNLTLADLDWDASPGNDSLGDELLQLFPAPLLAGVTATCVALFVVGIAGNLLTMLVVSRFRELRTTTNLYLSSMAFSDLLIFLCMPLDLVRLWQYRPWNFGDLLCKLFQFVSESCTYATVLTITALSVERYFAICFPLRAKVVVTKGRVKLVIFVIWAVAFCSAGPIFVLVGVEHENGTDPWDTNECRPTEFAVRSGLLTVMVWVSSIFFFLPVFCLTVLYSLIGRKLWRRRRGDAVVGASLRDQNHKQTVKMLAVVVFAFILCWLPFHVGRYLFSKSFEPGSLEIAQISQYCNLVSFVLFYLSAAINPILYNIMSKKYRVAVFRLLGFEPFSQRKLSTLKDESSRAWTESSINT

SEQ ID NO: 1707 - protein, 306 aa, unidentified
MGGRKMATDEENVYGLEENAQSRQESTRRLILVGRTGAGKSATGNSILGQRRFFSRLGATSVTRACTTGSRRWDKCHVEVVDTPDIFSSQVSKTDPGCEERGHCYLLSAPGPHALLLVTQLGRFTAQDQQAVRQVRDMFGEDVLKWMVIVFTRKEDLAGGSLHDYVSNTENRALRELVAECGGRVCAFDNRATGREQEAQVEQLLGMVEGLVLEHKGAHYSNEVYELAQVLRWAGPEERLRRVAERVAARVQRRPWGAWLSARLWKWLKSPRSWRLGLALLLGGALLFWVLLHRRWSEAVAEVGPD

SEQ ID NO: 1708 - protein, 337 aa, unidentified
MDQNEHSHWGPHAKGQCASRSELRIILVGKTGTGKSAAGNSILRKQAFESKLGSQTLTKTCSKSQGSWGNREIVIIDTPDMFSWKDHCEALYKEVQRCYLLSAPGPHVLLLVTQLGRYTSQDQQAAQRVKEIFGEDAMGHTIVLFTHKEDLNGGSLMDYMHDSDNKALSKLVAACGGRICAFNNRAEGSNQDDQVKELMDCIEDLLMEKNGDHYTNGLYSLIQRSKCGPVGSDERVKEFKQSLIKYMETQRSYTALAEANCLKGALIKTQLCVLFCIQLFLRLIILWLCILHSMCNLFCCLLFSMCNLFCSLLFIIPKKLMIFLRTVIRLERKTPRL

SEQ ID NO: 1709 - protein, 307 aa, unidentified
MGGFQRGKYGTMAEGRSEDNLSATPPALRIILVGKTGCGKSATGNSILGQPVFESKLRAQSVTRTCQVKTGTWNGRKVLVVDTPSIFESQADTQELYKNIGDCYLLSAPGPHVLLLVIQLGRFTAQDTVAIRKVKEVFGTGAMRHVVILFTHKEDLGGQALDDYVANTDNCSLKDLVRECERRYCAFNNWGSVEEQRQQQAELLAVIERLGREREGSFHSNDLFLDAQLLQRTGAGACQEDYRQYQAKVEWQVEKHKQELRENESNWAYKALLRVKHLMLLHYEIFVFLLLCSILFFIIFLFIFHYI

SEQ ID NO: 1710 - protein, 330 aa, unidentified
MEGAPPGSLALRLLLFVALPASGWLTTGAPEPPPLSGAPQDGIRINVTTLKDDGDISKQQVVLNITYESGQVYVNDLPVNSGVTRISCQTLIVKNENLENLEEKEYFGIVSVRILVHEWPMTSGSSLQLIVIQEEVVEIDGKQVQQKDVTEIDILVKNRGVLRHSNYTLPLEESMLYSISRDSDILFTLPNLSKKESVSSLQTTSQYLIRNVETTVDEDVLPGKLPETPLRAEPPSSYKVMCQWMEKFRKDLCRFWSNVFPVFFQFLNIMVVGITGAAVVITILKVFFPVSEYKGILQLDKVDVIPVTAINLYPDGPEKRAENLEDKTCI

SEQ ID NO: 1711 - protein, 466 aa, unidentified
MTTSPILQLLLRLSLCGLLLQRAETGSKGQTAGELYQRWERYRRECQETLAAAEPPSGLACNGSFDMYVCWDYAAPNATARASCPWYLPWHHHVAAGFVLRQCGSDGQWGLWRDHTQCENPEKNEAFLDQRLILERLQVMYTVGYSLSLATLLLALLILSLFRRLHCTRNYIHINLFTSFMLRAAAILSRDRLLPRPGPYLGDQALALWNQALAACRTAQIVTQYCVGANYTWLLVEGVYLHSLLVLVGGSEEGHFRYYLLLGWGAPALFVIPWVIVRYLYENTQCWERNEVKAIWWIIRTPILMTILINFLIFIRILGILLSKLRTRQMRCRDYRLRLARSTLTLVPLLGVHEVVFAPVTEEQARGALRFAKLGFEIFLSSFQGFLVSVLYCFINKEVQSEIRRGWHHCRLRRSLGEEQRQLPERAFRALPSGSGPGEVPTSRGLSSGTLPGPGNEASRELESYC

SEQ ID NO: 1712 - protein, 382 aa, unidentified
MGDWSALGKLLDKVQAYSTAGGKVWLSVLFIFRILLLGTAVESAWGDEQSAFRCNTQQPGCENVCYDKSFPISHVRFWVLQIIFVSVPTLLYLAHVFYVMRKEEKLNKKEEELKVAQTDGVNVDMHLKQIEIKKFKYGIEEHGKVKMRGGLLRTYIISILFKSIFEVAFLLIQWYIYGFSLSAVYTCKRDPCPHQVDCFLSRPTEKTIFIIFMLVVSLVSLALNIIELFYVFFKGVKDRVKGKSDPYHATSGALSPAKDCGSQKYAYFNGCSSPTAPLSPMSPPGYKLVTGDRNNSSCRNYNKQASEQNWANYSAEQNRMGQAGSTISNSHAQPFDFPDDNQNSKKLAAGHELQPLAIVDQRPSSRASSRASSRPRPDDLEI

SEQ ID NO: 1713 - protein, 543 aa, unidentified
MGDWNLLGGILEEVHSHSTIVGKIWLTILFIFRMLVLRVAAEDVWDDEQSAFACNTRQPGCNNICYDDAFPISLIRFWVLQIIFVSSPSLVYMGHALYRLRAFEKDRQRKKSHLRAQMENPDLDLEEQQRIDRELRRLEEQKRIHKVPLKGCLLRTYVLHILTRSVLEVGFMIGQYILYGFQMHPLYKCTQPPCPNAVDCFVSRPTEKTIFMLFMHSIAAISLLLNILEIFHLGIRKIMRTLYKKSSSEGIEDETGPPFHLKKYSVAQQCMICSSLPERISPLQANNQQQVIRVNVPKSKTMWQIPQPRQLEVDPSNGKKDWSEKDQHSGQLHVHSPCPWAGSAGNQHLGQQSDHSSFGLQNTMSQSWLGTTTAPRNCPSFAVGTWEQSQDPEPSGEPLTDLHSHCRDSEGSMRESGVWIDRSRPGSRKASFLSRLLSEKRHLHSDSGSSGSRNSSCLDFPHWENSPSPLPSVTGHRTSMVRQAALPIMELSQELFHSGCFLFPFFLPGVCMYVCVDREADGGGDYLWRDKIIHSIHSVKFNS

SEQ ID NO: 1714 - protein, 435 aa, unidentified
MGDWSFLGRLLENAQEHSTVIGKVWLTVLFIFRILVLGAAAEDVWGDEQSDFTCNTQQPGCENVCYDRAFPISHIRFWALQIIFVSTPTLIYLGHVLHIVRMEEKKKEREEEEQLKRESPSPKEPPQDNPSSRDDRGRVRMAGALLRTYVFNIIFKTLFEVGFIAGQYFLYGFELKPLYRCDRWPCPNTVDCFISRPTEKTIFIIFMLAVACASLLLNMLEIYHLGWKKLKQGVTSRLGPDASEAPLGTADPPPLPPSSRPPAVAIGFPPYYAHTAAPLGQARAVGYPGAPPPAADFKLLALTEARGKGQSAKLYNGHHHLLMTEQNWANQAAERQPPALKAYPAASTPAAPSPVGSSSPPLAHEAEAGAAPLLLDGSGSSLEGSALAGTPEEEEQAVTTAAQMHQPPLPLGDPGRASKASRASSGRARPEDLAI

SEQ ID NO: 1715 - protein, 333 aa, unidentified
MGDWGFLEKLLDQVQEHSTVVGKIWLTVLFIFRILILGLAGESVWGDEQSDFECNTAQPGCTNVCYDQAFPISHIRYWVLQFLFVSTPTLVYLGHVIYLSRREERLRQKEGELRALPAKDPQVERALAAVERQMAKISVAEDGRLRIRGALMGTYVASVLCKSVLEAGFLYGQWRLYGWTMEPVFVCQRAPCPYLVDCFVSRPTEKTIFIIFMLVVGLISLVLNLLELVHLLCRCLSRGMRARQGQDAPPTQGTSSDPYTDQVFFYLPVGQGPSSPPCPTYNGLSSSEQNWANLTTEERLASSRPPLFLDPPPQNGQKPPSRPSSSASKKQYV

SEQ ID NO: 1716 - protein, 433 aa, unidentified
MGDWSFLGNILEEVNEHSTVIGRVWLTVLFIFRILILGTAAEFVWGDEQSDFVCNTQQPGCENVCYDEAFPISHIRLWVLQIIFVSTPSLMYVGHAVHYVRMEEKRKSREAEELGQQAGTNGGPDQGSVKKSSGSKGTKKFRLEGTLLRTYICHIIFKTLFEVGFIVGHYFLYGFRILPLYRCSRWPCPNVVDCFVSRPTEKTIFILFMLSVASVSLFLNVMELGHLGLKGIRSALKRPVEQPLGEIPEKSLHSIAVSSIQKAKGYQLLEEEKIVSHYFPLTEVGMVETSPLPAKPFNQFEEKISTGPLGDLSRGYQETLPSYAQVGAQEVEGEGPPAEEGAEPEVGEKKEEAERLTTEEQEKVAVPEGEKVETPGVDKEGEKEEPQSEKVSKQGLPAEKTPSLCPELTTDDARPLSRLSKASSRARSDDLTV

SEQ ID NO: 1717 - protein, 515 aa, unidentified
MGDWNLLGDTLEEVHIHSTMIGKIWLTILFIFRMLVLGVAAEDVWNDEQSGFICNTEQPGCRNVCYDQAFPISLIRYWVLQVIFVSSPSLVYMGHALYRLRVLEEERQRMKAQLRVELEEVEFEMPRDRRRLEQELCQLEKRKLNKAPLRGTLLCTYVIHIFTRSVVEVGFMIGQYLLYGFHLEPLFKCHGHPCPNIIDCFVSRPTEKTIFLLFMQSIATISLFLNILEIFHLGFKKIKRGLWGKYKLKKEHNEFHANKAKQNVAKYQSTSANSLKRLPSAPDYNLLVEKQTHTAVYPSLNSSSVFQPNPDNHSVNDEKCILDEQETVLSNEISTLSTSCSHFQHISSNNNKDTHKIFGKELNGNQLMEKRETEGKDSKRNYYSRGHRSIPGVAIDGENNMRQSPQTVFSLPANCDWKPRWLRATWGSSTEHENRGSPPKGNLKGQFRKGTVRTLPPSQGDSQSLDIPNTADSLGGLSFEPGLVRTCNNPVCPPNHVVSLTNNLIGRRVPTDLQI

SEQ ID NO: 1718 - protein, 283 aa, unidentified
MNWTGLYTLLSGVNRHSTAIGRVWLSVIFIFRIMVLVVAAESVWGDEKSSFICNTLQPGCNSVCYDQFFPISHVRLWSLQLILVSTPALLVAMHVAHQQHIEKKMLRLEGHGDPLHLEEVKRHKVHISGTLWWTYVISVVFRLLFEAVFMYVFYLLYPGYAMVRLVKCDVYPCPNTVDCFVSRPTEKTVFTVFMLAASGICIILNVAEVVYLIIRACARRAQRRSNPPSRKGSGFGHRLSPEYKQNEINKLLSEQDGSLKDILRRSPGTGAGLAEKSDRCSAC

SEQ ID NO: 1719 - protein, 226 aa, unidentified
MDWGTLQTILGGVNKHSTSIGKIWLTVLFIFRIMILVVAAKEVWGDEQADFVCNTLQPGCKNVCYDHYFPISHIRLWALQLIFVSTPALLVAMHVAYRRHEKKRKFIKGEIKSEFKDIEEIKTQKVRIEGSLWWTYTSSIFFRVIFEAAFMYVFYVMYDGFSMQRLVKCNAWPCPNTVDCFVSRPTEKTVFTVFMIAVSGICILLNVTELCYLLIRYCSGKSKKPV

SEQ ID NO: 1720 - protein, 270 aa, unidentified
MDWKTLQALLSGVNKYSTAFGRIWLSVVFVFRVLVYVVAAERVWGDEQKDFDCNTKQPGCTNVCYDNYFPISNIRLWALQLIFVTCPSLLVILHVAYREERERRHRQKHGDQCAKLYDNAGKKHGGLWWTYLFSLIFKLIIEFLFLYLLHTLWHGFNMPRLVQCANVAPCPNIVDCYIARPTEKKIFTYFMVGASAVCIVLTICELCYLICHRVLRGLHKDKPRGGCSPSSSASRASTCRCHHKLVEAGEVDPDPGNNKLQASAPNLTPI

SEQ ID NO: 1721 - protein, 266 aa, unidentified
MNWAFLQGLLSGVNKYSTVLSRIWLSVVFIFRVLVYVVAAEEVWDDEQKDFVCNTKQPGCPNVCYDEFFPVSHVRLWALQLILVTCPSLLVVMHVAYREERERKHHLKHGPNAPSLYDNLSKKRGGLWWTYLLSLIFKAAVDAGFLYIFHRLYKDYDMPRVVACSVEPCPHTVDCYISRPTEKKVFTYFMVTTAAICILLNLSEVFYLVGKRCMEIFGPRHRRPRCRECLPDTCPPYVLSQGGHPEDGNSVLMKAGSAPVDAGGYP

SEQ ID NO: 1722 - protein, 273 aa, unidentified
MNWSIFEGLLSGVNKYSTAFGRIWLSLVFIFRVLVYLVTAERVWSDDHKDFDCNTRQPGCSNVCFDEFFPVSHVRLWALQLILVTCPSLLVVMHVAYREVQEKRHREAHGENSGRLYLNPGKKRGGLWWTYVCSLVFKASVDIAFLYVFHSFYPKYILPPVVKCHADPCPNIVDCFISKPSEKNIFTLFMVATAAICILLNLVELIYLVSKRCHECLAARKAQAMCTGHHPHGTTSSCKQDDLLSGDLIFLGSDSHPPLLPDRPRDHVKKTIL

SEQ ID NO: 1723 - protein, 261 aa, unidentified
MDWGTLHTFIGGVNKHSTSIGKVWITVIFIFRVMILVVAAQEVWGDEQEDFVCNTLQPGCKNVCYDHFFPVSHIRLWALQLIFVSTPALLVAMHVAYYRHETTRKFRRGEKRNDFKDIEDIKKQKVRIEGSLWWTYTSSIFFRIIFEAAFMYVFYFLYNGYHLPWVLKCGIDPCPNLVDCFISRPTEKTVFTIFMISASVICMLLNVAELCYLLLKVCFRRSKRAQTQKNHPNHALKESKQNEMNELISDSGQNAITGFPS

SEQ ID NO: 1724 - protein, 223 aa, unidentified
MSWMFLRDLLSGVNKYSTGTGWIWLAVVFVFRLLVYMVAAEHVWKDEQKEFECNSRQPGCKNVCFDDFFPISQVRLWALQLIMVSTPSLLVVLHVAYHEGREKRHRKKLYVSPGTMDGGLWYAYLISLIVKTGFEIGFLVLFYKLYDGFSVPYLIKCDLKPCPNTVDCFISKPTEKTIFILFLVITSCLCIVLNFIELSFLVLKCFIKCCLQKYLKKPQVLSV

SEQ ID NO: 1725 - protein, 396 aa, unidentified
MSWSFLTRLLEEIHNHSTFVGKIWLTVLIVFRIVLTAVGGESIYYDEQSKFVCNTEQPGCENVCYDAFAPLSHVRFWVFQIILVATPSVMYLGYAIHKIAKMEHGEADKKAARSKPYAMRWKQHRALEETEEDNEEDPMMYPEMELESDKENKEQSQPKPKHDGRRRIREDGLMKIYVLQLLARTVFEVGFLIGQYFLYGFQVHPFYVCSRLPCPHKIDCFISRPTEKTIFLLIMYGVTGLCLLLNIWEMLHLGFGTIRDSLNSKRRELEDPGAYNYPFTWNTPSAPPGYNIAVKPDQIQYTELSNAKIAYKQNKANTAQEQQYGSHEENLPADLEALQREIRMAQERLDLAVQAYSHQNNPHGPREKKAKVGSKAGSNKSTASSKSGDGKTSVWI

SEQ ID NO: 1726 - protein, 439 aa, unidentified
MTNMSWSFLTRLLEEIHNHSTFVGKVWLTVLVVFRIVLTAVGGEAIYSDEQAKFTCNTRQPGCDNVCYDAFAPLSHVRFWVFQIVVISTPSVMYLGYAVHRLARASEQERRRALRRRPGPRRAPRAHLPPPHAGWPEPADLGEEEPMLGLGEEEEEEETGAAEGAGEEAEEAGAEEACTKAVGADGKAAGTPGPTGQHDGRRRIQREGLMRVYVAQLVARAAFEVAFLVGQYLLYGFEVRPFFPCSRQPCPHVVDCFVSRPTEKTVFLLVMYVVSCLCLLLNLCEMAHLGLGSAQDAVRGRRGPPASAPAPAPRPPPCAFPAAAAGLACPPDYSLVVRAAERARAHDQNLANLALQALRDGAAAGDRDRDSSPCVGLPAASRGPPRAGAPASRTGSATSAGTVGEQGRPGTHERPGAKPRAGSEKGSASSRDGKTTVWI

SEQ ID NO: 1727 - protein, 279 aa, unidentified
MCGRFLRRLLAEESRRSTPVGRLLLPVLLGFRLVLLAASGPGVYGDEQSEFVCHTQQPGCKAACFDAFHPLSPLRFWVFQVILVAVPSALYMGFTLYHVIWHWELSGKGKEEETLIQGREGNTDVPGAGSLRLLWAYVAQLGARLVLEGAALGLQYHLYGFQMPSSFACRREPCLGSITCNLSRPSEKTIFLKTMFGVSGFCLLFTFLELVLLGLGRWWRTWKHKSSSSKYFLTSESTRRHKKATDSLPVVETKEQFQEAVPGRSLAQEKQRPVGPRDA

SEQ ID NO: 1728 - protein, 321 aa, unidentified
MGEWTILERLLEAAVQQHSTMIGRILLTVVVIFRILIVAIVGETVYDDEQTMFVCNTLQPGCNQACYDRAFPISHIRYWVFQIIMVCTPSLCFITYSVHQSAKQRERRYSTVFLALDRDPPESIGGPGGTGGGGSGGGKREDKKLQNAIVNGVLQNTENTSKETEPDCLEVKELTPHPSGLRTASKSKLRRQEGISRFYIIQVVFRNALEIGFLVGQYFLYGFSVPGLYECNRYPCIKEVECYVSRPTEKTVFLVFMFAVSGICVVLNLAELNHLGWRKIKLAVRGAQAKRKSIYEIRNKDLPRVSVPNFGRTQSSDSAYV

SEQ ID NO: 1729 - protein, 294 aa, unidentified
MGEWAFLGSLLDAVQLQSPLVGRLWLVVMLIFRILVLATVGGAVFEDEQEEFVCNTLQPGCRQTCYDRAFPVSHYRFWLFHILLLSAPPVLFVVYSMHRAGKEAGGAEAAAQCAPGLPEAQCAPCALRARRARRCYLLSVALRLLAELTFLGGQALLYGFRVAPHFACAGPPCPHTVDCFVSRPTEKTVFVLFYFAVGLLSALLSVAELGHLLWKGRPRAGERDNRCNRAHEEAQKLLPPPPPPPPPPALPSRRPGPEPCAPPAYAHPAPASLRECGSGRGKASPATGRRDLAI

SEQ ID NO: 1730 - protein, 370 aa, unidentified
MEGVDLLGFLIITLNCNVTMVGKLWFVLTMLLRMLVIVLAGRPVYQDEQERFVCNTLQPGCANVCYDVFSPVSHLRFWLIQGVCVLLPSAVFSVYVLHRGATLAALGPRRCPDPREPASGQRRCPRPFGERGGLQVPDFSAGYIIHLLLRTLLEAAFGALHYFLFGFLAPKKFPCTRPPCTGVVDCYVSRPTEKSLLMLFLWAVSALSFLLGLADLVCSLRRRMRRRPGPPTSPSIRKQSGASGHAEGRRTDEEGGREEEGAPAPPGARAGGEGAGSPRRTSRVSGHTKIPDEDESEVTSSASEKLGRQPRGRPHREAAQDPRGSGSEEQPSAAPSRLAAPPSCSSLQPPDPPASSSGAPHLRARKSEWV

SEQ ID NO: 1731 - protein, 559 aa, unidentified
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKISHSVKAGALEGVPISGCLGDQSAALVGQMCFQIGQAKNTYGTGCFLLCNTGHKCVFSDHGLLTTVAYKLGRDKPVYYALEGSVAIAGAVIRWLRDNLGIIKTSEEIEKLAKEVGTSYGCYFVPAFSGLYAPYWEPSARGIICGLTQFTNKCHIAFAALEAVCFQTREILDAMNRDCGIPLSHLQVDGGMTSNKILMQLQADILYIPVVKPSMPETTALGAAMAAGAAEGVGVWSLEPEDLSAVTMERFEPQINAEESEIRYSTWKKAVMKSMGWVTTQSPESGDPSIFCSLPLGFFIVSSMVMLIGARYISGIP

SEQ ID NO: 1732 - protein, 553 aa, unidentified
MAAPKTAAVGPLVGAVVQGTNSTRFLVFNSKTAELLSHHKVELTQEFPKEGWVEQDPKEILQSVYECIARTCEKLDELNIDISNIKAVGVSNQRETTVIWDKLTGEPLYNAVVWLDLRTQTTVEDLSKKIPGNSNFVKSKTGLPLSTYFSAVKLRWMLDNVRNVQKAVEEGRALFGTIDSWLIWSLTGGVNGGVHCTDVTNASRTMLFNIHSLEWDKELCDFFEIPMDLLPNVFSSSEIYGLIKTGALEGVPISGCLGDQCAALVGQMCFQEGQAKNTYGTGCFLLCNTGRKCVFSEHGLLTTVAYKLGREKPAYYALEGSVAIAGAVIRWLRDNLGIIETSGDIERLAKEVGTSYGCYFVPAFSGLYAPYWEPSARGILCGLTQFTNKCHIAFAALEAVCFQTREILEAMNRDCGIPLRHLQVDGGMTNNKVLMQLQADILHIPVIKPFMPETTALGAAMAAGAAEGVSVWSLEPQALSVLRMERFEPQIQATESEIRYATWKKAVMKSMGWVTSQSPEGGDPSIFSSLPLGFFIVSSMVMLIGARYISGVP

SEQ ID NO: 1733 - protein, 547 aa, unidentified
MSTASSSSSSSSSQTPHPPSQRMRRSAAGSPPAVAAAGSGNGAGGGGGVGCAPAAGAGRLLQPIRATVPYQLLRGSQHSPTRPPVAAAAASLGSLPGPGAARGPSPSSPTPPAAAAPAEQAPRAKGRPRRSPESHRRSSSPERRSPGSPVCRADKAKSQQVRTSSTIRRTSSLDTITGPYLTGQWPRDPHVHYPSCMKDKATQTPSCWAEEGAEKRSHQRSASWGSADQLKEQIAKLRQQLQRSKQSSRHSKEKDRQSPLHGNHITISHTQATGSRSVPMPLSNISVPKSSVSRVPCNVEGISPELEKVFIKENNGKEEVSKPLDIPDGRRAPLPAHYRSSSTRSIDTQTPSVQERSSSCSSHSPCVSPFCPPESQDGSPCSTEDLLYDRDKDSGSSSPLPKYASSPKPNNSYMFKREPPEGCERVKVFEEMASRQPISAPLFSCPDKNKVNFIPTGSAFCPVKLLGPLLPASDLMLKNSPNSGQSSALATLTVEQLSSRVSFTSLSDDTSTAGSMEASVQQPSQQQQLLQELQGEDHISAQNYVII

SEQ ID NO: 1734 - protein, 1179 aa, unidentified
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 1735 - protein, 266 aa, unidentified
MRVTLATIAWMVSFVSNYSHTANILPDIENEDFIKDCVRIHNKFRSEVKPTASDMLYMTWDPALAQIAKAWASNCQFSHNTRLKPPHKLHPNFTSLGENIWTGSVPIFSVSSAITNWYDEIQDYDFKTRICKKVCGHYTQVVWADSYKVGCAVQFCPKVSGFDALSNGAHFICNYGPGGNYPTWPYKRGATCSACPNNDKCLDNLCVNRQRDQVKRYYSVVYPGWPIYPRNRYTSLFLIVNSVILILSVIITILVQHKYPNLVLLD

SEQ ID NO: 1736 - protein, 344 aa, unidentified
MEAARPFAREWRAQSLPLAVGGVLKLRLCELWLLLLGSSLNARFLPDEEDVDFINEYVNLHNELRGDVIPRGSNLRFMTWDVALSRTARAWGKKCLFTHNIYLQDVQMVHPKFYGIGENMWVGPENEFTASIAIRSWHAEKKMYNFENGSCSGDCSNYIQLVWDHSYKVGCAVTPCSKIGHIIHAAIFICNYAPGGTLTRRPYEPGIFCTRCGRRDKCTDFLCSNADRDQATYYRFWYPKWEMPRPVVCDPLCTFILLLRILCFILCVITVLIVQSQFPNILLEQQMIFTPEESEAGNEEEEKEEEKKEKEEMEMEIMEMEEEKEEREEEEEETQKEKMEEEEK

SEQ ID NO: 1737 - protein, 406 aa, unidentified
MRGSVECTWGWGHCAPSPLLLWTLLLFAAPFGLLGEKTRQVSLEVIPNWLGPLQNLLHIRAVGTNSTLHYVWSSLGPLAVVMVATNTPHSTLSVNWSLLLSPEPDGGLMVLPKDSIQFSSALVFTRLLEFDSTNVSDTAAKPLGRPYPPYSLADFSWNNITDSLDPATLSATFQGHPMNDPTRTFANGSLAFRVQAFSRSSRPAQPPRLLHTADTCQLEVALIGASPRGNRSLFGLEVATLGQGPDCPSMQEQHSIDDEYAPAVFQLDQLLWGSLPSGFAQWRPVAYSQKPGGRESALPCQASPLHPALAYSLPQSPIVRAFFGSQNNFCAFNLTFGASTGPGYWDQHYLSWSMLLGVGFPPVDGLSPLVLGIMAVALGAPGLMLLGGGLVLLLHHKKYSEYQSIN

SEQ ID NO: 1738 - protein, 463 aa, unidentified
MAGAPGPLRLALLLLGMVGRAGPRPQGATVSLWETVQKWREYRRQCQRSLTEDPPPATDLFCNRTFDEYACWPDGEPGSFVNVSCPWYLPWASSVPQGHVYRFCTAEGLWLQKDNSSLPWRDLSECEESKRGERSSPEEQLLFLYIIYTVGYALSFSALVIASAILLGFRHLHCTRNYIHLNLFASFILRALSVFIKDAALKWMYSTAAQQHQWDGLLSYQDSLSCRLVFLLMQYCVAANYYWLLVEGVYLYTLLAFSVLSEQWIFRLYVSIGWGVPLLFVVPWGIVKYLYEDEGCWTRNSNMNYWLIIRLPILFAIGVNFLIFVRVICIVVSKLKANLMCKTDIKCRLAKSTLTLIPLLGTHEVIFAFVMDEHARGTLRFIKLFTELSFTSFQGLMVAILYCFVNNEVQLEFRKSWERWRLEHLHIQRDSSMKPLKCPTSSLSSGATAGSSMYTATCQASCS

SEQ ID NO: 1739 - protein, 553 aa, unidentified
MKLGSSRAGPGRGSAGLLPGVHELPMGIPAPWGTSPLSFHRKCSLWAPGRPFLTLVLLVSIKQVTGSLLEETTRKWAQYKQACLRDLLKEPSGIFCNGTFDQYVCWPHSSPGNVSVPCPSYLPWWSEESSGRAYRHCLAQGTWQTIENATDIWQDDSECSENHSFKQNVDRYALLSTLQLMYTVGYSFSLISLFLALTLLLFLRKLHCTRNYIHMNLFASFILRTLAVLVKDVVFYNSYSKRPDNENGWMSYLSEMSTSCRSVQVLLHYFVGANYLWLLVEGLYLHTLLEPTVLPERRLWPRYLLLGWAFPVLFVVPWGFARAHLENTGCWTTNGNKKIWWIIRGPMMLCVTVNFFIFLKILKLLISKLKAHQMCFRDYKYRLAKSTLVLIPLLGVHEILFSFITDDQVEGFAKLIRLFIQLTLSSFHGFLVALQYGFANGEVKAELRKYWVRFLLARHSGCRACVLGKDFRFLGKCPKKLSEGDGAEKLRKLQPSLNSGRLLHLAMRGLGELGAQPQQDHARWPRGSSLSECSEGDVTMANTMEEILEESEI

SEQ ID NO: 1740 - protein, 457 aa, unidentified
MYSFNTLRLYLWETIVFFSLAASKEAEAARSAPKPMSPSDFLDKLMGRTSGYDARIRPNFKGPPVNVSCNIFINSFGSIAETTMDYRVNIFLRQQWNDPRLAYNEYPDDSLDLDPSMLDSIWKPDLFFANEKGAHFHEITTDNKLLRISRNGNVLYSIRITLTLACPMDLKNFPMDVQTCIMQLESFGYTMNDLIFEWQEQGAVQVADGLTLPQFILKEEKDLRYCTKHYNTGKFTCIEARFHLERQMGYYLIQMYIPSLLIVILSWISFWINMDAAPARVGLGITTVLTMTTQSSGSRASLPKVSYVKAIDIWMAVCLLFVFSALLEYAAVNFVSRQHKELLRFRRKRRHHKSPMLNLFQEDEAGEGRFNFSAYGMGPACLQAKDGISVKGANNSNTTNPPPAPSKSPEEMRKLFIQRAKKIDKISRIGFPMAFLIFNMFYWIIYKIVRREDVHNQ

SEQ ID NO: 1741 - protein, 452 aa, unidentified [sequence omitted]

SEQ ID NO: 1742 - protein, 464 aa, unidentified
MAHVRHFRTLVSGFYFWEAALLLSLVATKETDSARSRSAPMSPSDFLDKLMGRTSGYDARIRPNFKGPPVNVTCNIFINSFGSIAETTMDYRVNIFLRQKWNDPRLAYSEYPDDSLDLDPSMLDSIWKPDLFFANEKGANFHEVTTDNKLLRIFKNGNVLYSIRLTLTLSCPMDLKNFPMDVQTCIMQLESFGYTMNDLIFEWQDEAPVQVAEGLTLPQFLLKEEKDLRYCTKHYNTGKFTCIEVRFHLERQMGYYLIQMYIPSLLIVILSWVSFWINMDAAPARVALGITTVLTMTTQSSGSRASLPKVSYVKAIDIWMAVCLLFVFSALLEYAAVNFVSRQHKELLRFRRKRKNKTEAFALEKFYRFSDMDDEVRESRFSFTAYGMGPCLQAKDGMTPKGPNHPVQVMPKSPDEMRKVFIDRAKKIDTISRACFPLAFLIFNIFYWVIYKILRHEDIHQQQD

SEQ ID NO: 1743 - protein, 497 aa, unidentified
MKFLLTTAFLILISLWVEEAYSKEKSSKKGKGKKKQYLCPSQQSAEDLARVPANSTSNILNRLLVSYDPRIRPNFKGIPVDVVVNIFINSFGSIQETTMDYRVNIFLRQKWNDPRLKLPSDFRGSDALTVDPTMYKCLWKPDLFFANEKSANFHDVTQENILLFIFRDGDVLVSMRLSITLSCPLDLTLFPMDTQRCKMQLESFGYTTDDLRFIWQSGDPVQLEKIALPQFDIKKEDIEYGNCTKYYKGTGYYTCVEVIFTLRRQVGFYMMGVYAPTLLIVVLSWLSFWINPDASAARVPLGIFSVLSLASECTTLAAELPKVSYVKALDVWLIACLLFGFASLVEYAVVQVMLNNPKRVEAEKARIAKAEQADGKGGNVAKKNTVNGTGTPVHISTLQVGETRCKKVCTSKSDLRSNDFSIVGSLPRDFELSNYDCYGKPIEVNNGLGKSQAKNNKKPPPAKPVIPTAAKRIDLYARALFPFCFLFFNVIYWSIYL

SEQ ID NO: 1744 - protein, 371 aa, unidentified
MSFRKVNIIILVLAVALFLLVLHHNFLSLSSLLRNEVTDSGIVGPQPIDFVPNALRHAVDGRQEEIPVVIAASEDRLGGAIAAINSIQHNTRSNVIFYIVTLNNTADHLRSWLNSDSLKSIRYKIVNFDPKLLEGKVKEDPDQGESMKPLTFARFYLPILVPSAKKAIYMDDDVIVQGDILALYNTALKPGHAAAFSEDCDSASTKVVIRGAGNQYNYIGYLDYKKERIRKLSMKASTCSFNPGVFVANLTEWKRQNITNQLEKWMKLNVEEGLYSRTLAGSITTPPLLIVFYQQHSTIDPMWNVRHLGSSAGKRYSPQFVKAAKLLHWNGHLKPWGRTASYTDVWEKWYIPDPTGKFNLIRRYTEISNIK

SEQ ID NO: 1745 - protein, 722 aa, unidentified
MEKNGNNRKLRVCVATCNRADYSKLAPIMFGIKTEPEFFELDVVVLGSHLIDDYGNTYRMIEQDDFDINTRLHTIVRGEDEAAMVESVGLALVKLPDVLNRLKPDIMIVHGDRFDALALATSAALMNIRILHIEGGEVSGTIDDSIRHAITKLAHYHVCCTRSAEQHLISMCEDHDRILLAGCPSYDKLLSAKNKDYMSIIRMWLGDDVKSKDYIVALQHPVTTDIKHSIKMFELTLDALISFNKRTLVLFPNIDAGSKEMVRVMRKKGIEHHPNFRAVKHVPFDQFIQLVAHAGCMIGNSSCGVREVGAFGTPVINLGTRQIGRETGENVLHVRDADTQDKILQALHLQFGKQYPCSKIYGDGNAVPRILKFLKSIDLQEPLQKKFCFPPVKENISQDIDHILETLSALAVDLGGTNLRVAIVSMKGEIVKKYTQFNPKTYEERINLILQMCVEAAAEAVKLNCRILGVGISTGGRVNPREGIVLHSTKLIQEWNSVDLRTPLSDTLHLPVWVDNDGNCAALAERKFGQGKGLENFVTLITGTGIGGGIIHQHELIHGSSFCAAELGHLVVSLDGPDCSCGSHGCIEAYASGMALQREAKKLHDEDLLLVEGMSVPKDEAVGALHLIQAAKLGNAKAQSILRTAGTALGLGVVNILHTMNPSLVILSGVLASHYIHIVKDVIRQQALSSVQDVDVVVSDLVDPALLGAASMVLDYTTRRIY

SEQ ID NO: 1746 - protein, 1256 aa, unidentified
MLFKLLQRQTYTCLSHRYGLYVCFLGVVVTIVSAFQFGEVVLEWSRDQYHVLFDSYRDNIAGKSFQNRLCLPMPIDVVYTWVNGTDLELLKELQQVREQMEEEQKAMREILGKNTTEPTKKSEKQLECLLTHCIKVPMLVLDPALPANITLKDLPSLYPSFHSASDIFNVAKPKNPSTNVSVVVFDSTKDVEDAHSGLLKGNSRQTVWRGYLTTDKEVPGLVLMQDLAFLSGFPPTFKETNQLKTKLPENLSSKVKLLQLYSEASVALLKLNNPKDFQELNKQTKKNMTIDGKELTISPAYLLWDLSAISQSKQDEDISASRFEDNEELRYSLRSIERHAPWVRNIFIVTNGQIPSWLNLDNPRVTIVTHQDVFRNLSHLPTFSSPAIESHIHRIEGLSQKFIYLNDDVMFGKDVWPDDFYSHSKGQKVYLTWPVPNCAEGCPGSWIKDGYCDKACNNSACDWDGGDCSGNSGGSRYIAGGGGTGSIGVGQPWQFGGGINSVSYCNQGCANSWLADKFCDQACNVLSCGFDAGDCGQDHFHELYKVILLPNQTHYIIPKGECLPYFSFAEVAKRGVEGAYSDNPIIRHASIANKWKTIHLIMHSGMNATTIHFNLTFQNTNDEEFKMQITVEVDTREGPKLNSTAQKGYENLVSPITLLPEAEILFEDIPKEKRFPKFKRHDVNSTRRAQEEVKIPLVNISLLPKDAQLSLNTLDLQLEHGDITLKGYNLSKSALLRSFLMNSQHAKIKNQAIITDETNDSLVAPQEKQVHKSILPNSLGVSERLQRLTFPAVSVKVNGHDQGQNPPLDLETTARFRVETHTQKTIGGNVTKEKPPSLIVPLESQMTKEKKITGKEKENSRMEENAENHIGVTEVLLGRKLQHYTDSYLGFLPWEKKKYFQDLLDEEESLKTQLAYFTDSKNTGRQLKDTFADSLRYVNKILNSKFGFTSRKVPAHMPHMIDRIVMQELQDMFPEEFDKTSFHKVRHSEDMQFAFSYFYYLMSAVQPLNISQVFDEVDTDQSGVLSDREIRTLATRIHELPLSLQDLTGLEHMLINCSKMLPADITQLNNIPPTQESYYDPNLPPVTKSLVTNCKPVTDKIHKAYKDKNKYRFEIMGEEEIAFKMIRTNVSHVVGQLDDIRKNPRKFVCLNDNIDHNHKDAQTVKAVLRDFYESMFPIPSQFELPREYRNRFLHMHELQEWRAYRDKLKFWTHCVLATLIMFTIFSFFAEQLIALKRKIFPRRRIHKEASPNRIRV

SEQ ID NO: 1747 - protein, 328 aa, unidentified
MANSASPEQNQNHCSAINNSIPLMQGNLPTLTLSGKIRVTVTFFLFLLSATFNASFLLKLQKWTQKKEKGKKLSRMKLLLKHLTLANLLETLIVMPLDGMWNITVQWYAGELLCKVLSYLKLFSMYAPAFMMVVISLDRSLAITRPLALKSNSKVGQSMVGLAWILSSVFAGPQLYIFRMIHLADSSGQTKVFSQCVTHCSFSQWWHQAFYNFFTFSCLFIIPLFIMLICNAKIIFTLTRVLHQDPHELQLNQSKNNIPRARLKTLKMTVAFATSFTVCWTPYYVLGIWYWFDPEMLNRLSDPVNHFFFLFAFLNPCFDPLIYGYFSL

SEQ ID NO: 1748 - protein, 731 aa, unidentified
MSWFVDLAGKAEDLLNRVDQGAATALSRKDNASNIYSKNTDYTELHQQNTDLIYQTGPKSTYISSAADNIRNQKATILAGTANVKVGSRTPVEASHPVENASVPRPSSHFVRRKKSEPDDELLFDFLNSSQKEPTGRVEIRKEKGKTPVFQSSQTSSVSSVNPSVTTIKTIEENSFGSQTHEAASNSDSSHEGQEESSKENVSSNAACPDHTPTPNDDGKSHELSNLRLENQLLRNEVQSLNQEMASLLQRSKETQEELNKARARVEKWNADHSKSDRMTRGLRAQVDDLTEAVAAKDSQLAVLKVRLQEADQLLSTRTEALEALQSEKSRIMQDQSEGNSLQNQALQTFQERLHEADATLKREQESYKQMQSEFAARLNKVEMERQNLAEAITLAERKYSDEKKRVDELQQQVKLYKLNLESSKQELIDYKQKATRILQSKEKLINSLKEGSGFEGLDSSTASSMELEELRHEKEMQREEIQKLMGQIHQLRSELQDMEAQQVNEAESAREQLQDLHDQIAGQKASKQELETELERLKQEFHYIEEDLYRTKNTLQSRIKDRDEEIQKLRNQLTNKTLSNSSQSELENRLHQLTETLIQKQTMLESLSTEKNSLVFQLERLEQQMNSASGSSSNGSSINMSGIDNGEGTRLRNVPVLFNDTETNLAGMYGKVRKAASSIDQFSIRLGIFLRRYPIARVFVIIYMALLHLWVMIVLLTYTPEMHHDQPYGK

SEQ ID NO: 1749 - protein, 3259 aa, unidentified
MLSRLSGLANVVLHELSGDDDTDQNMRAPLDPELHQESDMEFNNTTQEDVQERLAYAEQLVVELKDIIRQKDVQLQQKDEALQEERKAADNKIKKLKLHAKAKLTSLNKYIEEMKAQGGTVLPTEPQSEEQLSKHDKSSTEEEMEIEKIKHKLQEKEELISTLQAQLTQAQAEQPAQSSTEMEEFVMMKQQLQEKEEFISTLQAQLSQTQAEQAAQQVVREKDARFETQVRLHEDELLQLVTQADVETEMQQKLRVLQRKLEEHEESLVGRAQVVDLLQQELTAAEQRNQILSQQLQQMEAEHNTLRNTVETEREESKILLEKMELEVAERKLSFHNLQEEMHHLLEQFEQAGQAQAELESRYSALEQKHKAEMEEKTSHILSLQKTGQELQSACDALKDQNSKLLQDKNEQAVQSAQTIQQLEDQLQQKSKEISQFLNRLPLQQHETASQTSFPDVYNEGTQAVTEENIASLQKRVVELENEKGALLLSSIELEELKAENEKLSSQITLLEAQNRTGEADREVSEISIVDIANKRSSSAEESGQDVLENTFSQKHKELSVLLLEMKEAQEEIAFLKLQLQGKRAEEADHEVLDQKEMKQMEGEGIAPIKMKVFLEDTGQDFPLMPNEESSLPAVEKEQASTEHQSRTSEEISLNDAGVELKSTKQDGDKSLSAVPDIGQCHQDELERLKSQILELELNFHKAQEIYEKNLDEKAKEISNLNQLIEEFKKNADNNSSAFTALSEERDQLLSQVKELSMVTELRAQVKQLEMNLAEAERQRRLDYESQTAHDNLLTEQIHSLSIEAKSKDVKIEVLQNELDDVQLQFSEQSTLIRSLQSQLQNKESEVLEGAERVRHISSKVEELSQALSQKELEITKMDQLLLEKKRDVETLQQTIEEKDQQVTEISFSMTEKMVQLNEEKFSLGVEIKTLKEQLNLLSRAEEAKKEQVEEDNEVSSGLKQNYDEMSPAGQISKEELQHEFDLLKKENEQRKRKLQAALINRKELLQRVSRLEEELANLKDESKKEIPLSETERGEVEEDKENKEYSEKCVTSKCQEIEIYLKQTISEKEVELQHIRKDLEEKLAAEEQFQALVKQMNQTLQDKTNQIDLLQAEISENQAIIQKLITSNTDASDGDSVALVKETVVISPPCTGSSEHWKPELEEKILALEKEKEQLQKKLQEALTSRKAILKKAQEKERHLREELKQQKDDYNRLQEQFDEQSKENENIGDQLRQLQIQVRESIDGKLPSTDQQESCSSTPGLEEPLFKATEQHHTQPVLESNLCPDWPSHSEDASALQGGTSVAQIKAQLKEIEAEKVELELKVSSTTSELTKKSEEVFQLQEQINKQGLEIESLKTVSHEAEVHAESLQQKLESSQLQIAGLEHLRELQPKLDELQKLISKKEEDVSYLSGQLSEKEAALTKIQTEIIEQEDLIKALHTQLEMQAKEHDERIKQLQVELCEMKQKPEEIGEESRAKQQIQRKLQAALISRKEALKENKSLQEELSLARGTIERLTKSLADVESQVSAQNKEKDTVLGRLALLQEERDKLITEMDRSLLENQSLSSSCESLKLALEGLTEDKEKLVKEIESLKSSKIAESTEWQEKHKELQKEYEILLQSYENVSNEAERIQHVVEAVRQEKQELYGKLRSTEANKKETEKQLQEAEQEMEEMKEKMRKFAKSKQQKILELEEENDRLRAEVHPAGDTAKECMETLLSSNASMKEELERVKMEYETLSKKFQSLMSEKDSLSEEVQDLKHQIEGNVSKQANLEATEKHDNQTNVTEEGTQSIPGETEEQDSLSMSTRPTCSESVPSAKSANPAVSKDFSSHDEINNYLQQIDQLKERIAGLEEEKQKNKEFSQTLENEKNTLLSQISTKDGELKMLQEEVTKMNLLNQQIQEELSRVTKLKETAEEEKDDLEERLMNQLAELNGSIGNYCQDVTDAQIKNELLESEMKNLKKCVSELEEEKQQLVKEKTKVESEIRKEYLEKIQGAQKEPGNKSHAKELQELLKEKQQEVKQLQKDCIRYQEKISALERTVKALEFVQTESQKDLEITKENLAQAVEHRKKAQAELASFKVLLDDTQSEAARVLADNLKLKKELQSNKESVKSQMKQKDEDLERRLEQAEEKHLKEKKNMQEKLDALRREKVHLEETIGEIQVTLNKKDKEVQQLQENLDSTVTQLAAFTKSMSSLQDDRDRVIDEAKKWERKFSDAIQSKEEEIRLKEDNCSVLKDQLRQMSIHMEELKINISRLEHDKQIWESKAQTEVQLQQKVCDTLQGENKELLSQLEETRHLYHSSQNELAKLESELKSLKDQLTDLSNSLEKCKEQKGNLEGIIRQQEADIQNSKFSYEQLETDLQASRELTSRLHEEINMKEQKIISLLSGKEEAIQVAIAELRQQHDKEIKELENLLSQEEEENIVLEEENKKAVDKTNQLMETLKTIKKENIQQKAQLDSFVKSMSSLQNDRDRIVGDYQQLEERHLSIILEKDQLIQEAAAENNKLKEEIRGLRSHMDDLNSENAKLDAELIQYREDLNQVITIKDSQQKQLLEVQLQQNKELENKYAKLEEKLKESEEANEDLRRSFNALQEEKQDLSKEIESLKVSISQLTRQVTALQEEGTLGLYHAQLKVKEEEVHRLSALFSSSQKRIAELEEELVCVQKEAAKKVGEIEDKLKKELKHLHHDAGIMRNETETAEERVAELARDLVEMEQKLLMVTKENKGLTAQIQSFGRSMSSLQNSRDHANEELDELKRKYDASLKELAQLKEQGLLNRERDALLSETAFSMNSTEENSLSHLEKLNQQLLSKDEQLLHLSSQLEDSYNQVQSFSKAMASLQNERDHLWNELEKFRKSEEGKQRSAAQPSTSPAEVQSLKKAMSSLQNDRDRLLKELKNLQQQYLQINQEITELHPLKAQLQEYQDKTKAFQIMQEELRQENLSWQHELHQLRMEKSSWEIHERRMKEQYLMAISDKDQQLSHLQNLIRELRSSSSQTQPLKVQYQRQASPETSASPDGSQNLVYETELLRTQLNDSLKEIHQKELRIQQLNSNFSQLLEEKNTLSIQLCDTSQSLRENQQHYGDLLNHCAVLEKQVQELQAGPLNIDVAPGAPQEKNGVHRKSDPEELREPQQSFSEAQQQLCNTRQEVNELRKLLEEERDQRVAAENALSVAEEQIRRLEHSEWDSSRTPIIGSCGTQEQALLIDLTSNSCRRTRSGVGWKRVLRSLCHSRTRVPLLAAIYFLMIHVLLILCFTGHL

SEQ ID NO: 1750 - protein, 696 aa, unidentified
MGNGMCSRKQKRIFQTLLLLTVVFGFLYGAMLYYELQTQLRKAEAVALKYQQHQESLSAQLQVVYEHRSRLEKSLQKERLEHKKAKEDFLVYKLEAQETLNKGRQDSNSRYSALNVQHQMLKSQHEELKKQHSDLEEEHRKQGEDFSRTFNDHKQKYLQLQQEKEQELSKLKETVYNLREENRQLRKAHQDIHTQLQDVKQQHKNLLSEHEQLVVTLEDHKSALAAAQTQVAEYKQLKDTLNRIPSLRKPDPAEQQNVTQVAHSPQGYNTAREKPTREVQEVSRNNDVWQNHEAVPGRAEDTKLYAPTHKEAEFQAPPEPIQQEVERREPEEHQVEEEHRKALEEEEMEQVGQAEHLEEEHDPSPEEQDREWKEQHEQREAANLLEGHARAEVYPSAKPMIKFQSPYEEQLEQQRLAVQQVEEAQQLREHQEALHQQRLQGHLLRQQEQQQQQVAREMALQRQAELEEGRPQHQEQLRQQAHYDAMDNDIVQGAEDQGIQGEEGAYERDNQHQDEAEGDPGNRHEPREQGPREADPESEADRAAVEDINPADDPNNQGEDEFEEAEQVREENLPDENEEQKQSNQKQENTEVEEHLVMAGNPDQQEDNVDEQYQEEAEEEVQEDLTEEKKRELEHNAEETYGENDENTDDKNNDGEEQEVRDDNRPKGREEHYEEEEEEEEDGAAVAEKSHRRAEM

SEQ ID NO: 1751 - protein, 132 aa, unidentified
MISITEWQKIGVGITGFGIFFILFGTLLYFDSVLLAFGNLLFLTGLSLIIGLRKTFWFFFQRHKLKGTSFLLGGVVIVLLRWPLLGMFLETYGFFSLFKGFFPVAFGFLGNVCNIPFLGALFRRLQGTSSMV

SEQ ID NO: 1752 - protein, 138 aa, unidentified
MISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSFVDKVGESNNMV

SEQ ID NO: 1753 - protein, 250 aa, unidentified
MAAGTSSYWEDLRKQARQLENELDLKLVSFSKLCTSYSHSSTRDGRRDRYSSDTTPLLNGSSQDRMFETMAIEIEQLLARLTGVNDKMAEYTNSAGVPSLNAALMHTLQRHRDILQDYTHEFHKTKANFMAIRERENLMGSVRKDIESYKSGSGVNNRRTELFLKEHDHLRNSDRLIEETISIAMATKENMTSQRGMLKSIHSKMNTLANRFPAVNSLIQRINLRKRRDSLILGGVIGICTILLLLYAFH

SEQ ID NO: 1754 - protein, 212 aa, unidentified
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTCVVMFLVVQYLT

SEQ ID NO: 1755 - protein, 206 aa, unidentified
MGSGPRGALSLLLLLLAPPSRPAAGCPAPCSCAGTLVDCGRRGLTWASLPTAFPVDTTELVLTGNNLTALPPGLLDALPALRTAHLGANPWRCDCRLVPLRAWLAGRPERAPYRDLRCVAPPALRGRLLPYLAEDELRAACAPGPLCWGALAAQLALLGLGLLHALLLVLLLCRLRRLRARARARAAARLSLTDPLVAERAGTDES

SEQ ID NO: 1756 - protein, 537 aa, unidentified
MPHLMERMVGSGLLWLALVSCILTQASAVQRGYGNPIEASSYGLDLDCGAPGTPEAHVCFDPCQNYTLLDEPFRSTENSAGSQGCDKNMSGWYRFVGEGGVRMSETCVQVHRCQTDAPMWLNGTHPALGDGITNHTACAHWSGNCCFWKTEVLVKACPGGYHVYRLEGTPWCNLRYCTVPRDPSTVEDKCEKACRPEEECLALNSTWGCFCRQDLNSSDVHSLQPQLDCGPREIKVKVDKCLLGGLGLGEEVIAYLRDPNCSSILQTEERNWVSVTSPVQASACRNILERNQTHAIYKNTLSLVNDFIIRDTILNINFQCAYPLDMKVSLQAALQPIVSSLNVSVDGNGEFIVRMALFQDQNYTNPYEGDAVELSVESVLYVGAILEQGDTSRFNLVLRNCYATPTEDKADLVKYFIIRNSCSNQRDSTIHVEENGQSSESRFSVQMFMFAGHYDLVFLHCEIHLCDSLNEQCQPSCSRSQVRSEVPAIDLARVLDLGPITRRGAQSPGVMNGTPSTAGFLVAWPMVLLTVLLAWLF

SEQ ID NO: 1757 - protein, 560 aa, unidentified
MLRGTLLCAVLGLLRAQPFPCPPACKCVFRDAAQCSGGDVARISALGLPTNLTHILLFGMGRGVLQSQSFSGMTVLQRLMISDSHISAVAPGTFSDLIKLKTLRLSRNKITHLPGALLDKMVLLEQLFLDHNALRGIDQNMFQKLVNLQELALNQNQLDFLPASLFTNLENLKLLDLSGNNLTHLPKGLLGAQAKLERLLLHSNRLVSLDSGLLNSLGALTELQFHRNHIRSIAPGAFDRLPNLSSLTLSRNHLAFLPSALFLHSHNLTLLTLFENPLAELPGVLFGEMGGLQELWLNRTQLRTLPAAAFRNLSRLRYLGVTLSPRLSALPQGAFQGLGELQVLALHSNGLTALPDGLLRGLGKLRQVSLRRNRLRALPRALFRNLSSLESVQLDHNQLETLPGDVFGALPRLTEVLLGHNSWRCDCGLGPFLGWLRQHLGLVGGEEPPRCAGPGAHAGLPLWALPGGDAECPGPRGPPPRPAADSSSEAPVHPALAPNSSEPWVWAQPVTTGKGQDHSPFWGFYFLLLAVQAMITVIIVFAMIKIGQLFRKLIRERALG

SEQ ID NO: 1758 - protein, 339 aa, unidentified
MSPSPTALFCLGLCLGRVPAQSGPLPKPSLQALPSSLVPLEKPVTLRCQGPPGVDLYRLEKLSSSRYQDQAVLFIPAMKRSLAGRYRCSYQNGSLWSLPSDQLELVATGVFAKPSLSAQPGPAVSSGGDVTLQCQTRYGFDQFALYKEGDPAPYKNPERWYRASFPIITVTAAHSGTYRCYSFSSRDPYLWSAPSDPLELVVTGTSVTPSRLPTEPPSPVAEFSEATAELTVSFTNEVFTTETSRSITASPKESDSPAGPARQYYTKGNLVRICLGAVILIILAGFLAEDWHSRRKRLRHRGRAVQRPLPPLPPLPLTRKSNGGQDGGRQDVHSRGLCS

SEQ ID NO: 1759 - protein, 177 aa, unidentified
MPAWGALFLLWATAEATKDCPSPCTCRALETMGLWVDCRGHGLTALPALPARTRHLLLANNSLQSVPPGAFDHLPQLQTLDVTQNPWHCDCSLTYLRLWLEDRTPEALLQVRCASPSLAAHGPLGRLTGYQLGSCGWQLQASWVRPGVLWDVALVAVAALGLALLAGLLCATTEALD

SEQ ID NO: 1760 - protein, 319 aa, unidentified
MVGKMWPVLWTLCAVRVTVDAISVETPQDVLRASQGKSVTLPCTYHTSTSSREGLIQWDKLLLTHTERVVIWPFSNKNYIHGELYKNRVSISNNAEQSDASITIDQLTMADNGTYECSVSLMSDLEGNTKSRVRLLVLVPPSKPECGIEGETIIGNNIQLTCQSKEGSPTPQYSWKRYNILNQEQPLAQPASGQPVSLKNISTDTSGYYICTSSNEEGTQFCNITVAVRSPSMNVALYVGIAVGVVAALIIIGIIIYCCCCRGKDDNTEDKEDARPNREAYEEPPEQLRELSREREEEDDYRQEEQRSTGRESPDHLDQ

SEQ ID NO: 1761 - protein, 621 aa, unidentified
MGLLSDPVRRRALARLVLRLNAPLCVLSYVAGIAWFLALVFPPLTQRTYMSENAMGSTMVEEQFAGGDRARAFARDFAAHRKKSGALPVAWLERTMRSVGLEVYTQSFSRKLPFPDETHERYMVSGTNVYGILRAPRAASTESLVLTVPCGSDSTNSQAVGLLLALAAHFRGQIYWAKDIVFLVTEHDLLGTEAWLEAYHDVNVTGMQSSPLQGRAGAIQAAVALELSSDVVTSLDVAVEGLNGQLPNLDLLNLFQTFCQKGGLLCTLQGKLQPEDWTSLDGPLQGLQTLLLMVLRQASGRPHGSHGLFLRYRVEALTLRGINSFRQYKYDLVAVGKALEGMFRKLNHLLERLHQSFFLYLLPGLSRFVSIGLYMPAVGFLLLVLGLKALELWMQLHEAGMGLEEPGGAPGPSVPLPPSQGVGLASLVAPLLISQAMGLALYVLPVLGQHVATQHFPVAEAEAVVLTLLAIYAAGLALPHNTHRVVSTQAPDRGWMALKLVALIYLALQLGCIALTNFSLGFLLATTMVPTAALAKPHGPRTLYAALLVLTSPAATLLGSLFLWRELQEAPLSLAEGWQLFLAALAQGVLEHHTYGALLFPLLSLGLYPCWLLFWNVLFWK

SEQ ID NO: 1762 - protein, 828 aa, unidentified
MDESALTLGTIDVSYLPHSSEYSVGRCKHTSEEWGECGFRPTIFRSATLKWKESLMSRKRPFVGRCCYSCTPQSWDKFFNPSIPSLGLRNVIYINETHTRHRGWLARRLSYVLFIQERDVHKGMFATNVTENVLNSSRVQEAIAEVAAELNPDGSAQQQSKAVNKVKKKAKRILQEMVATVSPAMIRLTGWVLLKLFNSFFWNIQIHKGQLEMVKAATETNLPLLFLPVHRSHIDYLLLTFILFCHNIKAPYIASGNNLNIPIFSTLIHKLGGFFIRRRLDETPDGRKDVLYRALLHGHIVELLRQQQFLEIFLEGTRSRSGKTSCARAGLLSVVVDTLSTNVIPDILIIPVGISYDRIIEGHYNGEQLGKPKKNESLWSVARGVIRMLRKNYGCVRVDFAQPFSLKEYLESQSQKPVSALLSLEQALLPAILPSRPSDAADEGRDTSINESRNATDESLRRRLIANLAEHILFTASKSCAIMSTHIVACLLLYRHRQGIDLSTLVEDFFVMKEEVLARDFDLGFSGNSEDVVMHAIQLLGNCVTITHTSRNDEFFITPSTTVPSVFELNFYSNGVLHVFIMEAIIACSLYAVLNKRGLGGPTSTPPNLISQEQLVRKAASLCYLLSNEGTISLPCQTFYQVCHETVGKFIQYGILTVAEHDDQEDISPSLAEQQWDKKLPEPLSWRSDEEDEDSDFGEEQRDCYLKVSQSKEHQQFITFLQRLLGPLLEAYSSAAIFVHNFSGPVPEPEYLQKLHKYLITRTERNVAVYAESATYCLVKNAVKMFKDIGVFKETKQKRVSVLELSSTFLPQCNRQKLLEYILSFVVL

SEQ ID NO: 1763 - protein, 795 aa, unidentified
MATMLEGRCQTQPRSSPSGREASLWSSGFGMKLEAVTPFLGKYRPFVGRCCQTCTPKSWESLFHRSITDLGFCNVILVKEENTRFRGWLVRRLCYFLWSLEQHIPPCQDVPQKIMESTGVQNLLSGRVPGGTGEGQVPDLVKKEVQRILGHIQAPPRPFLVRLFSWALLRFLNCLFLNVQLHKGQMKMVQKAAQAGLPLVLLSTHKTLLDGILLPFMLLSQGLGVLRVAWDSRACSPALRALLRKLGGLFLPPEASLSLDSSEGLLARAVVQAVIEQLLVSGQPLLIFLEEPPGALGPRLSALGQAWVGFVVQAVQVGIVPDALLVPVAVTYDLVPDAPCDIDHASAPLGLWTGALAVLRSLWSRWGCSHRICSRVHLAQPFSLQEYIVSARSCWGGRQTLEQLLQPIVLGQCTAVPDTEKEQEWTPITGPLLALKEEDQLLVRRLSCHVLSASVGSSAVMSTAIMATLLLFKHQKLLGEFSWLTEEILLRGFDVGFSGQLRSLLQHSLSLLRAHVALLRIRQGDLLVVPQPGPGLTHLAQLSAELLPVFLSEAVGACAVRGLLAGRVPPQGPWELQGILLLSQNELYRQILLLMHLLPQDLLLLKPCQSSYCYCQEVLDRLIQCGLLVAEETPGSRPACDTGRQRLSRKLLWKPSGDFTDSDSDDFGEADGRYFRLSQQSHCPDFFLFLCRLLSPLLKAFAQAAAFLRQGQLPDTELGYTEQLFQFLQATAQEEGIFECADPKLAISAVWTFRDLGVLQQTPSPAGPRLHLSPTFASLDNQEKLEQFIRQFICS

SEQ ID NO: 1764 - protein, 434 aa, unidentified
MEGAELAGKILSTWLTLVLGFILLPSVFGVSLGISEIYMKILVKTLEWATIRIEKGTPKESILKNSASVGIIQRDESPMEKGLSGLRGRDFELSDVFYFSKKGLEAIVEDEVTQRFSSEELVSWNLLTRTNVNFQYISLRLTMVWVLGVIVRYCVLLPLRVTLAFIGISLLVIGTTLVGQLPDSSLKNWLSELVHLTCCRICVRALSGTIHYHNKQYRPQKGGICVANHTSPIDVLILTTDGCYAMVGQVHGGLMGIIQRAMVKACPHVWFERSEMKDRHLVTKRLKEHIADKKKLPILIFPEGTCINNTSVMMFKKGSFEIGGTIHPVAIKYNPQFGDAFWNSSKYNMVSYLLRMMTSWAIVCDVWYMPPMTREEGEDAVQFANRVKSAIAIQGGLTELPWDGGLKRAKVKDIFKEEQQKNYSKMIVGNGSLS

SEQ ID NO: 1765 - protein, 456 aa, unidentified
MFLLLPFDSLIVNLLGISLTVLFTLLLVFIIVPAIFGVSFGIRKLYMKSLLKIFAWATLRMERGAKEKNHQLYKPYTNGIIAKDPTSLEEEIKEIRRSGSSKALDNTPEFELSDIFYFCRKGMETIMDDEVTKRFSAEELESWNLLSRTNYNFQYISLRLTVLWGLGVLIRYCFLLPLRIALAFTGISLLVVGTTVVGYLPNGRFKEFMSKHVHLMCYRICVRALTAIITYHDRENRPRNGGICVANHTSPIDVIILASDGYYAMVGQVHGGLMGVIQRAMVKACPHVWFERSEVKDRHLVAKRLTEHVQDKSKLPILIFPEGTCINNTSVMMFKKGSFEIGATVYPVAIKYDPQFGDAFWNSSKYGMVTYLLRMMTSWAIVCSVWYLPPMTREADEDAVQFANRVKSAIARQGGLVDLLWDGGLKREKVKDTFKEEQQKLYSKMIVGNHKDRSRS

SEQ ID NO: 1766 - protein, 330 aa, unidentified
MTPNSTGEVPSPIPKGALGLSLALASLIITANLLLALGIAWDRRLRSPPAGCFFLSLLLAGLLTGLALPTLPGLWNQSRRGYWSCLLVYLAPNFSFLSLLANLLLVHGERYMAVLRPLQPPGSIRLALLLTWAGPLLFASLPALGWNHWTPGANCSSQAIFPAPYLYLEVYGLLLPAVGAAAFLSVRVLATAHRQLQDICRLERAVCRDEPSALARALTWRQARAQAGAMLLFGLCWGPYVATLLLSVLAYEQRPPLGPGTLLSLLSLGSASAAAVPVAMGLGDQRYTAPWRAAAQRCLQGLWGRASRDSPGPSIAYHPSSQSSVDLDLN

SEQ ID NO: 1767 - protein, 558 aa, unidentified
MELRARGWWLLCAAAALVACARGDPASKSRSCGEVRQIYGAKGFSLSDVPQAEISGEHLRICPQGYTCCTSEMEENLANRSHAELETALRDSSRVLQAMLATQLRSFDDHFQHLLNDSERTLQATFPGAFGELYTQNARAFRDLYSELRLYYRGANLHLEETLAEFWARLLERLFKQLHPQLLLPDDYLDCLGKQAEALRPFGEAPRELRLRATRAFVAARSFVQGLGVASDVVRKVAQVPLGPECSRAVMKLVYCAHCLGVPGARPCPDYCRNVLKGCLANQADLDAEWRNLLDSMVLITDKFWGTSGVESVIGSVHTWLAEAINALQDNRDTLTAKVIQGCGNPKVNPQGPGPEEKRRRGKLAPRERPPSGTLEKLVSEAKAQLRDVQDFWISLPGTLCSEKMALSTASDDRCWNGMARGRYLPEVMGDGLANQINNPEVEVDITKPDMTIRQQIMQLKIMTNRLRSAYNGNDVDFQDASDDGSGSGSGDGCLDDLCSRKVSRKSSSSRTPLTHALPGLSEQEGQKTSAASCPQPPTFLLPLLLFLALTVARPRWR

SEQ ID NO: 1768 - protein, 580 aa, unidentified
MAGTVRTACLVVAMLLSLDFPGQAQPPPPPPDATCHQVRSFFQRLQPGLKWVPETPVPGSDLQVCLPKGPTCCSRKMEEKYQLTARLNMEQLLQSASMELKFLIIQNAAVFQEAFEIVVRHAKNYTNAMFKNNYPSLTPQAFEFVGEFFTDVSLYILGSDINVDDMVNELFDSLFPVIYTQLMNPGLPDSALDINECLRGARRDLKVFGNFPKLIMTQVSKSLQVTRIFLQALNLGIEVINTTDHLKFSKDCGRMLTRMWYCSYCQGLMMVKPCGGYCNVVMQGCMAGVVEIDKYWREYILSLEELVNGMYRIYDMENVLLGLFSTIHDSIQYVQKNAGKLTTTIGKLCAHSQQRQYRSAYYPEDLFIDKKVLKVAHVEHEETLSSRRRELIQKLKSFISFYSALPGYICSHSPVAENDTLCWNGQELVERYSQKAARNGMKNQFNLHELKMKGPEPVVSQIIDKLKHINQLLRTMSMPKGRVLDKNLDEEGFESGDCGDDEDECIGGSGDGMIKVKNQLRFLAELAYDLDVDDAPGNSQQATPKDNEISTFHNLGNVHSPLKLLTSMAISVVCFFFLVH

SEQ ID NO: 1769 - protein, 556 aa, unidentified
MARFGLPALLCTLAVLSAALLAAELKSKSCSEVRRLYVSKGFNKNDAPLHEINGDHLKICPQGSTCCSQEMEEKYSLQSKDDFKSVVSEQCNHLQAVFASRYKKFDEFFKELLENAEKSLNDMFVKTYGHLYMQNSELFKDLFVELKRYYVVGNVNLEEMLNDFWARLLERMFRLVNSQYHFTDEYLECVSKYTEQLKPFGDVPRKLKLQVTRAFVAARTFAQGLAVAGDVVSKVSVVNPTAQCTHALLKMIYCSHCRGLVTVKPCYNYCSNIMRGCLANQGDLDFEWNNFIDAMLMVAERLEGPFNIESVMDPIDVKISDAIMNMQDNSVQVSQKVFQGCGPPKPLPAGRISRSISESAFSARFRPHHPEERPTTAAGTSLDRLVTDVKEKLKQAKKFWSSLPSNVCNDERMAAGNGNEDDCWNGKGKSRYLFAVTGNGLANQGNNPEVQVDTSKPDILILRQIMALRVMTSKMKNAYNGNDVDFFDISDESSGEGSGSGCEYQQCPSEFDYNATDHAGKSANEKADSAGVRPGAQAYLLTVFCILFLVMQREWR

SEQ ID NO: 1770 - protein, 375 aa, unidentified
MDVTSQARGVGLEMYPGTAQPAAPNTTSPELNLSHPLLGTALANGTGELSEHQQYVIGLFLSCLYTIFLFPIGFVGNILILVVNISFREKMTIPDLYFINLAVADLILVADSLIEVFNLHERYYDIAVLCTFMSLFLQVNMYSSVFFLTWMSFDRYIALARAMRCSLFRTKHHARLSCGLIWMASVSATLVPFTAVHLQHTDEACFCFADVREVQWLEVTLGFIVPFAIIGLCYSLIVRVLVRAHRHRGLRPRRQKALRMILAVVLVFFVCWLPENVFISVHLLQRTQPGAAPCKQSFRHAHPLTGHIVNLAAFSNSCLNPLIYSFLGETFRDKLRLYIEQKTNLPALNRFCHAALKAVIPDSTEQSDVRFSSAV

SEQ ID NO: 1771 - protein, 558 aa, unidentified
MAALTRDPQFQKLQQWYREHRSELNLRRLFDANKDRFNHFSLTLNTNHGHILVDYSKNLVTEDVMRMLVDLAKSRGVEAARERMFNGEKINYTEGRAVLHVALRNRSNTPILVDGKDVMPEVNKVLDKMKSFCQRVRSGDWKGYTGKTITDVINIGIGGSDLGPLMVTEALKPYSSGGPRVWYVSNIDGTHIAKTLAQLNPESSLFIIASKTFTTQETITNAETAKEWFLQAAKDPSAVAKHFVALSTNTTKVKEFGIDPQNMFEFWDWVGGRYSLWSAIGLSIALHVGFDNFEQLLSGAHWMDQHFRTTPLEKNAPVLLALLGIWYINCFGCETHAMLPYDQYLHRFAAYFQQGDMESNGKYITKSGTRVDHQTGPIVWGEPGTNGQHAFYQLIHQGTKMIPCDFLIPVQTQHPIRKGLHHKILLANFLAQTEALMRGKSTEEARKELQAAGKSPEDLERLLPHKVFEGNRPTNSIVFTKLTPFMLGALVAMYEHKIFVQGIIWDINSFDQWGVELGKQLAKKIEPELDGSAQVTSHDASTNGLINFIKQQREARVQ

SEQ ID NO: 1772 - protein, 278 aa, unidentified
MEENMEEGQTQKGCFECCIKCLGGIPYASLIATILLYAGVALFCGCGHEALSGTVNILQTYFEMARTAGDTLDVFTMIDIFKYVIYGIAAAFFVYGILLMVEGFFTTGAIKDLYGDFKITTCGRCVSAWFIMLTYLFMLAWLGVTAFTSLPVYMYFNLWTICRNTTLVEGANLCLDLRQFGIVTIGEEKKICTVSENFLRMCESTELNMTFHLFIVALAGAGAAVIAMVHYLMVLSANWAYVKDACRMQKYEDIKSKEEQELHDIHSTRSKERLNAYT

SEQ ID NO: 1773 - protein, 265 aa, unidentified
MKPAMETAAEENTEQSQERKGCFECCIKCLGGVPYASLVATILCFSGVALFCGCGHVALAGTVAILEQHFSTNASDHALLSEVIQLMQYVIYGIASFFFLYGIILLAEGFYTTSAVKELHGEFKTTACGRCISGMFVFLTYVLGVAWLGVFGFSAVPVFMFYNIWSTCEVIKSPQTNGTTGVEQICVDIRQYGIIPWNAFPGKICGSALENICNTNEFYMSYHLFIVACAGAGATVIALLIYMMATTYNYAVLKFKSREDCCTKF

SEQ ID NO: 1774 - protein, 572 aa, unidentified
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETFLKDLPIMFDVLIHDPSHFLNYSTINYKWSFGDNTGLFVSTNHTVNHTYVLNGTFSLNLTVKAAAPGPCPPPPPPPRPSKPTPSLATTLKSYDSNTPGPAGDNPLELSRIPDENCQINRYGHFQATITIVEGILEVNIIQMTDVLMPVPWPESSLIDFVVTCQGSIPTEVCTIISDPTCEITQNTVCSPVDVDEMCLLTVRRTFNGSGTYCVNLTLGDDTSLALTSTLISVPDRDPASPLRMANSALISVGCLAIFVTVISLLVYKKHKEYNPIENSPGNVVRSKGLSVFLNRAKAVFFPGNQEKDPLLKNQEFKGVS

SEQ ID NO: 1775 - protein, 355 aa, unidentified
MEDLEETLFEEFENYSYDLDYYSLESDLEEKVQLGVVHWVSLVLYCLAFVLGIPGNAIVIWFTGFKWKKTVTTLWFLNLAIADFIFLLFLPLYISYVAMNFHWPFGIWLCKANSFTAQLNMFASVFFLTVISLDHYIHLIHPVLSHRHRTLKNSLIVIIFIWLLASLIGGPALYFRDTVEFNNHTLCYNNFQKHDPDLTLIRHHVLTWVKFIIGYLFPLLTMSICYLCLIFKVKKRSILISSRHFWTILVVVVAFVVCWTPYHLFSIWELTIHHNSYSHHVMQAGIPLSTGLAFLNSCLNPILYVLISKKFQARFRSSVAEILKYTLWEVSCSGTVSEQLRNSETKNLCLLETAQ

SEQ ID NO: 1776 - protein, 508 aa, unidentified
MTSTCTNSTRESNSSHTCMPLSKMPISLAHGIIRSTVLVIFLAASFVGNIVLALVLQRKPQLLQVTNRFIFNLLVTDLLQISLVAPWVVATSVPLFWPLNSHFCTALVSLTHLFAFASVNTIVVVSVDRYLSIIHPLSYPSKMTQRRGYLLLYGTWIVAILQSTPPLYGWGQAAFDERNALCSMIWGASPSYTILSVVSFIVIPLIVMIACYSVVFCAARRQHALLYNVKRHSLEVRVKDCVENEDEEGAEKKEEFQDESEFRRQHEGEVKAKEGRMEAKDGSLKAKEGSTGTSESSVEARGSEEVRESSTVASDGSMEGKEGSTKVEENSMKADKGRTEVNQCSIDLGEDDMEFGEDDINFSEDDVEAVNIPESLPPSRRNSNSNPPLPRCYQCKAAKVIFIIIFSYVLSLGPYCFLAVLAVWVDVETQVPQWVITIIIWLFFLQCCIHPYVYGYMHKTIKKEIQDMLKKFFCKEKPPKEDSHPDLPGTEGGTEGKIVPSYDSATFP

SEQ ID NO: 1777 - protein, 600 aa, unidentified
MAALAPVGSPASRGPRLAAGLRLLPMLGLLQLLAEPGLGRVHHLALKDDVRHKVHLNTFGFFKDGYMVVNVSSLSLNEPEDKDVTIGFSLDRTKNDGFSSYLDEDVNYCILKKQSVSVTLLILDISRSEVRVKSPPEAGTQLPKIIFSRDEKVLGQSQEPNVNPASAGNQTQKTQDGGKSKRSTVDSKAMGEKSFSVHNNGGAVSFQFFFNISTDDQEGLYSLYFHKCLGKELPSDKFTFSLDIEITEKNPDSYLSAGEIPLPKLYISMAFFFFLSGTIWIHILRKRRNDVFKIHWLMAALPFTKSLSLVFHAIDYHYISSQGFPIEGWAVVYYITHLLKGALLFITIALIGTGWAFIKHILSDKDKKIFMIVIPLQVLANVAYIIIESTEEGTTEYGLWKDSLFLVDLLCCGAILFPVVWSIRHLQEASATDGKGDSMGPLQQRANLRAGSRIESHHFAQADLELLASSCPPASVSQRAGITAAINLAKLKLFRHYYVLIVCYIYFTRIIAFLLKLAVPFQWKWLYQLLDETATLVFFVLTGYKFRPASDNPYLQLSQEEEDLEMESVVTTSGVMESMKKVKKVTNGSVEPQGEWEGAV

SEQ ID NO: 1778 - protein, 543 aa, unidentified
MAVSERRGLGRGSPAEWGQRLLLVLLLGGCSGRIHQLALTGEKRADIQLNSFGFYTNGSLEVELSVLRLGLREAEEKSLLVGFSLSRVRSGRVRSYSTRDFQDCPLQKNSSSFLVLFLINTKDLQVQVRKYGEQKTLFIFPGLLPEAPSKPGLPKPQATVPRKVDGGGTSAASKPKSTPAVIQGPSGKDKDLVLGLSHLNNSYNFSFHVVIGSQAEEGQYSLNFHNCNNSVPGKEHPFDITVMIREKNPDGFLSAAEMPLFKLYMVMSACFLAAGIFWVSILCRNTYSVFKIHWLMAALAFTKSISLLFHSINYYFINSQGHPIEGLAVMYYIAHLLKGALLFITIALIGSGWAFIKYVLSDKEKKVFGIVIPMQVLANVAYIIIESREEGASDYVLWKEILFLVDLICCGAILFPVVWSIRHLQDASGTDGKVAVNLAKLKLFRHYYVMVICYVYFTRIIAILLQVAVPFQWQWLYQLLVEGSTLAFFVLTGYKFQPTGNNPYLQLPQEDEEDVQMEQVMTDSGFREGLSKVNKTASGRELL

SEQ ID NO: 1779 - protein, 335 aa, unidentified
MESSFSFGVILAVLASLIIATNTLVAVAVLLLIHKNDGVSLCFTLNLAVADTLIGVAISGLLTDQLSSPSRPTQKTLCSLRMAFVTSSAAASVLTVMLITFDRYLAIKQPFRYLKIMSGFVAGACIAGLWLVSYLIGFLPLGIPMFQQTAYKGQCSFFAVFHPHFVLTLSCVGFFPAMLLFVFFYCDMLKIASMHSQQIRKMEHAGAMAGGYRSPRTPSDFKALRTVSVLIGSFALSWTPFLITGIVQVACQECHLYLVLERYLWLLGVGNSLLNPLIYAYWQKEVRLQLYHMALGVKKVLTSFLLFLSARNCGPERPRESSCHIVTISSSEFDG

SEQ ID NO: 1780 - protein, 334 aa, unidentified
MNEDLKVNLSGLPRDYLDAAAAENISAAVSSRVPAVEPEPELVVNPWDIVLCTSGTLISCENAIVVLIIFHNPSLRAPMFLLIGSLALADLLAGIGLITNFVFAYLLQSEATKLVTIGLIVASFSASVCSLLAITVDRYLSLYYALTYHSERTVTFTYVMLVMLWGTSICLGLLPVMGWNCLRDESTCSVVRPLTKNNAAILSVSFLFMFALMLQLYIQICKIVMRHAHQIALQHHFLATSHYVTTRKGVSTLAIILGTFAACWMPFTLYSLIADYTYPSIYTYATLLPATYNSIINPVIYAFRNQEIQKALCLICCGCIPSSLAQRARSPSDV

SEQ ID NO: 1781 - protein, 380 aa, unidentified
MCPMLLKNGYNGNATPVTTTAPWASLGLSAKTCNNVSFEESRIVLVVVYSAVCTLGVPANCLTAWLALLQVLQGNVLAVYLLCLALCELLYTGTLPLWVIYIRNQHRWTLGLLACKVTAYIFFCNIYVSILFLCCISCDRFVAVVYALESRGRRRRRTAILISACIFILVGIVHYPVFQTEDKETCFDMLQMDSRIAGYYYARFTVGFAIPLSIIAFTNHRIFRSIKQSMGLSAAQKAKVKHSAIAVVVIFLVCFAPYHLVLLVKAAAFSYYRGDRNAMCGLEERLYTASVVFLCLSTVNGVADPIIYVLATDHSRQEVSRIHKGWKEWSMKTDVTRLTHSRDTEELQSPVALADHYTFSRPVHPPGSPCPAKRLIEESC

SEQ ID NO: 1782 - protein, 494 aa, unidentified
MEEPQPPRPPASMALLGSQHSGAPSAAGPPGGTSSAATAAVLSFSTVATAALGNLSDASGGGTAAAPGGGGLGGSGAAREAGAAVRRPLGPEAAPLLSHGAAVAAQALVLLLIFLLSSLGNCAVMGVIVKHRQLRTVTNAFILSLSLSDLLTALLCLPAAFLDLFTPPGGSAPAAAAGPWRGFCAASRFFSSCFGIVSTLSVALISLDRYCAIVRPPREKIGRRRALQLLAGAWLTALGFSLPWELLGAPRELAAAQSFHGCLYRTSPDPAQLGAAFSVGLVVACYLLPFLLMCFCHYHICKTVRLSDVRVRPVNTYARVLRFFSEVRTATTVLIMIVFVICCWGPYCFLVLLAAARQAQTMQAPSLLSVVAVWLTWANGAINPVIYAIRNPNISMLLGRNREEGYRTRNVDAFLPSQGPGLQARSRSRLRNRYANRLGACNRMSSSNPASGVAGDVAMWARKNPVVLFCREGPPEPVTAVTKQPKSEAGDTSL

SEQ ID NO: 1783 - protein, 417 aa, unidentified
MESNLSGLVPAAGLVPALPPAVTLGLTAAYTTLYALLFFSVYAQLWLVLLYGHKRLSYQTVFLALCLLWAALRTTLFSFYFRDTPRANRLGPLPFWLLYCCPVCLQFFTLTLMNLYFAQVVFKAKVKRRPEMSRGLLAVRGAFVGASLLFLLVNVLCAVLSHRRRAQPWALLLVRVLVSDSLFVICALSLAACLCLVARRAPSTSIYLEAKGTSVCQAAAMGGAMVLLYASRACYNLTALALAPQSRLDTFDYDWYNVSDQADLVNDLGNKGYLVFGLILFVWELLPTTLLVGFFRVHRPPQDLSTSHILNGQVFASRSYFFDRAGHCEDEGCSWEHSRGESTRCQDQAATTTVSTPPHRRDPPPSPTEYPGPSPPHPRPLCQVCLPLLAQDPGGRGYPLLWPAPCCSCHSELVPSP

SEQ ID NO: 1784 - protein, 399 aa, unidentified
MRPERPRPRGSAPGPMETPPWDPARNDSLPPTLTPAVPPYVKLGLTVVYTVFYALLFVFIYVQLWLVLRYRHKRLSYQSVFLFLCLFWASLRTVLFSFYFKDFVAANSLSPFVFWLLYCFPVCLQFFTLTLMNLYFTQVIFKAKSKYSPELLKYRLPLYLASLFISLVFLLVNLTCAVLVKTGNWERKVIVSVRVAINDTLFVLCAVSLSICLYKISKMSLANIYLESKGSSVCQVTAIGVTVILLYTSRACYNLFILSFSQNKSVHSFDYDWYNVSDQADLKNQLGDAGYVLFGVVLFVWELLPTTLVVYFFRVRNPTKDLTNPGMVPSHGFSPRSYFFDNPRRYDSDDDLAWNIAPQGLQGGFAPDYYDWGQQTNSFLAQAGTLQDSTLDPDKPSLG

SEQ ID NO: 1785 - protein, 429 aa, unidentified
MRVSVPGPAAAAAPAAGREPSTPGGGSGGGGAVAAASGAAVPGSVQLALSVLHALLYAALFAFAYLQLWRLLLYRERRLSYQSLCLFLCLLWAALRTTLFSAAFSLSGSLPLLRPPAHLHFFPHWLLYCFPSCLQFSTLCLLNLYLAEVICKVRCATELDRHKILLHLGFIMASLLFLVVNLTCAMLVHGDVPENQLKWTVFVRALINDSLFILCAISLVCYICKITKMSSANVYLESKGMSLCQTVVVGSVVILLYSSRACYNLVVVTISQDTLESPFNYGWDNLSDKAHVEDISGEEYIVFGMVLFLWEHVPAWSVVLFFRAQRLNQNLAPAGMINSHSYSSRAYFFDNPRRYDSDDDLPRLGSSREGSLPNSQSLGWYGTMTGCGSSSYTVTPHLNGPMTDTAPLLFTCSNLDLNNHHSLYVTPQN

SEQ ID NO: 1786 - protein, 353 aa, unidentified
MEHTHAHLAANSSLSWWSPGSACGLGFVPVVYYSLLLCLGLPANILTVIILSQLVARRQKSSYNYLLALAAADILVLFFIVFVDFLLEDFILNMQMPQVPDKIIEVLEFSSIHTSIWITVPLTIDRYIAVCHPLKYHTVSYPARTRKVIVSVYITCFLTSIPYYWWPNIWTEDYISTSVHHVLIWIHCFTVYLVPCSIFFILNSIIVYKLRRKSNFRLRGYSTGKTTAILFTITSIFATLWAPRIIMILYHLYGAPIQNRWLVHIMSDIANMLALLNTAINFFLYCFISKRFRTMAAATLKAFFKCQKQPVQFYTNHNFSITSSPWISPANSHCIKMLVYQYDKNGKPIKVSP

SEQ ID NO: 1787 - protein, 305 aa, unidentified
MPGHNTSRNSSCDPIVTPHLISLYFIVLIGGLVGVISILFLLVKMNTRSVTTMAVINLVVVHSVFLLTVPFRLTYLIKKTWMFGLPFCKFVSAMLHIHMYLTFLFYVVILVTRYLIFFKCKDKVEFYRKLHAVAASAGMWTLVIVIVVPLVVSRYGIHEEYNEEHCFKFHKELAYTYVKIINYMIVIFVIAVAVILLVFQVFIIMLMVQKLRHSLLSHQEFWAQLKNLFFIGVILVCFLPYQFFRIYYLNVVTHSNACNSKVAFYNEIFLSVTAISCYDLLLFVFGGSHWFKQKIIGLWNCVLCR

SEQ ID NO: 1788 - protein, 462 aa, unidentified
MSIMMLPMEQKIQWVPTSLQDITAVLGTEAYTEEDKSMVSHAQKSQHSCLSHSRWLRSPQVTGGSWDLRIRPSKDSSSFRQAQCLRKDPGANNHLESQGVRGTAGDADRELRGPSEKATAGQPRVTLLPTPHVSGLSQEFESHWPEIAERSPCVAGVIPVIYYSVLLGLGLPVSLLTAVALARLATRTRRPSYYYLLALTASDIIIQVVIVFAGFLLQGAVLARQVPQAVVRTANILEFAANHASVWIAILLTVDRYTALCHPLHHRAASSPGRTRRAIAAVLSAALLTGIPFYWWLDMWRDTDSPRTLDEVLKWAHCLTVYFIPCGVFLVTNSAIIHRLRRRGRSGLQPRVGKSTAILLGITTLFTLLWAPRVFVMLYHMYVAPVHRDWRVHLALDVANMVAMLHTAANFGLYCFVSKTFRATVRQVIHDAYLPCTLASQPEGMAAKPVMEPPGLPTGAEV

SEQ ID NO: 1789 - protein, 404 aa, unidentified
MASPRLGTFCCPTRDAATQLVLSFQPRAFHALCLGSGGLRLALGLLQLLPGRRPAGPGSPATSPPASVRILRAAAACDLLGCLGMVIRSTVWLGFPNFVDSVSDMNHTEIWPAAFCVGSAMWIQLLYSACFWWLFCYAVDAYLVIRRSAGLSTILLYHIMAWGLATLLCVEGAAMLYYPSVSRCERGLDHAIPHYVTMYLPLLLVLVANPILFQKTVTAVASLLKGRQGIYTENERRMGAVIKIRFFKIMLVLIICWLSNIINESLLFYLEMQTDINGGSLKPVRTAAKTTWFIMGILNPAQGFLLSLAFYGWTGCSLGFQSPRKEIQWESLTTSAAEGAHPSPLMPHENPASGKVSQVGGQTSDEALSMLSEGSDASTIEIHTASESCNKNEGDPALPTHGDL

SEQ ID NO: 1790 - protein, 333 aa, unidentified
MWSCSWFNGTGLVEELPACQDLQLGLSLLSLLGLVVGVPVGLCYNALLVLANLHSKASMTMPDVYFVNMAVAGLVLSALAPVHLLGPPSSRWALWSVGGEVHVALQIPFNVSSLVAMYSTALLSLDHYIERALPRTYMASVYNTRHVCGFVWGGALLTSFSSLLFYICSHVSTRALECAKMQNAEAADATLVFIGYVVPALATLYALVLLSRVRREDTPLDRDTGRLEPSAHRLLVATVCTQFGLWTPHYLILLGHTVIISRGKPVDAHYLGLLHFVKDFSKLLAFSSSFVTPLLYRYMNQSFPSKLQRLMKKLPCGDRHCSPDHMGVQQVLA

SEQ ID NO: 1791 - protein, 347 aa, unidentified
MGDELAPCPVGTTAWPALIQLISKTPCMPQAASNTSLGLGDLRVPSSMLYWLFLPSSLLAAATLAVSPLLLVTILRNQRLRQEPHYLLPANILLSDLAYILLHMLISSSSLGGWELGRMACGILTDAVFAACTSTILSFTAIVLHTYLAVIHPLRYLSFMSHGAAWKAVALIWLVACCFPTFLIWLSKWQDAQLEEQGASYILPPSMGTQPGCGLLVIVTYTSILCVLFLCTALIANCFWRIYAEAKTSGIWGQGYSRARGTLLIHSVLITLYVSTGVVFSLDMVLTRYHHIDSGTHTWLLAANSEVLMMLPRAMLTYLYLLRYRQLLGMVRGHLPSRRHQAIFTIS

SEQ ID NO: 1792 - protein, 731 aa, unidentified
MSLFLSNLSTNDSSLWKENHNSTDLLNPPGTLNIYLFCLTCLMTFAALVGSIYSLISLLKMQNRTVVSMLVASWSVDDLMSVLSVTIFMFLQWPNEVPGYFQFLCTTSALMYLCQGLSSNLKATLLVSYNFYTMHRGVGSQTASRRSGQVLGVVLTVWAASLLLSALPLCGWGAFVRTPWGCLVDCSSSYVLFLSIVYALAFGLLVGLSVPLTHRLLCSEEPPRLHSNYQEISRGASIPGTPPTAGRVVSLSPEDAPGPSLRRSGGCSPSSDTVFGPGAPAAAGAEACRRENRGTLYGTRSFTVSVAQKRFALILALTKVVLWLPMMMHMVVQNVVGFQSLPLETFSFLLTLLATTVTPVFVLSKRWTHLPCGCIINCRQNAYAVASDGKKIKRKGFEFNLSFQKSYGIYKIAHEDYYDDDENSIFYHNLMNSECETTKDPQRDNRNIFNAIKVEISTTPSLDSSTQRGINKCTNTDITEAKQDSNNKKDAFSDKTGGDINYEETTFSEGPERRLSHEESQKPDLSDWEWCRSKSERTPRQRSGYALAIPLCAFQGTVSLHAPTGKTLSLSTYEVSAEGQKITPASKKIEVYRSKSVGHEPNSEDSSSTFVDTSVKIHLEVLEICDNEEALDTVSIISNISQSSTQVRSPSLRYSRKENRFVSCDLGETASYSLFLPTSNPDGDINISIPDTVEAHRQNSKRQHQERDGYQEEIQLLNKAYRKREEESKGS

SEQ ID NO: 1793 - protein, 360 aa, unidentified
MDPEETSVYLDYYYATSPNSDIRETHSHVPYTSVFLPVFYTAVFLTGVLGNLVLMGALHFKPGSRRLIDIFIINLAASDFIFLVTLPLWVDKEASLGLWRTGSFLCKGSSYMISVNMHCSVLLLTCMSVDRYLAIVWPVVSRKFRRTDCAYVVCASIWFISCLLGLPTLLSRELTLIDDKPYCAEKKATPIKLIWSLVALIFTFFVPLLSIVTCYCCIARKLCAHYQQSGKHNKKLKKSIKIIFIVVAAFLVSWLPFNTFKFLAIVSGLRQEHYLPSAILQLGMEVSGPLAFANSCVNPFIYYIFDSYIRRAIVHCLCPCLKNYDFGSSTETSDSHLTKALSTFIHAEDFARRRKRSVSL

SEQ ID NO: 1794 - protein, 434 aa, unidentified
MEDLFSPSILPPAPNISVPILLGWGLNLTLGQGAPASGPPSRRVRLVFLGVILVVAVAGNTTVLCRLCGGGGPWAGPKRRKMDFLLVQLALADLYACGGTALSQLAWELLGEPRAATGDLACRFLQLLQASGRGASAHLVVLIALERRRAVRLPHGRPLPARALAALGWLLALLLALPPAFVVRGDSPSPLPPPPPPTSLQPGAPPAARAWPGERRCHGIFAPLPRWHLQVYAFYEAVAGFVAPVTVLGVACGHLLSVWWRHRPQAPAAAAPWSASPGRAPAPSALPRAKVQSLKMSLLLALLFVGCELPYFAARLAAAWSSGPAGDWEGEGLSAALRVVAMANSALNPFVYLFFQAGDCRLRRQLRKRLGSLCCAPQGGAEDEEGPRGHQALYRQRWPHPHYHHARREPLDEGGLRPPPPRPRPLPCSCESAF

SEQ ID NO: 1795 - protein, 419 aa, unidentified
MLAAAFADSNSSSMNVSFAHLHFAGGYLPSDSQDWRTIIPALLVAVCLVGFVGNLCVIGILLHNAWKGKPSMIHSLILNLSLADLSLLLFSAPIRATAYSKSVWDLGWFVCKSSDWFIHTCMAAKSLTIVVVAKVCFMYASDPAKQVSIHNYTIWSVLVAIWTVASLLPLPEWFFSTIRHHEGVEMCLVDVPAVAEEFMSMFGKLYPLLAFGLPLFFASFYFWRAYDQCKKRGTKTQNLRNQIRSKQVTVMLLSIAIISALLWLPEWVAWLWVWHLKAAGPAPPQGFIALSQVLMFSISSANPLIFLVMSEEFREGLKGVWKWMITKKPPTVSESQETPAGNSEGLPDKVPSPESPASIPEKEKPSSPSSGKGKTEKAEIPILPDVEQFWHERDTVPSVQDNDPIPWEHEDQETGEGVK

SEQ ID NO: 1796 - protein, 470 aa, unidentified
MDTTMEADLGATGHRPRTELDDEDSYPQGGWDTVFLVALLLLGLPANGLMAWLAGSQARHGAGTRLALLLLSLALSDFLFLAAAAFQILEIRHGGHWPLGTAACRFYYFLWGVSYSSGLFLLAALSLDRCLLALCPHWYPGHRPVRLPLWVCAGVWVLATLFSVPWLVFPEAAVWWYDLVICLDFWDSEELSLRMLEVLGGFLPFLLLLVCHVLTQATACRTCHRQQQPAACRGFARVARTILSAYVVLRLPYQLAQLLYLAFLWDVYSGYLLWEALVYSDYLILLNSCLSPFLCLMASADLRTLLRSVLSSFAAALCEERPGSFTPTEPQTQLDSEGPTLPEPMAEAQSQMDPVAQPQVNPTLQPRSDPTAQPQLNPTAQPQSDPTAQPQLNLMAQPQSDSVAQPQADTNVQTPAPAASSVPSPCDEASPTPSSHPTPGALEDPATPPASEGESPSSTPPEAAPGAGPT

SEQ ID NO: 1797 - protein, 609 aa, unidentified
MSDERRLPGSAVGWLVCGGLSLLANAWGILSVGAKQKKWKPLEFLLCTLAATHMLNVAVPIATYSVVQLRRQRPDFEWNEGLCKVFVSTFYTLTLATCFSVTSLSYHRMWMVCWPVNYRLSNAKKQAVHTVMGIWMVSFILSALPAVGWHDTSERFYTHGCRFIVAEIGLGFGVCFLLLVGGSVAMGVICTAIALFQTLAVQVGRQADRRAFTVPTIVVEDAQGKRRSSIDGSEPAKTSLQTTGLVTTIVFIYDCLMGFPVLVVSFSSLRADASAPWMALCVLWCSVAQALLLPVFLWACDRYRADLKAVREKCMALMANDEESDDETSLEGGISPDLVLERSLDYGYGGDFVALDRMAKYEISALEGGLPQLYPLRPLQEDKMQYLQVPPTRRFSHDDADVWAAVPLPAFLPRWGSGEDLAALAHLVLPAGPERRRASLLAFAEDAPPSRARRRSAESLLSLRPSALDSGPRGARDSPPGSPRRRPGPGPRSASASLLPDAFALTAFECEPQALRRPPGPFPAAPAAPDGADPGEAPTPPSSAQRSPGPRPSAHSHAGSLRPGLSASWGEPGGLRAAGGGGSTSSFLSSPSESSGYATLHSDSLGSAS

SEQ ID NO: 1798 - protein, 870 aa, unidentified
MNSNLPAENLTIAVNMTKTLPTAVTHGFNSTNDPPSMSITRLFPALLECFGIVLCGYIAGRANVITSTQAKGLGNFVSRFALPALLFKNMVVLNFSNVDWSFLYSILIAKASVFFIVCVLTLLVASPDSRFSKAGLFPIFATQSNDFALGYPIVEALYQTTYPEYLQYIYLVAPISLMMLNPIGFIFCEIQKWKDTQNASQNKIKIVGLGLLRVLQNPIVFMVFIGIAFNFILDRKVPVYVENFLDGLGNSFSGSALFYLGLTMVGKIKRLKKSAFVVLILLITAKLLVLPLLCREMVELLDKGDSVVNHTSLSNYAFLYGVFPVAPGVAIFATQFNMEVEIITSGMVISTFVSAPIMYVSAWLLTFPTMDPKPLAYAIQNVSFDISIVSLISLIWSLAILLLSKKYKQLPHMLTTNLLIAQSIVCAGMMIWNFVKEKNFVGQILVFVLLYSSLYSTYLWTGLLAISLFLLKKRERVQIPVGIIIISGWGIPALLVGVLLITGKHNGDSIDSAFFYGKEQMITTAVTLFCSILIAGISLMCMNQTAQAGSYEGFDQSQSHKVVEPGNTAFEESPAPVNEPELFTSSIPETSCCSCSMGNGELHCPSIEPIANTSTSEPVIPSFEKNNHCVSRCNSQSCILAQEEEQYLQSGDQQLTRHVLLCLLLIIGLFANLSSCLWWLFNQEPGRLYVELQFFCAVFNFGQGFISFGIFGLDKHLIILPFKRRLEFLWNNKDTAENRDSPVSEEIKMTCQQFIHYHRDLCIRNIVKERRCGAKTSAGTFCGCDLVSWLIEVGLASDRGEAVIYGDRLVQGGVIQHITNEYEFRDEYLFYRFLQKSPEQSPPAINANTLQQERYKEIEHSSPPSHSPKT

SEQ ID NO: 1799 - protein, 814 aa, unidentified
MEPEINCSELCDSFPGQELDRRPLHDLCKTTITSSHHSSKTISSLSPVLLGIVWTFLSCGLLLILFFLAFTIHCRKNRIVKMSSPNLNIVTLLGSCLTYSSAYLFGIQDVLVGSSMETLIQTRLSMLCIGTSLVFGPILGKSWRLYKVFTQRVPDKRVIIKDLQLLGLVAALLMADVILLMTWVLTDPIQCLQILSVSMTVTGKDVSCTSTSTHFCASRYSDVWIALIWGCKGLLLLYGAYLAGLTGHVSSPPVNQSLTIMVGVNLLVLAAGLLFVVTRYLHSWPNLVFGLTSGGIFVCTTTINCFIFIPQLKQWKAFEEENQTIRRMAKYFSTPNKSFHTQYGEEENCHPRGEKSSMERLLTEKNAVIESLQEQVNNAKEKIVRLMSAECTYDLPEGAAPPASSPNKDVQAVASVHTLAAAQGPSGHLSDFQNDPGMAARDSQCTSGPSSYAQSLEGPGKDSSFSPGKEEKISDSKDFSDHLDSGCSQKPWTEQSLGPERGDQVPMNPSQSLLPERGGSDPQRQRHLENSEEPPERRSRVSSVIREKLQEVLQDLGLGPEASLSTAPSCHQQTWKNSAAFSPQKMPLSKELGFSPYMVRRRRAAQRARSHFPGSAPSSVGHRANRTVPGAHSRLHVQNGDSPSLAPQTTDSRVRRPSSRKPSLPSDPQDRPGTLEGSKQSQTEPEGARGSKAAFLRQPSGSGRAPSPAAPCLSKASPDLPEQWQLWPPVPSGCASLSSQHSYFDTESSSSDEFFCRCHRPYCEICFQSSSDSSDSGTSDTDPEPTGGLASWEKLWARSKPIVNFKDDLKPTLV

SEQ ID NO: 1800 - protein, 335 aa, unidentified
MQPSPPPTELVPSERAVVLLSCALSALGSGLLVATHALWPDLRSRARRLLLFLSLADLLSAASYFYGVLQNFAGPSWDCVLQGALSTFANTSSFFWTVAIALYLYLSIVRAARGPRTDRLLWAFHVVSWGVPLVITVAAVALKKIGYDASDVSVGWCWIDLEAKDHVLWMLLTGKLWEMLAYVLLPLLYLLVRKHINRAHTALSEYRPILSQEHRLLRHSSMADKKLVLIPLIFIGLRVWSTVRFVLTLCGSPAVQTPVLVVLHGIGNTFQGGANCIMFVLCTRAVRTRLFSLCCCCCSSQPPTKSPAGTPKAPAPSKPGESQESQGTPGELPST

SEQ ID NO: 1801 - protein, 1215 aa, unidentified
MGAMAYPLLLCLLLAQLGLGAVGASRDPQGRPDSPRERTPKGKPHAQQPGRASASDSSAPWSRSTDGTILAQKLAEEVPMDVASYLYTGDSHQLKRANCSGRYELAGLPGKWPALASAHPSLHRALDTLTHATNFLNVMLQSNKSREQNLQDDLDWYQALVWSLLEGEPSISRAAITFSTDSLSAPAPQVFLQATREESRILLQDLSSSAPHLANATLETEWFHGLRRKWRPHLHRRGPNQGPRGLGHSWRRKDGLGGDKSHFKWSPPYLECENGSYKPGWLVTLSSAIYGLQPNLVPEFRGVMKVDINLQKVDIDQCSSDGWFSGTHKCHLNNSECMPIKGLGFVLGAYECICKAGFYHPGVLPVNNFRRRGPDQHISGSTKDVSEEAYVCLPCREGCPFCADDSPCFVQEDKYLRLAIISFQALCMLLDFVSMLVVYHFRKAKSIRASGLILLETILFGSLLLYFPVVILYFEPSTFRCILLRWARLLGFATVYGTVTLKLHRVLKVFLSRTAQRIPYMTGGRVMRMLAVILLVVFWFLIGWTSSVCQNLEKQISLIGQGKTSDHLIFNMCLIDRWDYMTAVAEFLFLLWGVYLCYAVRTVPSAFHEPRYMAVAVHNELIISAIFHTIRFVLASRLQSDWMLMLYFAHTHLTVTVTIGLLLIPKFSHSSNNPRDDIATEAYEDELDMGRSGSYLNSSINSAWSEHSLDPEDIRDELKKLYAQLEIYKRKKMITNNPHLQKKRCSKKGLGRSIMRRITEIPETVSRQCSKEDKEGADHGTAKGTALIRKNPPESSGNTGKSKEETLKNRVFSLKKSHSTYDHVRDQTEESSSLPTESQEEETTENSTLESLSGKKLTQKLKEDSEAESTESVPLVCKSASAHNLSSEKKTGHPRTSMLQKSLSVIASAKEKTLGLAGKTQTAGVEERTKSQKPLPKDKETNRNHSNSDNTETKDPAPQNSNPAEEPRKPQKSGIMKQQRVNPTTANSDLNPGTTQMKDNFDIGEVCPWEVYDLTPGPVPSESKVQKHVSIVASEMEKNPTFSLKEKSHHKPKAAEVCQQSNQKRIDKAEVCLWESQGQSILEDEKLLISKTPVLPERAKEENGGQPRAANVCAGQSEELPPKAVASKTENENLNQIGHQEKKTSSSEENVRGSYNSSNNFQQPLTSRAEVCPWEFETPAQPNAGRSVALPASSALSANKIAGPRKEEIWDSFKV

SEQ ID NO: 1802 - protein, 338 aa, unidentified
MTALSSENCSFQYQLRQTNQPLDVNYLLFLIILGKILLNILTLGMRRKNTCQNFMEYFCISLAFVDLLLLVNISIILYFRDFVLLSIRFTKYHICLFTQIISFTYGFLHYPVFLTACIDYCLNFSKTTKLSFKCQKLFYFFTVILIWISVLAYVLGDPAIYQSLKAQNAYSRHCPFYVSIQSYWLSFFMVMILFVAFITCWEEVTTLVQAIRITSYMNETILYFPFSSHSSYTVRSKKIFLSKLIVCFLSTWLPFVLLQVIIVLLKVQIPAYIEMNIPWLYFVNSFLIATVYWFNCHKLNLKDIGLPLDPFVNWKCCFIPLTIPNLEQIEKPISIMIC

SEQ ID NO: 1803 - protein, 529 aa, unidentified
MSLNSSLSCRKELSNLTEEEGGEGGVIITQFIAIIVITIFVCLGNLVIVVTLYKKSYLLTLSNKFVFSLTLSNFLLSVLVLPFVVTSSIRREWIFGVVWCNFSALLYLLISSASMLTLGVIAIDRYYAVLYPMVYPMKITGNRAVMALVYIWLHSLIGCLPPLFGWSSVEFDEFKWMCVAAWHREPGYTAFWQIWCALFPFLVMLVCYGFIFRVARVKARKVHCGTVVIVEEDAQRTGRKNSSTSTSSSGSRRNAFQGVVYSANQCKALITILVVLGAFMVTWGPYMVVIASEALWGKSSVSPSLETWATWLSFASAVCHPLIYGLWNKTVRKELLGMCFGDRYYREPFVQRQRTSRLFSISNRITDLGLSPHLTALMAGGQPLGHSSSTGDTGFSCSQDSGTDMMLLEDYTSDDNPPSHCTCPPKRRSSVTFEDEVEQIKEAAKNSILHVKAEVHKSLDSYAASLAKAIEAEAKINLFGEEALPGVLVTARTVPGGGFGGRRGSRTLVSQRLQLQSIEEGDVLAAEQR

SEQ ID NO: 1804 - protein, 588 aa, unidentified
MARGGAGAEEASLRSNALSWLACGLLALLANAWIILSISAKQQKHKPLELLLCFLAGTHILMAAVPLTTFAVVQLRRQASSDYDWNESICKVFVSTYYTLALATCFTVASLSYHRMWMVRWPVNYRLSNAKKQALHAVMGIWMVSFILSTLPSIGWHNNGERYYARGCQFIVSKIGLGFGVCFSLLLLGGIVMGLVCVAITFYQTLWARPRRARQARRVGGGGGTKAGGPGALGTRPAFEVPAIVVEDARGKRRSSLDGSESAKTSLQVTNLVSAIVFLYDSLTGVPILVVSFFSLKSDSAPPWMVLAVLWCSMAQTLLLPSFIWSCERYRADVRTVWEQCVAIMSEEDGDDDGGCDDYAEGRVCKVRFDANGATGPGSRDPAQVKLLPGRHMLFPPLERVHYLQVPLSRRLSHDETNIFSTPREPGSFLHKWSSSDDIRVLPAQSRALGGPPEYLGQRHRLEDEEDEEEAEGGGLASLRQFLESGVLGSGGGPPRGPGFFREEITTFIDETPLPSPTASPGHSPRRPRPLGLSPRRLSLGSPESRAVGLPLGLSAGRRCSLTGGEESARAWGGSWGPGNPIFPQLTL

SEQ ID NO: 1805 - protein, 367 aa, unidentified
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLYAHLACAFLWVVVAVAMAPLLVSPQTVQTNHTVVCLQLYREKASHHALVSLAVAFTFPFITTVTCYLLIIRSLRQGLRVEKRLKTKAVRMIAIVLAIFLVCFVPYHVNRSVYVLHYRSHGASCATQRILALANRITSCLTSLNGALDPIMYFFVAEKFRHALCNLLCGKRLKGPPPSFEGKTNESSLSAKSEL

SEQ ID NO: 1806 - protein, 319 aa, unidentified
MTNSSFFCPVYKDLEPFTYFFYLVFLVGIIGSCFATWAFIQKNTNHRCVSIYLINLLTADFLLTLALPVKIVVDLGVAPWKLKIFHCQVTACLIYINMYLSIIFLAFVSIDRCLQLTHSCKIYRIQEPGFAKMISTVVWLMVLLIMVPNMMIPIKDIKEKSNVGCMEFKKEFGRNWHLLTNFICVAIFLNFSAIILISNCLVIRQLYRNKDNENYPNVKKALINILLVTTGYIICFVPYHIVRIPYTLSQTEVITDCSTRISLFKAKEATLLLAVSNLCFDPILYYHLSKAFRSKVTETFASPKETKAQKEKLRCENNA

SEQ ID NO: 1807 - protein, 373 aa, unidentified
MANTTGEPEEVSGALSPPSASAYVKLVLLGLIMCVSLAGNAILSLLVLKERALHKAPYYFLLDLCLADGIRSAVCFPFVLASVRHGSSWTFSALSCKIVAFMAVLFCFHAAFMLFCISVTRYMAIAHHRFYAKRMTLWTCAAVICMAWTLSVAMAFPPVFDVGTYKFIREEDQCIFEHRYFKANDTLGFMLMLAVLMAATHAVYGKLLLFEYRHRKMKPVQMVPAISQNWTFHGPGATGQAAANWIAGFGRGPMPPTLLGIRQNGHAASRRLLGMDEVKGEKQLGRMFYAITLLFLLLWSPYIVACYWRVFVKACAVPHRYLATAVWMSFAQAAVNPIVCFLLNKDLKKCLRTHAPCWGTGGAPAPREPYCVM

SEQ ID NO: 1808 - protein, 333 aa, unidentified
MPANYTCTRPDGDNTDFRYFIYAVTYTVILVPGLIGNILALWVFYGYMKETKRAVIFMINLAIADLLQVLSLPLRIFYYLNHDWPFGPGLCMFCFYLKYVNMYASIYFLVCISVRRFWFLMYPFRFHDCKQKYDLYISIAGWLIICLACVLFPLLRTSDDTSGNRTKCFVDLPTRNVNLAQSVVMMTIGELIGFVTPLLIVLYCTWKTVLSLQDKYPMAQDLGEKQKALKMILTCAGVFLICFAPYHFSFPLDFLVKSNEIKSCLARRVILIFHSVALCLASLNSCLDPVIYYFSTNEFRRRLSRQDLHDSIQLHAKSFVSNHTASTMTPELC

SEQ ID NO: 1809 - protein, 515 aa, unidentified
MGHNGSWISPNASEPHNASGAEAAGVNRSALGEFGEAQLYRQFTTTVQVVIFIGSLLGNFMVLWSTCRTTVFKSVTNRFIKNLACSGICASLVCVPFDIILSTSPHCCWWIYTMLFCKVVKFLHKVFCSVTILSFPAIALDRYYSVLYPLERKISDAKSRELVMYIWAHAVVASVPVFAVTNVADIYATSTCTEVWSNSLGHLVYVLVYNITTVIVPVVVVFLFLILIRRALSASQKKKVIIAALRTPQNTISIPYASQREAELHATLLSMVMVFILCSVPYATLVVYQTVLNVPDTSVFLLLTAVWLPKVSLLANPVLFLTVNKSVRKCLIGTLVQLHHRYSRRNVVSTGSGMAEASLEPSIRSGSQLLEMFHIGQQQIFKPTEDEEESEAKYIGSADFQAKEIFSTCLEGEQGPQFAPSAPPLSTVDSVSQVAPAAPVEPETFPDKYSLQFGFGPFELPPQWLSETRNSKKRLLPPLGNTPEELIQTKVPKVGRVERKMSRNNKVSIFPKVDS

SEQ ID NO: 1810 - protein, 331 aa, unidentified
MITLNNQDQPVPFNSSHPDEYKIAALVFYSCIFIIGLFVNITALWVFSCTTKKRTTVTIYMMNVALVDLIFIMTLPFRMFYYAKDEWPFGEYFCQILGALTVFYPSIALWLLAFISADRYMAIVQPKYAKELKNTCKAVLACVGVWIMTLTTTTPLLLLYKDPDKDSTPATCLKISDIIYLKAVNVLNLTRLTFFFLIPLFIMIGCYLVIIHNLLHGRTSKLKPKVKEKSIRIIITLLVQVLVCFMPFHICFAFLMLGTGENSYNPWGAFTTFLMNLSTCLDVILYYIVSKQFQARVISVMLYRNYLRSMRRKSFRSGSLRSLSNINSEML

SEQ ID NO: 1811 - protein, 440 aa, unidentified
MGGLRLLAVALTCCWWPQGSQGKTLRGSFSSTAAQDAQGQRIGHFEFHGDHALLCVRINNIAVAVGKEAKLYLFQAQEWLKLQQSSHGYSCSEKLSKAQLTMTMNQTEHNLTVSQIPSPQTWHVFYADKYTCQDDKENSQVEDIPFEMVLLNPDAEGNPFDHFSAGESGLHEFFFLLVLVYFVIACIYAQSLWQAIKKGGPMHMILKVLTTALLLQAGSALANYIHFSSYSKDGIGVPFMGSLAEFFDIASQIQMLYLLLSLCMGWTIVRMKKSQSRPLQWDSTPASTGIAVFIVMTQSVLLLWEQFEDISHHSYHSHHNLAGILLIVLRICLALSLGCGLYQIITVERSTLKREFYITFAKGCILWFLCHPVLACISVIFSDYQRDKVITIGVILCQSVSMVILYRLFLSHSLYWEVSSLSSVTLPLTISSGHKSRPHF

SEQ ID NO: 1812 - protein, 404 aa, unidentified
MSVKPSWGPGPSEGVTAVPTSDLGEIHNWTELLDLFNHTLSECHVELSQSTKRVVLFALYLAMFVVGLVENLLVICVNWRGSGRAGLMNLYILNMAIADLGIVLSLPVWMLEVTLDYTWLWGSFSCRFTHYFYFVNMYSSIFFLVCLSVDRYVTLTSASPSWQRYQHRVRRAMCAGIWVLSAIIPLPEVVHIQLVEGPEPMCLFMAPFETYSTWALAVALSTTILGFLLPFPLITVFNVLTACRLRQPGQPKSRRHCLLLCAYVAVFVMCWLPYHVTLLLLTLHGTHISLHCHLVHLLYFFYDVIDCFSMLHCVINPILYNFLSPHFRGRLLNAVVHYLPKDQTKAGTCASSSSCSTQHSIIITKGDSQPAAAAPHPEPSLSFQAHHLLPNTSPISPTQPLTPS

SEQ ID NO: 1813 - protein, 361 aa, unidentified [sequence omitted]

SEQ ID NO: 1814 - protein, 415 aa, unidentified
MVFAHRMDNSKPHLIIPTLLVPLQNRSCTETATPLPSQYLMELSEEHSWMSNQTDLHYVLKPGEVATASIFFGILWLFSIFGNSLVCLVIHRSRRTQSTTNYFVVSMACADLLISVASTPFVLLQFTTGRWTLGSATCKVVRYFQYLTPGVQIYVLLSICIDRFYTIVYPLSFKVSREKAKKMIAASWVFDAGFVTPVLFFYGSNWDSHCNYFLPSSWEGTAYTVIHFLVGFVIPSVLIILFYQKVIKYIWRIGTDGRTVRRTMNIVPRTKVKTIKMFLILNLLFLLSWLPFHVAQLWHPHEQDYKKSSLVFTAITWISFSSSASKPTLYSIYNANFRRGMKETFCMSSMKCYRSNAYTITTSSRMAKKNYVGISEIPSMAKTITKDSIYDSFDREAKEKKLAWPINSNPPNTFV

SEQ ID NO: 1815 - protein, 358 aa, unidentified
MPSVSPAGPSAGAVPNATAVTTVRTNASGLEVPLFHLFARLDEELHGTFPGLWLALMAVHGAIFLAGLVLNGLALYVFCCRTRAKTPSVIYTINLVVTDLLVGLSLPTRFAVYYGARGCLRCAFPHVLGYFLNMHCSILFLTCICVDRYLAIVRPEGSRRCRQPACARAVCAFVWLAAGAVTLSVLGVTGSRPCCRVFALTVLEFLLPLLVISVFTGRIMCALSRPGLLHQGRQRRVRAMQLLLTVLIIFLVCFTPFHARQVAVALWPDMPHHTSLVVYHVAVTLSSLNSCMDPIVYCFVTSGFQATVRGLFGQHGEREPSSGDVVSMHRSSKGSGRHHILSAGPHALTQALANGPEA

SEQ ID NO: 1816 - protein, 349 aa, unidentified
MNSTLDGNQSSHPFCLLAFGYLETVNFCLLEVLIIVFLTVLIISGNIIVIFVFHCAPLLNHHTTSYFIQTMAYADLFVGVSCVVPSLSLLHHPLPVEESLTCQIFGFVVSVLKSVSMASLACISIDRYIAITKPLTYNTLVTPWRLRLCIFLIWLYSTLVFLPSFFHWGKPGYHGDVFQWCAESWHTDSYFTLFIVMMLYAPAALIVCFTYFNIFRICQQHTKDISERQARFSSQSGETGEVQACPDKRYAMVLFRITSVFYILWLPYIIYFLLESSTGHSNRFASFLTTWLAISNSFCNCVIYSLSNSVFQRGLKRLSGAMCTSCASQTTANDPYTVRSKGPLNGCHI

SEQ ID NO: 1817 - protein, 433 aa, unidentified
MCFSPILEINMQSESNITVRDDIDDINTNMYQPLSYPLSFQVSLTGFLMLEIVLGLGSNLTVLVLYCMKSNLINSVSNIITMNLHVLDVIICVGCIPLTIVILLLSLESNTALICCFHEACVSFASVSTAINVFAITLDRYDISVKPANRILTMGRAVMLMISIWIFSFFSFLIPFIEVNFFSLQSGNTWENKTLLCVSTNEYYTELGMYYHLLVQIPIFFFTVVVMLITYTKILQALNIRIGTRFSTGQKKKARKKKTISLTTQHEATDMSQSSGGRNVVFGVRTSVSVIIALRRAVKRHRERRERQKRVFRMSLLIISTFLLCWTPISVLNTTILCLGPSDLLVKLRLCFLVMAYGTTIFHPLLYAFTRQKFQKVLKSKMKKRVVSIVEADPLPNNAVIHNSWIDPKRNKKITFEDSEIREKCLVPQVVTD

SEQ ID NO: 1818 - protein, 361 aa, unidentified
MAPTEPWSPSPGSAPWDYSGLDGLEELELCPAGDLPYGYVYIPALYLAAFAVGLLGNAFVVWLLAGRRGPRRLVDTFVLHLAAADLGFVLTLPLWAAAAALGGRWPFGDGLCKLSSFALAGTRCAGALLLAGMSVDRYLAVVKLLEARPLRTPRCALASCCGVWAVALLAGLPSLVYRGLQPLPGGQDSQCGEEPSHAFQGLSLLLLLLTFVLPLVVTLFCYCRISRRLRRPPHVGRARRNSLRIIFAIESTFVGSWLPFSALRAVFHLARLGALPLPCPLLLALRWGLTIATCLAFVNSCANPLIYLLLDRSFRARALDGACGRTGRLARRISSASSLSRDDSSVFRCRAQAANTASASW

SEQ ID NO: 1819 - protein, 337 aa, unidentified
MNSWDAGLAGLLVGTMGVSLLSNALVLLCLLHSADIRRQAPALFTLNLTCGNLLCTVVNMPLTLAGVVAQRQPAGDRLCRLAAFLDTFLAANSMLSMAALSIDRWVAVVFPLSYRAKMRLRDAALMVAYTWLHALTFPAAALALSWLGFHQLYASCTLCSRRPDERLRFAVFTGAFHALSFLLSFVVLCCTYLKVLKVARFHCKRIDVITMQTLVLLVDLHPSVRERCLEEQKRRRQRATKKISTFIGTFLVCFAPYVITRLVELFSTVPIGSHWGVLSKCLAYSKAASDPFVYSLLRHQYRKSCKEILNRLLHRRSIHSSGLTGDSHSQNILPVSE

SEQ ID NO: 1820 - protein, 375 aa, unidentified
MANASEPGGSGGGEAAALGLKLATLSLLLCVSLAGNVLFALLIVRERSLHRAPYYLLLDLCLADGLRALACLPAVMLAARRAAAAAGAPPGALGCKLLAFLAALFCFHAAFLLLGVGVTRYLAIAHHRFYAERLAGWPCAAMLVCAAWALALAAAFPPVLDGGGDDEDAPCALEQRPDGAPGALGFLLLLAVVVGATHLVYLRLLFFIHDRRKMRPARLVPAVSHDWTFHGPGATGQAAANWTAGFGRGPTPPALVGIRPAGPGRGARRLLVLEEFKTEKRLCKMFYAVTLLFLLLWGPYVVASYLRVLVRPGAVPQAYLTASVWLTFAQAGINPVVCFLFNRELRDCFRAQFPCCQSPRTTQATHPCDLKGIGL

SEQ ID NO: 1821 - protein, 330 aa, unidentified
MMWGAGSPLAWLSAGSGNVNVSSVGPAEGPTGPAAPLPSPKAWDVVLCISGTLVSCENALVVAIIVGTPAFRAPMFLLVGSLAVADLLAGLGLVLHFAAVFCIGSAEMSLVLVGVLAMAFTASIGSLLAITVDRYLSLYNALTYYSETTVTRTYVMLALVWGGALGLGLLPVLAWNCLDGLTTCGVVYPLSKNHLVVLAIAFFMVFGIMLQLYAQICRIVCRHAQQIALQRHLLPASHYVATRKGIATLAVVLGAFAACWLPFTVYCLLGDAHSPPLYTYLTLLPATYNSMINPIIYAFRNQDVQKVLWAVCCCCSSSKIPFRSRSPSDV

SEQ ID NO: 1822 - protein, 319 aa, unidentified
MPFPNCSAPSTVVATAVGVLLGLECGLGLLGNAVALWTFLFRVRVWKPYAVYLLNLALADLLLAACLPFLAAFYLSLQAWHLGRVGCWALHFLLDLSRSVGMAFLAAVALDRYLRVVHPRLKVNLLSPQAALGVSGLVWLLMVALTCPGLLISEAAQNSTRCHSFYSRADGSFSIIWQEALSCLQFVLPFGLIVFCNAGIIRALQKRLREPEKQPKLQRAQALVTLVVVLFALCFLPCFLARVLMHIFQNLGSCRALCAVAHTSDVTGSLTYLHSVLNPVVYCFSSPTFRSSYRRVFHTLRGKGQAAEPPDFNPRDSYS

SEQ ID NO: 1823 - protein, 356 aa, unidentified
MNGVSEGTRGCSDRQPGVLTRDRSCSRKMNSSGCLSEEVGSLRPLTVVILSASIVVGVLGNGLVLWMTVFRMARTVSTVCFFHLALADFMLSLSLPIAMYYIVSRQWLLGEWACKLYITFVFLSYFASNCLLVFISVDRCISVLYPVWALNHRTVQRASWLAFGVWLLAAALCSAHLKFRTTRKWNGCTHCYLAFNSDNETAQIWIEGVVEGHIIGTIGHFLLGFLGPLAIIGTCAHLIRAKLLREGWVHANRPKRLLLVLVSAFFIFWSPFNVVLLVHLWRRVMLKEIYHPRMLLILQASFALGCVNSSLNPFLYVFVGRDFQEKFFQSLTSALARAFGEEEFLSSCPRGNAPRE

SEQ ID NO: 1824 - protein, 381 aa, unidentified
MRSHTITMTTTSVSSWPYSSHRMRFITNHSDQPPQNFSATPNVTTCPMDEKLLSTVLTTSYSVIFIVGLVGNIIALYVFLGIHRKRNSIQIYLLNVAIADLLLIFCLPFRIMYHINQNKWTLGVILCKVVGTLFYMNMYISIILLGFISLDRYIKINRSIQQRKAITTKQSIYVCCIVWMLALGGFLTMIILTLKKGGHNSTMCFHYRDKHNAKGEAIFNFILVVMFWLIFLLIILSYIKIGKNLLRISKRRSKFPNSGKYATTARNSFIVLIIFTICFVPYHAFRFIYISSQLNVSSCYWKEIVHKTNEIMLVLSSFNSCLDPVMYFLMSSNIRKIMCQLLFRRFQGEPSRSESTSEFKPGYSLHDTSVAVKIQSSSKST

SEQ ID NO: 1825 - protein, 309 aa, unidentified
MNGTYNTCGSSDLTWPPAIKLGFYAYLGVLLVLGLLLNSLALWVFCCRMQQWTETRIYMTNLAVADLCLLCTLPFVLHSLRDTSDTPLCQLSQGIYLTNRYMSISLVTAIAVDRYVAVRHPLRARGLRSPRQAAAVCAVLWVLVIGSLVARWLLGIQEGGFCFRSTRHNFNSMAFPLLGFYLPLAVVVFCSLKVVTALAQRPPTDVGQAEATRKAARMVWANLLVFVVCFLPLHVGLTVRLAVGWNACALLETIRRALYITSKLSDANCCLDAICYYYMAKEFQEASALAVAPSAKAHKSQDSLCVTLA

SEQ ID NO: 1826 - protein, 613 aa, unidentified
MRAPGALLARMSRLLLLLLLKVSASSALGVAPASRNETCLGESCAPTVIQRRGRDAWGPGNSARDVLRARAPREEQGAAFLAGPSWDLPAAPGRDPAAGRGAEASAAGPPGPPTRPPGPWRWKGARGQEPSETLGRGNPTALQLFLQISEEEEKGPRGAGISGRSQEQSVKTVPGASDLFYWPRRAGKLQGSHHKPLSKTANGLAGHEGWTIALPGRALAQNGSLGEGIHEPGGPRRGNSTNRRVRLKNPFYPLTQESYGAYAVMCLSVVIFGTGIIGNLAVMCIVCHNYYMRSISNSLLANLAFWDFLIIFFCLPLVIFHELTKKWLLEDFSCKIVPYIEVASLGVTTFTLCALCIDRFRAATNVQMYYEMIENCSSTTAKLAVIWVGALLLALPEVVLRQLSKEDLGFSGRAPAERCIIKISPDLPDTIYVLALTYDSARLWWYFGCYFCLPTLFTITCSLVTARKIRKAEKACTRGNKRQIQLESQMNCTVVALTILYGFCIIPENICNIVTAYMATGVSQQTMDLLNIISQFLLFFKSCVTPVLLFCLCKPFSRAFMECCCCCCEECIQKSSTVTSDDNDNEYTTELELSPFSTIRREMSTFASVGTHC

SEQ ID NO: 1827 - protein, 481 aa, unidentified
MRWLWPLAVSLAVILAVGLSRVSGGAPLHLGRHRAETQEQQSRSKRGTEDEEAKGVQQYVPEEWAEYPRPIHPAGLQPTKPLVATSPNPGKDGGTPDSGQELRGNLTGAPGQRLQIQNPLYPVTESSYSAYAIMLLALVVFAVGIVGNLSVMCIVWHSYYLKSAWNSILASLALWDFLVLFFCLPIVIFNEITKQRLLGDVSCRAVPFMEVSSLGVTTFSLCALGIDRFHVATSTLPKVRPIERCQSILAKLAVIWVGSMTLAVPELLLWQLAQEPAPTMGTLDSCIMKPSASLPESLYSLVMTYQNARMWWYFGCYFCLPILFTVTCQLVTWRVRGPPGRKSECRASKHEQCESQLNSTVVGLTVVYAFCTLPENVCNIVVAYLSTELTRQTLDLLGLINQFSTFFKGAITPVLLLCICRPLGQAFLDCCCCCCCEECGGASEASAANGSDNKLKTEVSSSIYFHKPRESPPLLPLGTPC

SEQ ID NO: 1828 - protein, 453 aa, unidentified
MASPSLPGSDCSQIIDHSHVPEFEVATWIKITLILVYLIIFVMGLLGNSATIRVTQVLQKKGYLQKEVTDHMVSLACSDILVFLIGMPMEFYSIIWNPLTTSSYTLSCKLHTFLFEACSYATLLHVLTLSFERYIAICHPFRYKAVSGPCQVKLLIGFVWVTSALVALPLLFAMGTEYPLVNVPSHRGLTCNRSSTRHHEQPETSNMSICTNLSSRWTVFQSSIFGAFVVYLVVLLSVAFMCWNMMQVLMKSQKGSLAGGTRPPQLRKSESEESRTARRQTIIFLRLIVVTLAVCWMPNQIRRIMAAAKPKHDWTRSYFRAYMILLPFSETFFYLSSVINPLLYTVSSQQFRRVFVQVLCCRLSLQHANHEKRLRVHAHSTTDSARFVQRPLLFASRRQSSARRTEKIFLSTFQSEAEPQSKSQSLSLESLEPNSGAKPANSAAENGFQEHEV

SEQ ID NO: 1829 - protein, 362 aa, unidentified
MGNHTWEGCHVDSRVDHLFPPSLYIFVIGVGLPTNCLALWAAYRQVQQRNELGVYLMNLSIADLLYICTLPLWVDYFLHHDNWIHGPGSCKLFGFIFYTNIYISIAFLCCISVDRYLAVAHPLRFARLRRVKTAVAVSSVVWATELGANSAPLFHDELFRDRYNHTFCFEKFPMEGWVAWMNLYRVFVGFLFPWALMLLSYRGILRAVRGSVSTERQEKAKIKRLALSLIAIVLVCFAPYHVLLLSRSAIYLGRPWDCGFEERVFSAYHSSLAFTSLNCVADPILYCLVNEGARSDVAKALHNLLRFLASDKPQEMANASLTLETPLTSKRNSTAKAMTGSWAATPPSQGDQVQLKMLPPAQ

SEQ ID NO: 1830 - protein, 372 aa, unidentified
MACNSTSLEAYTYLLLNTSNASDSGSTQLPAPLRISLAIVMLLMTVVGFLGNTVVCIIVYQRPAMRSAINLLLATLAFSDIMLSLCCMPFTAVTLITVRWHFGDHFCRLSATLYWFFVLEGVAILLIISVDRFLIIVQRQDKLNPRRAKVIIAVSWVLSFCIAGPSLTGWTLVEVPARAPQCVLGYTELPADRAYVVTLVVAVFFAPFGVMLCAYMCILNTVRKNAVRVHNQSDSLDLRQLTRAGLRRLQRQQQVSVDLSFKTKAFTTILILFVGFSLCWLPHSVYSLLSVFSQRFYCGSSFYATSTCVLWLSYLKSVFNPIVYCWRIKKFREACIELLPQTFQILPKVPERIRRRIQPSTVYVCNENQSAV

SEQ ID NO: 1831 - protein, 617 aa, unidentified
MGPTLAVPTPYGCIGCKLPQPEYPPALIIFMFCAMVITIVVDLIGNSMVILAVTKNKKLRNSGNIFVVSLSVADMLVAIYPYPLMLHAMSIGGWDLSQLQCQMVGFITGLSVVGSIFNIVAIAINRYCYICHSLQYERIFSVRNTCIYLVITWIMTVLAVLPNMYIGTIEYDPRTYTCIFNYLNNPVFTVTIVCIHFVLPLLIVGFCYVRIWTKVLAARDPAGQNPDNQLAEVRNFLTMFVIFLLFAVCWCPINVLTVLVAVSPKEMAGKIPNWLYLAAYFIAYFNSCLNAVIYGLLNENFRREYWTIFHAMRHPIIFFSGLISDIREMQEARTLARARAHARDQAREQDRAHACPAVEETPMNVRNVPLPGDAAAGHPDRASGHPKPHSRSSSAYRKSASTHHKSVFSHSKAASGHLKPVSGHSKPASGHPKSATVYPKPASVHFKADSVHFKGDSVHFKPDSVHFKPASSNPKPITGHHVSAGSHSKSAFSAATSHPKPTTGHIKPATSHAEPTTADYPKPATTSHPKPTAADNPELSASHCPEIPAIAHPVSDDSDLPESASSPAAGPTKPAASQLESDTIADLPDPTVVTTSTNDYHDVVVIDVEDDPDEMAV

SEQ ID NO: 1832 - protein, 361 aa, unidentified
MNESRWTEWRILNMSSGIVNVSERHSCPLGFGHYSVVDVCIFETVVIVLLTFLIIAGNLTVIFVFHCAPLLHHYTTSYFIQTMAYADLFVGVSCLVPTLSLLHYSTGVHESLTCQVFGYIISVLKSVSMACLACISVDRYLAITKPLSYNQLVTPCRLRICIILIWIYSCLIFLPSFFGWGKPGYHGDIFEWCATSWLTSAYFTGFIVCLLYAPAAFVVCFTYFHIFKICRQHTKEINDRRARFPSHEVDSSRETGHSPDRRYAMVLFRITSVFYMLWLPYIIYFLLESSRVLDNPTLSFLTTWLAISNSFCNCVIYSLSNSVFRLGLRRLSETMCTSCMCVKDQEAQEPKPRKRANSCSI

SEQ ID NO: 1833 - protein, 319 aa, unidentified
MSQQNTSGDCLFDGVNELMKTLQFAVHIPTFVLGLLLNLLAIHGFSTFLKNRWPDYAATSIYMINLAVFDLLLVLSLPFKMVLSQVQSPFPSLCTLVECLYFVSMYGSVFTICFISMDRFLAIRYPLLVSHLRSPRKIFGICCTIWVLVWTGSIPIYSFHGKVEKYMCFHNMSDDTWSAKVFFPLEVFGFLLPMGIMGFCCSRSIHILLGRRDHTQDWVQQKACIYSIAASLAVFVVSFLPVHLGFFLQFLVRNSFIVECRAKQSISFFLQLSMCFSNVNCCLDVFCYYFVIKEFRMNIRAHRPSRVQLVLQDTTISRG

SEQ ID NO: 1834 - protein, 362 aa, unidentified
MNASAASLNDSQVVVVAAEGAAAAATAAGGPDTGEWGPPAAAALGAGGGANGSLELSSQLSAGPPGLLLPAVNPWDVLLCVSGTVIAGENALVVALIASTPALRTPMFVLVGSLATADLLAGCGLILHFVFQYLVPSETVSLLTVGFLVASFAASVSSLLAITVDRYLSLYNALTYYSRRTLLGVHLLLAATWTVSLGLGLLPVLGWNCLAERAACSVVRPLARSHVALLSAAFFMVFGIMLHLYVRICQVVWRHAHQIALQQHCLAPPHLAATRKGVGTLAVVLGTFGASWLPFAIYCVVGSHEDPAVYTYATLLPATYNSMINPIIYAFRNQEIQRALWLLLCGCFQSKVPFRSRSPSEV

SEQ ID NO: 1835 - protein, 451 aa, unidentified
MESSPIPQSSGNSSTLGRVPQTPGPSTASGVPEVGLRDVASESVALFFMLLLDLTAVAGNAAVMAVIAKTPALRKFVFVFHLCLVDLLAALTLMPLAMLSSSALFDHALFGEVACRLYLFLSVCFVSLAILSVSAINVERYYYVVHPMRYEVRMTLGLVASVLVGVWVKALAMASVPVLGRVSWEEGAPSVPPGCSLQWSHSAYCQLFVVVFAVLYFLLPLLLILVVYCSMFRVARVAAMQHGPLPTWMETPRQRSESLSSRSTMVTSSGAPQTTPHRTFGGGKAAVVLLAVGGQFLLCWLPYFSFHLYVALSAQPISTGQVESVVTWIGYFCFTSNPFFYGCLNRQIRGELSKQFVCFFKPAPEEELRLPSREGSIEENFLQFLQGTGCPSESWVSRPLPSPKQEPPAVDFRIPGQIAEETSEFLEQQLTSDIIMSDSYLRPAASPRLES

SEQ ID NO: 1836 - protein, 368 aa, unidentified
MANSTGLNASEVAGSLGLILAAVVEVGALLGNGALLVVVLRTPGLRDALYLAHLCVVDLLAAASIMPLGLLAAPPPGLGRVRLGPAPCRAARFLSAALLPACTLGVAALGLARYRLIVHPLRPGSRPPPVLVLTAVWAAAGLLGALSLLGTPPAPPPAPARCSVLAGGLGPFRPLWALLAFALPALLLLGAYGGIFVVARRAALRPPRPARGSRLHSDSLDSRLSILPPLRPRLPGGKAALAPALAVGQFAACWLPYGCACLAPAARAAEAEAAVTWVAYSAFAAHPFLYGLLQRPVRLALGRLSRRALPGPVRACTPQAWHPRALLQCLQRPPEGPAVGPSEAPEQTPELAGGRSPAYQGPPESSLS

SEQ ID NO: 1837 - protein, 419 aa, unidentified
MVFSAVLTAFHTGTSNTTFVVYENTYMNITLPPPFQHPDLSPLLRYSFETMAPTGLSSLTVNSTAVPTTPAAFKSLNLPLQITLSAIMIFILFVSFLGNLVVCLMVYQKAAMRSAINILLASLAFADMLLAVLNMPFALVTILTTRWIFGKFFCRVSAMFFWLFVIEGVAILLIISIDRFLIIVQRQDKLNPYRAKVLIAVSWATSFCVAFPLAVGNPDLQIPSRAPQCVFGYTTNPGYQAYVILISLISFFIPFLVILYSFMGILNTLRHNALRIHSYPEGICLSQASKLGLMSLQRPFQMSIDMGFKTRAFTTILILFAVFIVCWAPFTTYSLVATFSKHFYYQHNFFEISTWLLWLCYLKSALNPLIYYWRIKKFHDACLDMMPKSFKFLPQLPGHTKRRIRPSAVYVCGEHRTVV

SEQ ID NO: 1838 - protein, 337 aa, unidentified
MNSTCIEEQHDLDHYLFPIVYIFVIIVSIPANIGSLCVSFLQAKKESELGIYLFSLSLSDLLYALTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHAVNFEDHSNSGKRTYTMYRITVALTSLNCVADPILYCFVTETGRYDMWNILKFCTGRCNTSQRQRKRILSVSTKDTMELEVLE

SEQ ID NO: 1839 - protein, 365 aa, unidentified
MGNITADNSSMSCTIDHTIHQTLAPVVYVTVLVVGFPANCLSLYFGYLQIKARNELGVYLCNLTVADLFYICSLPFWLQYVLQHDNWSHGDLSCQVCGILLYENIYISVGFLCCISVDRYLAVAHPFRFHQFRTLKAAVGVSVVIWAKELLTSIYFLMHEEVIEDENQHRVCFEHYPIQAWQRAINYYRFLVGFLFPICLLLASYQGILRAVRRSHGTQKSRKDQIQRLVLSTVVIFLACFLPYHVLLLVRSVWEASCDFAKGVFNAYHFSLLLTSFNCVADPVLYCFVSETTHRDLARLRGACLAFLTCSRTGRAREAYPLGAPEASGKSGAQGEEPELLTKLHPAFQTPNSPGSGGFPTGRLA

SEQ ID NO: 1840 - protein, 540 aa, unidentified
MNSTGHLQDAPNATSLHVPHSQEGNSTSLQEGLQDLIHTATLVTCTFLLAVIFCLGSYGNFIVFLSFFDPAFRKFRTNFDFMILNLSFCDLFICGVTAPMFTFVLFFSSASSIPDAFCFTFHLTSSGFIIMSLKTVAVIALHRLRMVLGKQPNRTASFPCTVLLTLLLWATSFTLATLATLKTSKSHLCLPMSSLIAGKGKAILSLYVVDFTFCVAVVSVSYIMIAQTLRKNAQVRKCPPVITVDASRPQPFMGVPVQGGGDPIQCAMPALYRNQNYNKLQHVQTRGYTKSPNQLVTPAASRLQLVSAINLSTAKDSKAVVTCVIIVLSVLVCCLPLGISLVQVVLSSNGSFILYQFELFGFTLIFFKSGLNPFIYSRNSAGLRRKVLWCLQYIGLGFFCCKQKTRLRAMGKGNLEVNRNKSSHHETNSAYMLSPKPQKKFVDQACGPSHSKESMVSPKISAGHQHCGQSSSTPINTRIEPYYSIYNSSPSQEESSPCNLQPVNSFGFANSYIAMHYHTTNDLVQEYDSTSAKQIPVPSV

SEQ ID NO: 1841 - protein, 363 aa, unidentified
MGPGEALLAGLLVMVLAVALLSNALVLLCCAYSAELRTRASGVLLVNLSLGHLLLAALDMPFTLLGVMRGRTPSAPGACQVIGFLDTFLASNAALSVAALSADQWLAVGFPLRYAGRLRPRYAGLLLGCAWGQSLAFSGAALGCSWLGYSSAFASCSLRLPPEPERPRFAAFTATLHAVGFVLPLAVLCLTSLQVHRVARRHCQRMDTVTMKALALLADLHPSVRQRCLIQQKRRRHRATRKIGIAIATFLICFAPYVMTRLAELVPFVTVNAQWGILSKCLTYSKAVADPFTYSLLRRPFRQVLAGMVHRLLKRTPRPASTHDSSLDVAGMVHQLLKRTPRPASTHNGSVDTENDSCLQQTH

SEQ ID NO: 1842 - protein, 336 aa, unidentified
MNNNTTCIQPSMISSMALPIIYILLCIVGVFGNTLSQWIFLTKIGKKTSTHIYLSHLVTANLLVCSAMPFMSIYFLKGFQWEYQSAQCRVVNFLGTLSMHASMFVSLLILSWIAISRYATLMQKDSSQETTSCYEKIFYGHLLKKFRQPNFARKLCIYIWGVVLGIIIPVTVYYSVIEATEGEESLCYNRQMELGAMISQIAGLIGTTFIGFSFLVVLTSYYSFVSHLRKIRTCTSIMEKDLTYSSVKRHLLVIQILLIVCFLPYSIFKPIFYVLHQRDNCQQLNYLIETKNILTCLASARSSTDPIIFLLLDKTFKKTLYNLFTKSNSAHMQSYG

SEQ ID NO: 1843 - protein, 423 aa, unidentified
MVPHLLLLCLLPLVRATEPHEGRADEQSAEAALAVPNASHFFSWNNYTFSDWQNFVGRRRYGAESQNPTVKALLIVAYSFIIVFSLFGNVLVCHVIFKNQRMHSATSLFIVNLAVADIMITLLNTPFTLVRFVNSTWIFGKGMCHVSRFAQYCSLHVSALTLTAIAVDRHQVIMHPLKPRISITKGVIYIAVIWTMATFFSLPHAICQKLFTFKYSEDIVRSLCLPDFPEPADLFWKYLDLATFILLYILPLLIISVAYARVAKKLWLCNMIGDVTTEQYFALRRKKKKTIKMLMLVVVLFALCWFPLNCYVLLLSSKVIRTNNALYFAFHWFAMSSTCYNPFIYCWLNENFRIELKALLSMCQRPPKPQEDRPPSPVPSFRVAWTEKNDGQRAPLANNLLPTSQLQSGKTDLSSVEPIVTMS

SEQ ID NO: 1844 - protein, 396 aa, unidentified
MWNSSDANFSCYHESVLGYRYVAVSWGVVVAVTGTVGNVLTLLALAIQPKLRTRFNLLIANLTLADLLYCTLLQPFSVDTYLHLHWRTGATFCRVFGLLLFASNSVSILTLCLIALGRYLLIAHPKLFPQVFSAKGIVLALVSTWVVGVASFAPLWPIYILVPVVCTCSFDRIRGRPYTTILMGIYFVLGLSSVGIFYCLIHRQVKRAAQALDQYKLRQASIHSNHVARTDEAMPGRFQELDSRLASGGPSEGISSEPVSAATTQTLEGDSSEVGDQINSKRAKQMAEKSPPEASAKAQPIKGARRAPDSSSEFGKVTRMCFAVFLCFALSYIPFLLLNILDARVQAPRVVHMLAANLTWLNGCINPVLYAAMNRQFRQAYGSILKRGPRSFHRLH

SEQ ID NO: 1845 - protein, 370 aa, unidentified
MANYSHAADNILQNLSPLTAFLKLTSLGFIIGVSVVGNLLISILLVKDKTLHRAPYYFLLDLCCSDILRSAICFPFVFNSVKNGSTWTYGTLTCKVIAFLGVLSCFHTAFMLFCISVTRYLAIAHHRFYTKRLTFWTCLAVICMVWTLSVAMAFPPVLDVGTYSFIREEDQCTFQHRSFRANDSLGFMLLLALILLATQLVYLKLIFFVHDRRKMKPVQFVAAVSQNWTFHGPGASGQAAANWLAGFGRGPTPPTLLGIRQNANTTGRRRLLVLDEFKMEKRISRMFYIMTFLFLTLWGPYLVACYWRVFARGPVVPGGFLTAAVWMSFAQAGINPFVCIFSNRELRRCFSTTLLYCRKSRLPREPYCVI

SEQ ID NO: 1846 - protein, 358 aa, unidentified
MGFNLTLAKLPNNELHGQESHNSGNRSDGPGKNTTLHNEFDTIVLPVLYLIIFVASILLNGLAVWIFFHIRNKTSFIFYLKNIVVADLIMTLTFPFRIVHDAGFGPWYFKFILCRYTSVLFYANMYTSIVFLGLISIDRYLKVVKPFGDSRMYSITFTKVLSVCVWVIMAVLSLPNIILTNGQPTEDNIHDCSKLKSPLGVKWHTAVTYVNSCLFVAVLVILIGCYIAISRYIHKSSRQFISQSSRKRKHNQSIRVVVAVFFTCFLPYHLCRIPFTFSHLDRLLDESAQKILYYCKEITLFLSACNVCLDPIIYFFMCRSFSRRLFKKSNIRTRSESIRSLQSVRRSEVRIYYDYTDV

SEQ ID NO: 1847 - protein, 384 aa, unidentified
MTNSSSTSTSSTTGGSLLLLCEEEESWAGRRIPVSLLYSGLAIGGTLANGMVIYLVSSFRKLQTTSNAFIVNGCAADLSVCALWMPQEAVLGLLPTGSAEPPADWDGAGGSYRLLRGGLLGLGLTVSLLSHCLVALNRYLLITRAPATYQALYQRRHTAGMLALSWALALGLVLLLPPWAPRPGAAPPRVHYPALLAAAALLAQTALLLHCYLGIVRRVRVSVKRVSVLNFHLLHQLPGCAAAAAAFPGAQHAPGPGGAAHPAQAQPLPPALHPRRAQRRLSGLSVLLLCCVFLLATQPLVWVSLASGFSLPVPWGVQAASWLLCCALSALNPLLYTWRNEEFRRSVRSVLPGVGDAAAAAVAATAVPAVSQAQLGTRAAGQHW

SEQ ID NO: 1848 - protein, 455 aa, unidentified
MSFLIDSSIMITSQILFFGFGWLFFMRQLFKDYEIRQYVVQVIFSVTFAFSCTMFELIIFEILGVLNSSSRYFHWKMNLCVILLILVFMVPFYIGYFIVSNIRLLHKQRLLFSCLLWLTFMYFFWKLGDPFPILSPKHGILSIEQLISRVGVIGVTLMALLSGFGAVNCPYTYMSYFLRNVTDTDILALERRLLQTMDMIISKKKRMAMARRTMFQKGEVHNKPSGFWGMIKSVTTSASGSENLTLIQQEVDALEELSRQLFLETADLYATKERIEYSKTFKGKYFNFLGYFFSIYCVWKIFMATINIVFDRVGKTDPVTRGIEITVNYLGIQFDVKFWSQHISFILVGIIIVTSIRGLLITLTKFFYAISSSKSSNVIVLLLAQIMGMYFVSSVLLIRMSMPLEYRTIITEVLGELQFNFYHRWFDVIFLVSALSSILFLYLAHKQAPEKQMAP

SEQ ID NO: 1849 - protein, 455 aa, unidentified; identical to SEQ ID NO: 1848

SEQ ID NO: 1850 - protein, 357 aa, unidentified
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 1851 - protein, 403 aa, unidentified
MFVASERKMRAHQVLTFLLLFVITSVASENASTSRGCGLDLLPQYVSLCDLDAIWGIVVEAVAGAGALITLLLMLILLVRLPFIKEKEKKSPVGLHFLFLLGTLGLFGLTFAFIIQEDETICSVRRFLWGVLFALCFSCLLSQAWRVRRLVRHGTGPAGWQLVGLALCLMLVQVIIAVEWLVLTVLRDTRPACAYEPMDFVMALIYDMVLLVVTLGLALFTLCGKFKRWKLNGAFLLITAFLSVLIWVAWMTMYLFGNVKLQQGDAWNDPTLAITLAASGWVFVIFHAIPEIHCTLLPALQENTPNYFDTSQPRMRETAFEEDVQLPRAYMENKAFSMDEHNAALRTAGFPNGSLGKRPSGSLGKRPSAPFRSNVYQPTEMAVVLNGGTIPTAPPSHTGRHLW

SEQ ID NO: 1852 - protein, 441 aa, unidentified
MAIHKALVMCLGLPLFLFPGAWAQGHVPPGCSQGLNPLYYNLCDRSGAWGIVLEAVAGAGIVTTFVLTIILVASLPFVQDTKKRSLLGTQVFFLLGTLGLFCLVFACVVKPDFSTCASRRFLFGVLFAICFSCLAAHVFALNFLARKNHGPRGWVIFTVALLLTLVEVIINTEWLIITLVRGSGEGGPQGNSSAGWAVASPCAIANMDFVMALIYVMLLLLGAFLGAWPALCGRYKRWRKHGVFVLLTTATSVAIWVVWIVMYTYGNKQHNSPTWDDPTLAIALAANAWAFVLFYVIPEVSQVTKSSPEQSYQGDMYPTRGVGYETILKEQKGQSMFVENKAFSMDEPVAAKRPVSPYSGYNGQLLTSVYQPTEMALMHKVPSEGAYDIILPRATANSQVMGSANSTLRAEDMYSAQSHQAATPPKDGKNSQVFRNPYVWD

SEQ ID NO: 1853 - protein, 345 aa, unidentified
MYKDCIESTGDYFLLCDAEGPWGIILESLAILGIVVTILLLLAFLFLMRKIQDCSQWNVLPTQLLFLLSVLGLFGLAFAFIIELNQQTAPVRYFLFGVLFALCFSCLLAHASNLVKLVRGCVSFSWTTILCIAIGCSLLQIIIATEYVTLIMTRGMMFVNMTPCQLNVDFVVLLVYVLFLMALTFFVSKATFCGPCENWKQHGRLIFITVLFSIIIWVVWISMLLRGNPQFQRQPQWDDPVVCIALVTNAWVFLLLYIVPELCILYRSCRQECPLQGNACPVTAYQHSFQVENQELSRARDSDGAEEDVALTSYGTPIQPQTVDPTQECFIPQAKLSPQQDAGGV

SEQ ID NO: 1854 - protein, 926 aa, unidentified
MAFLIILITCFVIILATSQPCQTPDDFVAATSPGHIIIGGLFAIHEKMLSSEDSPRRPQIQECVGFEISVFLQTLAMIHSIEMINNSTLLPGVKLGYEIYDTCTEVTVAMAATLRFLSKFNCSRETVEFKCDYSSYMPRVKAVIGSGYSEITMAVSRMLNLQLMPQVGYESTAEILSDKIRFPSFLRTVPSDFHQIKAMAHLIQKSGWNWIGIITTDDDYGRLALNTFIIQAEANNVCIAFKEVLPAFLSDNTIEVRINRTLKKIILEAQVNVIVVFLRQFHVFDLFNKAIEMNINKMWIASDNWSTATKITTIPNVKKIGKVVGFAFRRGNISSFHSFLQNLHLLPSDSHKLLHEYAMHLSACAYVKDTDLSQCIFNHSQRTLAYKANKAIERNFVMRNDFLWDYAEPGLIHSIQLAVFALGYAIRDLCQARDCQNPNAFQPWELLGVLKNVTFTDGWNSFHFDAHGDLNTGYDVVLWKEINGHMTVTKMAEYDLQNDVFIIPDQETKNEFRNLKQIQSKCSKECSPGQMKKTTRSQHICCYECQNCPENHYTNQTDMPHCLLCNNKTHWAPVRSTMCFEKEVEYLNWNDSLAILLLILSLLGIIFVLVVGIIFTRNLNTPVVKSSGGLRVCYVILLCHFLNFASTSFFIGEPQDFTCKTRQTMFGVSFTLCISCILTKSLKILLAFSFDPKLQKFLKCLYRPILIIFTCTGIQVVICTLWLIFAAPTVEVNVSLPRVIILECEEGSILAFGTMLGYIAILAFICFIFAFKGKYENYNEAKFITFGMLIYFIAWITFIPIYATTFGKYVPAVEIIVILISNYGILYCTFIPKCYVIICKQEINTKSAFLKMIYSYSSHSVSSIALSPASLDSMSGNVTMTNPSSSGKSATWQKSKDLQAQAFAHICRENATSVSKTLPRKRMSSI

SEQ ID NO: 1855 - protein, 684 aa, unidentified
MEENLISMREDHSFHVRYRMEASCLELALEGERLCKSGDCRAGVSFFEAAVQVGTEDLKTLSAIYSQLGNAYFYLHDYAKALEYHHHDLTLARTIGDQLGEAKASGNLGNTLKVLGNFDEAIVCCQRHLDISRELNDKVGEARALYNLGNVYHAKGKSFGCPGPQDVGEFPEEVRDALQAAVDFYEENLSLVTALGDRAAQGRAFGNLGNTHYLLGNFRDAVIAHEQRLLIAKEFGDKAAERRAYSNLGNAYIFLGEFETASEYYKKTLLLARQLKDRAVEAQSCYSLGNTYTLLQDYEKAIDYHLKHLAIAQELNDRIGEGRACWSLGNAYTALGNHDQAMHFAEKHLEISREVGDKSGELTARLNLSDLQMVLGLSYSTNNSIMSENTEIDSSLNGVRPKLGRRHSMENMELMKLTPEKVQNWNSEILAKQKPLIAKPSAKLLFVNRLKGKKYKTNSSTKVLQDASNSIDHRIPNSQRKISADTIGDEGFFDLLSRFQSNRMDDQRCCLQEKNCHTASTTTSSTPPKMMLKTSSVPVVSPNTDEFLDLLASSQSRRLDDQRASFSNLPGLRLTQNSQSVLSHLMTNDNKEADEDFFDILVKCQGSRLDDQRCAPPPATTKGPTVPDEDFFSLILRSQGKRMDEQRVLLQRDQNRDTDFGLKDFLQNNALLEFKNSGKKSADH

SEQ ID NO: 1856 - protein, 724 aa, unidentified
MFDTTPHSGRSTPSSSPSLRKRLQLLPPSRPPPEPEPGTMVEKGSDSSSEKGGVPGTPSTQSLGSRNFIRNSKKMQSWYSMLSPTYKQRNEDFRKLFSKLPEAERLIVDYSCALQREILLQGRLYLSENWICFYSNIFRWETTISIQLKEVTCLKKEKTAKLIPNAIQICTESEKHFFTSFGARDRCFLLIFRLWQNALLEKTLSPRELWHLVHQCYGSELGLTSEDEDYVSPLQLNGLGTPKEVGDVIALSDITSSGAADRSQEPSPVGSRRGHVTPNLSRASSDADHGAEEDKEEQVDSQPDASSSQTVTPVAEPPSTEPTQPDGPTTLGPLDLLPSEELLTDTSNSSSSTGEEADLAALLPDLSGRLLINSVFHVGAERLQQMLFSDSPFLQGFLQQCKFTDVTLSPWSGDSKCHQRRVLTYTIPISNPLGPKSASVVETQTLFRRGPQAGGCVVDSEVLTQGIPYQDYFYTAHRYCILGLARNKARLRVSSEIRYRKQPWSLVKSLIEKNSWSGIEDYFHHLERELAKAEKLSLEEGGKDARGLLSGLRRRKRPLSWRAHGDGPQHPDPDPCARAGIHTSGSLSSRFSEPSVDQGPGAGIPSALVLISIVICVSLIILIALNVLLFYRLWSLERTAHTFESWHSLALAKGKFPQTATEWAEILALQKQFHSVEVHKWRQILRASVELLDEMKFSLEKLHQGITVSDPPFDTQPRPDDSFS

SEQ ID NO: 1857 - protein, 738 aa, unidentified
MKGFKLSCTASNSNRSTPACSPILRKRSRSPTPQNQDGDTMVEKGSDHSSDKSPSTPEQGVQRSCSSQSGRSGGKNSKKSQSWYNVLSPTYKQRNEDFRKLFKQLPDTERLIVDYSCALQRDILLQGRLYLSENWICFYSNIFRWETLLTVRLKDICSMTKEKTARLIPNAIQVCTDSEKHFFTSFGARDRTYMMMFRLWQNALLEKPLCPKELWHFVHQCYGNELGLTSDDEDYVPPDDDFNTMGYCEEIPVEENEVNDSSSKSSIETKPDASPQLPKKSITNSTLTSTGSSEAPVSFDGLPLEEEALEGDGSLEKELAIDNIMGEKIEMIAPVNSPSLDFNDNEDIPTELSDSSDTHDEGEVQAFYEDLSGRQYVNEVFNFSVDKLYDLLFTNSPFQRDFMEQRRFSDIIFHPWKKEENGNQSRVILYTITLTNPLAPKTATVRETQTMYKASQESECYVIDAEVLTHDVPYHDYFYTINRYTLTRVARNKSRLRVSTELRYRKQPWGLVKTFIEKNFWSGLEDYFRHLESELAKTESTYLAEMHRQSPKEKASKTTTVRRRKRPHAHLRVPHLEEVMSPVTTPTDEDVGHRIKHVAGSTQTRHIPEDTPNGFHLQSVSKLLLVISCVICFSLVLLVILNMMLFYKLWMLEYTTQTLTAWQGLRLQERLPQSQTEWAQLLESQQKYHDTELQKWREIIKSSVMLLDQMKDSLINLQNGIRSRDYTSESEEKRNRYH

SEQ ID NO: 1858 - protein, 662 aa, unidentified
MEGAPTVRQVMNEGDSSLATDLQEDVEENPSPTVEENNVVVKKQGPNLHNWSGDWSFWISSSTYKDRNEEYRRQFTHLPDTERLIADYACALQRDILLQGRLYLSENWLCFYSNIFRWETTISIALKNITFMTKEKTARLIPNAIQIVTESEKFFFTSFGARDRSYLSIFRLWQNVLLDKSLTRQEFWQLLQQNYGTELGLNAEEMENLSLSIEDVQPRSPGRSSLDDSGERDEKLSKSISFTSESISRVSETESFDGNSSKGGLGKEESQNEKQTKKSLLPTLEKKLTRVPSKSLDLNKNEYLSLDKSSTSDSVDEENVPEKDLHGRLFINRIFHISADRMFELLFTSSRFMQKFASSRNIIDVVSTPWTAELGGDQLRTMTYTIVLNSPLTGKCTAATEKQTLYKESREARFYLVDSEVLTHDVPYHDYFYTVNRYCIIRSSKQKCRLRVSTDLKYRKQPWGLVKSLIEKNSWSSLEDYFKQLESDLLIEESVLNQAIEDPGKLTGLRRRRRTFNRTAETVPKLSSQHSSGDVGLGAKGDITGKKKEMENYNVTLIVVMSIFVLLLVLLNVTLFLKLSKIEHAAQSFYRLRLQEEKSLNLASDMVSRAETIQKNKDQAHRLKGVLRDSIVMLEQLKSSLIMLQKTFDLLNKNKTGMAVES

SEQ ID NO: 1859 - protein, 354 aa, unidentified
MTALSRSEATEEGGNQQMHRKTASLNSPVSCKEKPDRVEEPPDYSLHWPEGLKGEEIKKCGREGITLNKYNQQYHKLFKDVPLEEVVLKVCSCALQRDFLLQGRLYISPNWLCFHASLFGKDIKVVIPVVSVQMIKKHKMARLLPNGLAITTNTSQKYIFVSLLSRDSVYDLLRRVCTHLQPSSKKSLSVREFSGEPESLEVLIPEMKWRKVCPSSRSLSLPDNIPCIPPSSVDSTDSFFPSRKPPMSEKSRAQVASENGGRWAWPMPGWGPACPKKMPNCSPTAKNAVYEEDELEEEPRSTGELRLWDYRLLKVFFVLICFLVMSSSYLAFRISRLEQQLCSLSWDDPVPGHR

SEQ ID NO: 1860 - protein, 432 aa, unidentified
MTELQQDVEDTKPAKVLGKRESKLGSAHSEAENGVEEKKKACRSPTAQSPTPSVEADSPDQKKIISLWSKSSFDGASLASDKNDCKTESKNDPKTERKKSSSSSQYKANMHFHKLFLSVPTEEPLKQSFTCALQKEILYQGKLFVSENWICFHSKVFGKDTKISIPAFSVTLIKKTKTALLVPNALIIATVTDRYIFVSLLSRDSTYKLLKSVCGHLENTSVGNSPNPSSAENSFRADRPSSLPLDFNDEFSDLDGVVQQRRQDMEGYSSSGSQTPESENSRDFHATESQTVLNVSKGEAKPTRADAHVNRVPEGKAKSLPVQGLSETVGILHKVKSQKCPMLHHILIFYAIVVCALIISTFYMRYRINTLEEQLGLLTSIVDTHNTEQAAPSGLRSQVQFNVEVLCQELTANIVKLEKIQNNLQKLLENGD

SEQ ID NO: 1861 - protein, 578 aa, unidentified
MLRRLDKIRFRGHKRDDFLDLAESPNASDTECSDEIPLKVPRTSPRDSEELRDPAGPGTLIMATGVQDFNRTEFDRLNEIKGHLEIALLEKHFLQEELRKLREETNAEMLRQELDRERQRRMELEQKVQEVLKARTEEQMAQQPPKGQAQASNGAERRSQGLSSRLQKWFYERFGEYVEDFRFQPEENTVETEEPLSARRLTENMRRLKRGAKPVTNFVKNLSALSDWYSVYTSAIAFTVYMNAVWHGWAIPLFLFLAILRLSLNYLIARGWRIQWSIVPEVSEPVEPPKEDLTVSEKFQLVLDVAQKAQNLFGKMADILEKIKNLFMWVQPEITQKLYVALWAAFLASCFFPYRLVGLAVGLYAGIKFFLIDFIFKRCPRLRAKYDTPYIIWRSLPTDPQLKERSSAAVSRRLQTTSSRSYVPSAPAGLGKEEDAGRFHSTKKGNFHEIFNLTENERPLAVCENGWRCCLINRDRKMPTDYIRNGVLYVTENYLCFESSKSGSSKRNKVIKLVDITDIQKYKVLSVLPGSGMGIAVSTPSTQKPLVFGAMVHRDEAFETILSQYIKITSAAASGGDS

SEQ ID NO: 1862 - protein, 1949 aa, unidentified
MGNSYAGQLKTTRFEEVLHNSIEASLRSNNLVPRPIFSQLYLEAEQQLAALEGGSRVDNEEEEEEGEGGLETNGPPNPFQLHPLPEGCCTTDGFCQAGKDLRLVSISNEPMDVPAGFLLVGVKSPSLPDHLLVCAVDKRFLPDDNGHNALLGFSGNCVGCGKKGFCYFTEFSNHINLKLTTQPKKQKHLKYYLVRNAQGTLTKGPLICWKGSEFRSRQIPASTCSSSLFPALESTAAFPSEPVPGTNPSILMGAQQAGPASDHPSLNAAMGPAVFNGKDSPKCQQLAKNNLLALPRPSALGILSNSGPPKKRHKGWSPESPSAPDGGCPQGGGNRAKYESAGMSCVPQVGLVGPASVTFPVVASGEPVSVPDNLLKICKAKPVIFKGHGNFPYLCGNLNDVVVSPLLYTCYQNSQSVSRAYEQYGASAIQPISEEMQLLLTVYYLVQLAADQVPLMEDLEQIFLRSWRESHLTEIRQYQQAPPQPFPPAPSAAAPVTSAQLPWLASLAASSCNDSVHVIECAYSLAEGLSEMFRLLVEGKLAKTNYVVIICACRSAAIDSCIAVTGKYQARILSESLLTPAEYQKEVNYELVTGKVDSLGAFFSTLCPEGDIDILLDKFHQENQGHISSSLAASSVTKAASLDVSGTPVCTSYNLEPHSIRPFQLAVAQKLLSHVCSIADSSTQNLDLGSFEKVDFLICIPPSEVTYQQTLLHVWHSGVLLELGLKKEHMTKQRVEQYVLKLDTEAQTKFKAFLQNSFQNPHTLFVLIHDHAHWDLVSSTVHNLYSQSDPSVGLVDRLLNCREVKEAPNIVTLHVTSFPYALQTQHTLISPYNEIHWPASCSNGVDLYHENKKYFGLSEFIESTLSGHSLPLLRYDSSFEAMVTALGKRFPRLHSAVIRTFVLVQHYAAALMAVSGLPQMKNYTSVETLEITQNLLNSPKQCPCGHGLMVLLRVPCSPLAVVAYERLAHVRARLALEEHFEIILGSPSSGVTVGKHFVKQLRMWQKIEDVEWRPQTYLELEGLPCILIFSGMDPHGESLPRSLRYCDLRLINSSCLVRTALEQELGLAAYFVSNEVPLEKGARNEALESDAEKLSSTDNEDEELGTEGSTSEKRSPMKRERSRSHDSASSSLSSKASGSALGGESSAQPTALPQGEHARSPQPRGPAEEGRAPGEKQRPRASQGPPSAISRHSPGPTPQPDCSLRTGQRSVQVSVTSSCSQLSSSSGSSSSSVAPAAGTWVLQASQCSLTKACRQPPIVFLPKLVYDMVVSTDSSGLPKAASLLPSPSVMWASSFRPLLSKTMTSTEQSLYYRQWTVPRPSHMDYGNRAEGRVDGFHPRRLLLSGPPQIGKTGAYLQFLSVLSRMLVRLTEVDVYDEEEININLREESDWHYLQLSDPWPDLELFKKLPFDYIIHDPKYEDASLICSHYQGIKSEDRGMSRKPEDLYVRRQTARMRLSKYAAYNTYHHCEQCHQYMGFHPRYQLYESTLHAFAFSYSMLGEEIQLHFIIPKSKEHHFVFSQPGGQLESMRLPLVTDKSHEYIKSPTFTPTTGRHEHGLFNLYHAMDGASHLHVLVVKEYEMAIYKKYWPNHIMLVLPSIFNSAGVGAAHFLIKELSYHNLELERNRQEELGIKPQDIWPFIVISDDSCVMWNVVDVNSAGERSREFSWSERNVSLKHIMQHIEAAPDIMHYALLGLRKWSSKTRASEVQEPFSRCHVHNFIILNVDLTQNVQYNQNRFLCDDVDFNLRVHSAGLLLCRFNRFSVMKKQIVVGGHRSFHITSKVSDNSAAVVPAQYICAPDSKHTFLAAPAQLLLEKFLQHHSHLFFPLSLKNHDHPVLSVDCYLNLGSQISVCYVSSRPHSLNISCSDLLFSGLLLYLCDSFVGASFLKKFHFLKGATLCVICQDRSSLRQTVVRLELEDEWQFRLRDEFQTANAREDRPLFFLTGRHI

SEQ ID NO: 1863 - protein, 906 aa, unidentified
MQHIFAFFCTGFLGAVVGANFPNNIQIGGLFPNQQSQEHAAFRFALSQLTEPPKLLPQIDIVNISDSFEMTYRFCSQFSKGVYAIFGFYERRTVNMLTSFCGALHVCFITPSFPVDTSNQFVLQLRPELQDALISIIDHYKWQKFVYIYDADRGLSVLQKVLDTAAEKNWQVTAVNILTTTEEGYRMLFQDLEKKKERLVVVDCESERLNAILGQIIKLEKNGIGYHYILANLGFMDIDLNKFKESGANVTGFQLVNYTDTIPAKIMQQWKNSDARDHTRVDWKRPKYTSALTYDGVKVMAEAFQSLRRQRIDISRRGNAGDCLANPAVPWGQGIDIQRALQQVRFEGLTGNVQFNEKGRRTNYTLHVIEMKHDGIRKIGYWNEDDKFVPAATDAQAGGDNSSVQNRTYIVTTILEDPYVMLKKNANQFEGNDRYEGYCVELAAEIAKHVGYSYRLEIVSDGKYGARDPDTKAWNGMVGELVYGRADVAVAPLTITLVREEVIDFSKPFMSLGISIMIKKPQKSKPGVFSFLDPLAYEIWMCIVFAYIGVSVVLFLVSRFSPYEWHSEEFEEGRDQTTSDQSNEFGIFNSLWFSLGAFMQQGCDISPRSLSGRIVGGVWWFFTLIIISSYTANLAAFLTVERMVSPIESAEDLAKQTEIAYGTLEAGSTKEFFRRSKIAVFEKMWTYMKSAEPSVFVRTTEEGMIRVRKSKGKYAYLLESTMNEYIEQRKPCDTMKVGGNLDSKGYGIATPKGSALRNPVNLAVLKLNEQGLLDKLKNKWWYDKGECGSGGGDSKDKTSALSLSNVAGVFYILIGGLGLAMLVALIEFCYKSRSESKRMKGFCLIPQQSINEAIRTSTLPRNSGAGASSGGSGENGRVVSHDFPKSMQSIPCMSHSSGMPLGATGL

SEQ ID NO: 1864 - protein, 883 aa, unidentified
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGANVSGFQIVDYDDSLVSKFIERWSTLEEKEYPGAHTTTIKYTSALTYDAVQVMTEAFRNLRKQRIEISRRGNAGDCLANPAVPWGQGVEIERALKQVQVEGLSGNIKFDQNGKRINYTINIMELKTNGPRKIGYWSEVDKMVVTLTELPSGNDTSGLENKTVVVTTILESPYVMMKKNHEMLEGNERYEGYCVDLAAEIAKHCGFKYKLTIVGDGKYGARDADTKIWNGMVGELVYGKADIAIAPLTITLVREEVIDFSKPFMSLGISIMIKKPQKSKPGVFSFLDPLAYEIWMCIVFAYIGVSVVLFLVSRFSPYEWHTEEFEDGRETQSSESTNEFGIFNSLWFSLGAFMQQGCDISPRSLSGRIVGGVWWFFTLIIISSYTANLAAFLTVERMVSPIESAEDLSKQTEIAYGTLDSGSTKEFFRRSKIAVFDKMWTYMRSAEPSVFVRTTAEGVARVRKSKGKYAYLLESTMNEYIEQRKPCDTMKVGGNLDSKGYGIATPKGSSLRNAVNLAVLKLNEQGLLDKLKNKWWYDKGECGSGGGDSKEKTSALSLSNVAGVFYILVGGLGLAMLVALIEFCYKSRAEAKRMKVAKNAQNINPSSSQNSQNFATYKEGYNVYGIESVKI

SEQ ID NO: 1865 - protein, 894 aa, unidentified
MARQKKMGQSVLRAVFFLVLGLLGHSHGGFPNTISIGGLFMRNTVQEHSAFRFAVQLYNTNQNTTEKPFHLNYHVDHLDSSNSFSVTNAFCSQFSRGVYAIFGFYDQMSMNTLTSFCGALHTSFVTPSFPTDADVQFVIQMRPALKGAILSLLGHYKWEKFVYLYDTERGFSILQAIMEAAVQNNWQVTARSVGNIKDVQEFRRIIEEMDRRQEKRYLIDCEVERINTILEQVVILGKHSRGYHYMLANLGFTDILLERVMHGGANITGFQIVNNENPMVQQFIQRWVRLDEREFPEAKNAPLKYTSALTHDAILVIAEAFRYLRRQRVDVSRRGSAGDCLANPAVPWSQGIDIERALKMVQVQGMTGNIQFDTYGRRTNYTIDVYEMKVSGSRKAGYWNEYERFVPFSDQQISNDSASSENRTIVVTTILESPYVMYKKNHEQLEGNERYEGYCVDLAYEIAKHVRIKYKLSIVGDGKYGARDPETKIWNGMVGELVYGRADIAVAPLTITLVREEVIDFSKPFMSLGISIMIKKPQKSKPGVFSFLDPLAYEIWMCIVFAYIGVSVVLFLVSRFSPYEWHLEDNNEEPRDPQSPPDPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWSYMKSAEPSVFTKTTADGVARVRKSKGKFAFLLESTMNEYIEQRKPCDTMKVGGNLDSKGYGVATPKGSALRNAVNLAVLKLNEQGLLDKLKNKWWYDKGECGSGGGDSKDKTSALSLSNVAGVFYILVGGLGLAMMVALIEFCYKSRAESKRMKLTKNTQNFKPAPATNTQNYATYREGYNVYGTESVKI

SEQ ID NO: 1866 - protein, 902 aa, unidentified
MRIISRQIVLLFSGFWGLAMGAFPSSVQIGGLFIRNTDQEYTAFRLAIFLHNTSPNASEAPFNLVPHVDNIETANSFAVTNAFCSQYSRGVFAIFGLYDKRSVHTLTSFCSALHISLITPSFPTEGESQFVLQLRPSLRGALLSLLDHYEWNCFVFLYDTDRGYSILQAIMEKAGQNGWHVSAICVENFNDVSYRQLLEELDRRQEKKFVIDCEIERLQNILEQIVSVGKHVKGYHYIIANLGFKDISLERFIHGGANVTGFQLVDFNTPMVIKLMDRWKKLDQREYPGSETPPKYTSALTYDGVLVMAETFRSLRRQKIDISRRGNAGDCLANPAAPWGQGIDMERTLKQVRIQGLTGNVQFDHYGRRVNYTMDVFELKSTGPRKVGYWNDMDKLVLIQDVPTLGNDTAAIENRTVVVTTIMESPYVMYKKNHEMFEGNDKYEGYCVDLASEIAKHIGIKYKIAIVPDGKYGARDADTKIWNGMVGELVYGKAEIAIAPLTITLVREEVIDFSKPFMSLGISIMIKKPQKSKPGVFSFLDPLAYEIWMCIVFAYIGVSVVLFLVSRFSPYEWHTEEPEDGKEGPSDQPPNEFGIFNSLWFSLGAFMQQGCDISPRSLSGRIVGGVWWFFTLIIISSYTANLAAFLTVERMVSPIESAEDLAKQTEIAYGTLDSGSTKEFFRRSKIAVYEKMWTYMRSAEPSVFTRTTAEGVARVRKSKGKFAFLLESTMNEYIEQRKPCDTMKVGGNLDSKGYGVATPKGSSLRTPVNLAVLKLSEAGVLDKLKNKWWYDKGECGPKDSGSKDKTSALSLSNVAGVFYILVGGLGLAMLVALIEFCYKSRAEAKRMKLTFSEAIRNKARLSITGSVGENGRVLTPDCPKAVHTGTAIRQSSGLAVIASDLP

SEQ ID NO: 1867 - protein, 1009 aa, unidentified
MEALTLWLLPWICQCVSVRADSIIHIGAIFEENAAKDDRVFQLAVSDLSLNDDILQSEKITYSIKVIEANNPFQAVQEACDLMTQGILALVTSTGCASANALQSLTDAMHIPHLFVQRNPGGSPRTACHLNPSPDGEAYTLASRPPVRLNDVMLRLVTELRWQKFVMFYDSEYDIRGLQSFLDQASRLGLDVSLQKVDKNISHVFTSLFTTMKTEELNRYRDTLRRAILLLSPQGAHSFINEAVETNLASKDSHWVFVNEEISDPEILDLVHSALGRMTVVRQIFPSAKDNQKCTRNNHRISSLLCDPQEGYLQMLQISNLYLYDSVLMLANAFHRKLEDRKWHSMASLNCIRKSTKPWNGGRSMLDTIKKGHITGLTGVMEFREDSSNPYVQFEILGTTYSETFGKDMRKLATWDSEKGLNGSLQERPMGSRLQGLTLKVVTVLEEPFVMVAENILGQPKRYKGFSIDVLDALAKALGFKYEIYQAPDGRYGHQLHNTSWNGMIGELISKRADLAISAITITPERESVVDFSKRYMDYSVGILIKKPEEKISIFSLFAPFDFAVWACIAAAIPVVGVLIFVLNRIQAVRAQSAAQPRPSASATLHSAIWIVYGAFVQQGGESSVNSMAMRIVMGSWWLFTLIVCSSYTANLAAFLTVSRMDNPIRTFQDLSKQVEMSYGTVRDSAVYEYFRAKGTNPLEQDSTFAELWRTISKNGGADNCVSSPSEGIRKAKKGNYAFLWDVAVVEYAALTDDDCSVTVIGNSISSKGYGIALQHGSPYRDLFSQRILELQDTGDLDVLKQKWWPHMGRCDLTSHASAQADGKSLKLHSFAGVFCILAIGLLLACLVAALELWWNSNRCHQETPKEDKEVNLEQVHRRMNSLMDEDIAHKQISPASIELSALEMGGLAPTQTLEPTREYQNTQLSVSTFLPEQSSHGTSRTLSSGPSSNLPLPLSSSATMPSMQCKHRSPNGGLFRQSPVKTPIPMSFQPVPGGVLPEALDTSHGTSI

SEQ ID NO: 1868 - protein, 1007 aa, unidentified
MEVFPFLLVLSVWWSRTWDSANADSIIHIGAIFDESAKKDDEVFRTAVGDLNQNEEILQTEKITFSVTFVDGNNPFQAVQEACELMNQGILALVSSIGCTSAGSLQSLADAMHIPHLFIQRSTAGTPRSGCGLTRSNRNDDYTLSVRPPVYLHDVILRVVTEYAWQKFIIFYDSEYDIRGIQEFLDKVSQQGMDVALQKVENNINKMITTLFDTMRIEELNRYRDTLRRAILVMNPATAKSFITEVVETNLVAFDCHWIIINEEINDVDVQELVRRSIGRLTIIRQTFPVPQNISQRCFRGNHRISSTLCDPKDPFAQNMEISNLYIYDTVLLLANAFHKKLEDRKWHSMASLSCIRKNSKPWQGGRSMLETIKKGGVSGLTGELEFGENGGNPNVHFEILGTNYGEELGRGVRKLGCWNPVTGLNGSLTDKKLENNMRGVVLRVVTVLEEPFVMVSENVLGKPKKYQGFSIDVLDALSNYLGFNYEIYVAPDHKYGSPQEDGTWNGLVGELVFKRADIGISALTITPDRENVVDFTTRYMDYSVGVLLRRAEKTVDMFACLAPFDLSLWACIAGTVLLVGLLVYLLNWLNPPRLQMGSMTSTTLYNSMWFVYGSFVQQGGEVPYTTLATRMMMGAWWLFALIVISSYTANLAAFLTITRIESSIQSLQDLSKQTEIPYGTVLDSAVYEHVRMKGLNPFERDSMYSQMWRMINRSNGSENNVLESQAGIQKVKYGNYAFVWDAAVLEYVAINDPDCSFYTIGNTVADRGYGIALQHGSPYRDVFSQRILELQQNGDMDILKHKWWPKNGQCDLYSSVDTKQKGGALDIKSFAGVFCILAAGIVLSCFIAMLETWWNKRKGSRVPSKEDDKEIDLEHLHRRVNSLCTDDDSPHKQFSTSSIDLTPLDIDTLPTRQALEQISDFRNTHITTTTFIPEQIQTLSRTLSAKAASGFTFGNVPEHRTGPFRHRAPNGGFFRSPIKTMSSIPYQPTPTLGLNLGNDPDRGTSI

SEQ ID NO: 1869 - protein, 918 aa, unidentified
MEHGTLLAQPGLWTRDTSWALLYFLCYILPQTAPQVLRIGGIFETVENEPVNVEELAFKFAVTSINRNRTLMPNTTLTYDIQRINLFDSFEASRRACDQLALGVAALFGPSHSSSVSAVQSICNALEVPHIQTRWKHPSVDNKDLFYINLYPDYAAISRAILDLVLYYNWKTVTVVYEDSTGLIRLQELIKAPSRYNIKIKIRQLPSGNKDAKPLLKEMKKGKEFYVIFDCSHETAAEILKQILFMGMMTEYYHYFFTTLDLFALDLELYRYSGVNMTGFRLLNIDNPHVSSIIEKWSMERLQAPPRPETGLLDGMMTTEAALMYDAVYMVAIASHRASQLTVSSLQCHRHKPWRLGPRFMNLIKEARWDGLTGHITFNKTNGLRKDFDLDIISLKEEGTEKAAGEVSKHLYKVWKKIGIWNSNSGLNMTDSNKDKSSNITDSLANRTLIVTTILEEPYVMYRKSDKPLYGNDRFEGYCLDLLKELSNILGFIYDVKLVPDGKYGAQNDKGEWNGMVKELIDHRADLAVAPLTITYVREKVIDFSKPFMTLGISILYRKPNGTNPGVFSFLNPLSPDIWMYVLLACLGVSCVLFVIARFTPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVRDGSTMTFFKKSKISTYEKMWAFMSSRQQTALVRNSDEGIQRVLTTDYALLMESTSIEYVTQRNCNLTQIGGLIDSKGYGVGTPIGSPYRDKITIAILQLQEEGKLHMMKEKWWRGNGCPEEDNKEASALGVENIGGIFIVLAAGLVLSVFVAIGEFIYKSRKNNDIEQAFCFFYGLQCKQTHPTNSTSGTTLSTDLECGKLIREERGIRKQSSVHTV

SEQ ID NO: 1870 - protein, 908 aa, unidentified
MKIIFPILSNPVFRRTVKLLLCLLWIGYSQGTTHVLRFGGIFEYVESGPMGAEELAFRFAVNTINRNRTLLPNTTLTYDTQKINLYDSFEASKKACDQLSLGVAAIFGPSHSSSANAVQSICNALGVPHIQTRWKHQVSDNKDSFYVSLYPDFSSLSRAILDLVQFFKWKTVTVVYDDSTGLIRLQELIKAPSRYNLRLKIRQLPADTKDAKPLLKEMKRGKEFHVIFDCSHEMAAGILKQALAMGMMTEYYHYIFTTLDLFALDVEPYRYSGVNMTGFRILNTENTQVSSIIEKWSMERLQAPPKPDSGLLDGFMTTDAALMYDAVHVVSVAVQQFPQMTVSSLQCNRHKPWRFGTRFMSLIKEAHWEGLTGRITFNKTNGLRTDFDLDVISLKEEGLEKIGTWDPASGLNMTESQKGKPANITDSLSNRSLIVTTILEEPYVLFKKSDKPLYGNDRFEGYCIDLLRELSTILGFTYEIRLVEDGKYGAQDDANGQWNGMVRELIDHKADLAVAPLAITYVREKVIDFSKPFMTLGISILYRKPNGTNPGVFSFLNPLSPDIWMYILLAYLGVSCVLFVIARFSPYEWYNPHPCNPDSDVVENNFTLLNSFWFGVGALMQQGSELMPKALSTRIVGGIWWFFTLIIISSYTANLAAFLTVERMESPIDSADDLAKQTKIEYGAVEDGATMTFFKKSKISTYDKMWAFMSSRRQSVLVKSNEEGIQRVLTSDYAFLMESTTIEFVTQRNCNLTQIGGLIDSKGYGVGTPMGSPYRDKITIAILQLQEEGKLHMMKEKWWRGNGCPEEESKEASALGVQNIGGIFIVLAAGLVLSVFVAVGEFLYKSKKNAQLEKRSFCSAMVEELRMSLKCQRRLKHKPQAPVIVKTEEVINMHTFNDRRLPGKETMA

SEQ ID NO: 1871 - protein, 919 aa, unidentified [sequence omitted]

SEQ ID NO: 1872 - protein, 956 aa, unidentified
MPRVSAPLVLLPAWLVMVACSPHSLRIAAILDDPMECSRGERLSITLAKNRINRAPERLGKAKVEVDIFELLRDSEYETAETMCQILPKGVVAVLGPSSSPASSSIISNICGEKEVPHFKVAPEEFVKFQFQRFTTLNLHPSNTDISVAVAGILNFFNCTTACLICAKAECLLNLEKLLRQFLISKDTLSVRMLDDTRDPTPLLKEIRDDKTATIIIHANASMSHTILLKAAELGMVSAYYTYIFTNLEFSLQRMDSLVDDRVNILGFSIFNQSHAFFQEFAQSLNQSWQENCDHVPFTGPALSSALLFDAVYAVVTAVQELNRSQEIGVKPLSCGSAQIWQHGTSLMNYLRMVELEGLTGHIEFNSKGQRSNYALKILQFTRNGFRQIGQWHVAEGLSMDSHLYASNISDTLFNTTLVVTTILENPYLMLKGNHQEMEGNDRYEGFCVDMLKELAEILRFNYKIRLVGDGVYGVPEANGTWTGMVGELIARKADLAVAGLTITAEREKVIDFSKPFMTLGISILYRVHMGRKPGYFSFLDPFSPGVWLFMLLAYLAVSCVLFLVARLTPYEWYSPHPCAQGRCNLLVNQYSLGNSLWFPVGGFMQQGSTIAPRALSTRCVSGVWWAFTLIIISSYTANLAAFLTVQRMDVPIESVDDLADQTAIEYGTIHGGSSMTFFQNSRYQTYQRMWNYMYSKQPSVFVKSTEEGIARVLNSNYAFLLESTMNEYYRQRNCNLTQIGGLLDTKGYGIGMPVGSVFRDEFDLAILQLQENNRLEILKRKWWEGGKCPKEEDHRAKGLGMENIGGIFVVLICGLIVAIFMAMLEFLWTLRHSEATEVSVCQEMVTELRSIILCQDSIHPRRRRAAVPPPRPPIPEERRPRGTATLSNGKLCGAGEPDQLAQRLAQEAALVARGCTHIRVCPECRRFQGLRARPSPARSEESLEWEKTTNSSEPE

SEQ ID NO: 1873 - protein, 980 aa, unidentified
MPAELLLLLIVAFASPSCQVLSSLRMAAILDDQTVCGRGERLALALAREQINGIIEVPAKARVEVDIFELQRDSQYETTDTMCQILPKGVVSVLGPSSSPASASTVSHICGEKEIPHIKVGPEETPRLQYLRFASVSLYPSNEDVSLAVSRILKSFNYPSASLICAKAECLLRLEELVRGFLISKETLSVRMLDDSRDPTPLLKEIRDDKVSTIIIDANASISHLILRKASELGMTSAFYKYILTTMDFPILHLDGIVEDSSNILGFSMFNTSHPFYPEFVRSLNMSWRENCEASTYLGPALSAALMFDAVHVVVSAVRELNRSQEIGVKPLACTSANIWPHGTSLMNYLRMVEYDGLTGRVEFNSKGQRTNYTLRILEKSRQGHREIGVWYSNRTLAMNATTLDINLSQTLANKTLVVTTILENPYVMRRPNFQALSGNERFEGFCVDMLRELAELLRFRYRLRLVEDGLYGAPEPNGSWTGMVGELINRKADLAVAAFTITAEREKVIDFSKPFMTLGISILYRVHMGRKPGYFSFLDPFSPAVWLFMLLAYLAVSCVLFLAARLSPYEWYNPHPCLRARPHILENQYTLGNSLWFPVGGFMQQGSEIMPRALSTRCVSGVWWAFTLIIISSYTANLAAFLTVQRMEVPVESADDLADQTNIEYGTIHAGSTMTFFQNSRYQTYQRMWNYMQSKQPSVFVKSTEEGIARVLNSRYAFLLESTMNEYHRRLNCNLTQIGGLLDTKGYGIGMPLGSPFRDEITLAILQLQENNRLEILKRKWWEGGRCPKEEDHRAKGLGMENIGGIFIVLICGLIIAVFVAVMEFIWSTRRSAESEEVSVCQEMLQELRHAVSCRKTSRSRRRRRPGGPSRALLSLRAVREMRLSNGKLYSAGAGGDAGSAHGGPQRLLDDPGPPSGARPAAPTPCTHVRVCQECRRIQALRASGAGAPPRGLGVPAEATSPPRPRPGPAGPRELAEHE

SEQ ID NO: 1874 - protein, 938 aa, unidentified
MSTMRLLTLALLFSCSVARAACDPKIVNIGAVLSTRKHEQMFREAVNQANKRHGSWKIQLNATSVTHKPNAIQMALSVCEDLISSQVYAILVSHPPTPNDHFTPTPVSYTAGFYRIPVLGLTTRMSIYSDKSIHLSFLRTVPPYSHQSSVWFEMMRVYSWNHIILLVSDDHEGRAAQKRLETLLEERESKAEKVLQFDPGTKNVTALLMEAKELEARVIILSASEDDAATVYRAAAMLNMTGSGYVWLVGEREISGNALRYAPDGILGLQLINGKNESAHISDAVGVVAQAVHELLEKENITDPPRGCVGNTNIWKTGPLFKRVLMSSKYADGVTGRVEFNEDGDRKFANYSIMNLQNRKLVQVGIYNGTHVIPNDRKIIWPGGETEKPRGYQMSTRLKIVTIHQEPFVYVKPTLSDGTCKEEFTVNGDPVKKVICTGPNDTSPGSPRHTVPQCCYGFCIDLLIKLARTMNFTYEVHLVADGKFGTQERVNNSNKKEWNGMMGELLSGQADMIVAPLTINNERAQYIEFSKPFKYQGLTILVKKEIPRSTLDSFMQPFQSTLWLLVGLSVHVVAVMLYLLDRFSPFGRFKVNSEEEEEDALTLSSAMWFSWGVLLNSGIGEGAPRSFSARILGMVWAGFAMIIVASYTANLAAFLVLDRPEERITGINDPRLRNPSDKFIYATVKQSSVDIYFRRQVELSTMYRHMEKHNYESAAEAIQAVRDNKLHAFIWDSAVLEFEASQKCDLVTTGELFFRSGFGIGMRKDSPWKQNVSLSILKSHENGFMEDLDKTWVRYQECDSRSNAPATLTFENMAGVFMLVAGGIVAGIFLIFIEIAYKRHKDARRKQMQLAFAAVNVWRKNLQDRKSGRAEPDPKKKATFRAITSTLASSFKRRRSSKDTSTGGGRGALQNQKDTVLPRRAIEREEGQLQLCSRHRES

SEQ ID NO: 1875 - protein, 1464 aa, unidentified [sequence omitted]

SEQ ID NO: 1876 - protein, 1484 aa, unidentified [sequence omitted]

SEQ ID NO: 1877 - protein, 1233 aa, unidentified
MGGALGPALLLTSLFGAWAGLGPGQGEQGMTVAVVFSSSGPPQAQFRARLTPQSFLDLPLEIQPLTVGVNTTNPSSLLTQICGLLGAAHVHGIVFEDNVDTEAVAQILDFISSQTHVPILSISGGSAVVLTPKEPGSAFLQLGVSLEQQLQVLFKVLEEYDWSAFAVITSLHPGHALFLEGVRAVADASHVSWRLLDVVTLELGPGGPRARTQRLLRQLDAPVFVAYCSREEAEVLFAEAAQAGLVGPGHVWLVPNLALGSTDAPPATFPVGLISVVTESWRLSLRQKVRDGVAILALGAHSYWRQHGTLPAPAGDCRVHPGPVSPAREAFYRHLLNVTWEGRDFSFSPGGYLVQPTMVVIALNRHRLWEMVGRWEHGVLYMKYPVWPRYSASLQPVVDSRHLTVATLEERPFVIVESPDPGTGGCVPNTVPCRRQSNHTFSSGDVAPYTKLCCKGFCIDILKKLARVVKFSYDLYLVTNGKHGKRVRGVWNGMIGEVYYKRADMAIGSLTINEERSEIVDFSVPFVETGISVMVARSNGTVSPSAFLEPYSPAVWVMMFVMCLTVVAITVFMFEYFSPVSYNQNLTRGKKSGGPAFTIGKSVWLLWALVFNNSVPIENPRGTTSKIMVLVWAFFAVIFLASYTANLAAFMIQEQYIDTVSGLSDKKFQRPQDQYPPFRFGTVPNGSTERNIRSNYRDMHTHMVKFNQRSVEDALTSLKMGKLDAFIYDAAVLNYMAGKDEGCKLVTIGSGKVFATTGYGIAMQKDSHWKRAIDLALLQFLGDGETQKLETVWLSGICQNEKNEVMSSKLDIDNMAGVFYMLLVAMGLALLVFAWEHLVYWKLRHSVPNSSQLDFLLAFSRGIYSCFSGVQSLASPPRQASPDLTASSAQASVLKMLQAARDMVTTAGVSSSLDRATRTIENWGGGRRAPPPSPCPTPRSGPSPCLPTPDPPPEPSPTGWGPPDGGRAALVRRAPQPPGRPPTPGPPLSDVSRVSRRPAWEARWPVRTGHCGRHLSASERPLSPARCHYSSFPRADRSGRPFLPLFPELEDLPLLGPEQLARREALLHAAWARGSRPRHASLPSSVAEAFARPSSLPAGCTGPACARPDGHSACRRLAQAQSMCLPIYREACQEGEQAGAPAWQHRQHVCLHAHAHLPFCWGAVCPHLPPCASHGSWLSGAWGPLGHRGRTLGLGTGYRDSGGLDEISRVARGTQGFPGPCTWRRISSLESEV

SEQ ID NO: 1878 - protein, 1336 aa, unidentified
MRGAGGPRGPRGPAKMLLLLALACASPFPEEAPGPGGAGGPGGGLGGARPLNVALVFSGPAYAAEAARLGPAVAAAVRSPGLDVRPVALVLNGSDPRSLVLQLCDLLSGLRVHGVVFEDDSRAPAVAPILDFLSAQTSLPIVAVHGGAALVLTPKEKGSTFLQLGSSTEQQLQVIFEVLEEYDWTSFVAVTTRAPGHRAFLSYIEVLTDGSLVGWEHRGALTLDPGAGEAVLSAQLRSVSAQIRLLFCAREEAEPVFRAAEEAGLTGSGYVWFMVGPQLAGGGGSGAPGEPPLLPGGAPLPAGLFAVRSAGWRDDLARRVAAGVAVVARGAQALLRDYGFLPELGHDCRAQNRTHRGESLHRYFMNITWDNRDYSFNEDGFLVNPSLVVISLTRDRTWEVVGSWEQQTLRLKYPLWSRYGRFLQPVDDTQHLTVATLEERPFVIVEPADPISGTCIRDSVPCRSQLNRTHSPPPDAPRPEKRCCKGFCIDILKRLAHTIGFSYDLYLVTNGKHGKKIDGVWNGMIGEVFYQRADMAIGSLTINEERSEIVDFSVPFVETGISVMVARSNGTVSPSAFLEPYSPAVWVMMFVMCLTVVAVTVFIFEYLSPVGYNRSLATGKRPGGSTFTIGKSIWLLWALVFNNSVPVENPRGTTSKIMVLVWAFFAVIFLASYTANLAAFMIQEEYVDTVSGLSDRKFQRPQEQYPPLKFGTVPNGSTEKNIRSNYPDMHSYMVRYNQPRVEEALTQLKAGKLDAFIYDAAVLNYMARKDEGCKLVTIGSGKVFATTGYGIALHKGSRWKRPIDLALLQFLGDDEIEMLERLWLSGICHNDKIEVMSSKLDIDNMAGVFYMLLVAMGLSLLVFAWEHLVYWRLRHCLGPTHRMDFLLAFSRGMYSCCSAEAAPPPAKPPPPPQPLPSPAYPAPRPAPGPAPFVPRERASVDRWRRTKGAGPPGGAGLADGFHRYYGPIEPQGLGLGLGEARAAPRGAAGRPLSPPAAQPPQKPPPSYFAIVRDKEPAEPPAGAFPGFPSPPAPPAAAATAVGPPLCRLAFEDESPPAPARWPRSDPESQPLLGPGAGGAGGTGGAGGGAPAAPPPCRAAPPPCPYLDLEPSPSDSEDSESLGGASLGGLEPWWFADFPYPYAERLGPPPGRYWSVDKLGGWRAGSWDYLPPRSGPAAWHCRHCASLELLPPPRHLSCSHDGLDGGWWAPPPPPWAAGPLPRRRARCGCPRSHPHRPRASHRTPAAAAPHHHRHRRAAGGWDLPPPAPTSRSLEDLSSCPRAAPARRLTGPSRHARRCPHAAHWGPPLPTASHRRHRGGDLGTRRGSAHFSSLESEV

SEQ ID NO: 1879 - protein, 1115 aa, unidentified
MRRLSLWWLLSRVCLLLPPPCALVLAGVPSSSSHPQPCQILKRIGHAVRVGAVHLQPWTTAPRAASRAPDDSRAGAQRDEPEPGTRRSPAPSPGARWLGSTLHGRGPPGSRKPGEGARAEALWPRDALLFAVDNLNRVEGLLPYNLSLEVVMAIEAGLGDLPLLPFSSPSSPWSSDPFSFLQSVCHTVVVQGVSALLAFPQSQGEMMELDLVSLVLHIPVISIVRHEFPRESQNPLHLQLSLENSLSSDADVTVSILTMNNWYNFSLLLCQEDWNITDFLLLTQNNSKFHLGSIINITANLPSTQDLLSFLQIQLESIKNSTPTVVMFGCDMESIRRIFEITTQFGVMPPELRWVLGDSQNVEELRTEGLPLGLIAHGKTTQSVFEHYVQDAMELVARAVATATMIQPELALIPSTMNCMEVETTNLTSGQYLSRFLANTTFRGLSGSIRVKGSTIVSSENNFFIWNLQHDPMGKPMWTRLGSWQGGKIVMDYGIWPEQAQRHKTHFQHPSKLHLRVVTLIEHPFVFTREVDDEGLCPAGQLCLDPMTNDSSTLDSLFSSLHSSNDTVPIKFKKCCYGYCIDLLEKIAEDMNFDFDLYIVGDGKYGAWKNGHWTGLVGDLLRGTAHMAVTSFSINTARSQVIDFTSPFFSTSLGILVRTRDTAAPIGAFMWPLHWTMWLGIFVALHITAVFLTLYEWKSPFGLTPKGRNRSKVFSFSSALNICYALLFGRTVAIKPPKCWTGRFLMNLWAIFCMFCLSTYTANLAAVMVGEKIYEELSGIHDPKLHHPSQGFRFGTVRESSAEDYVRQSFPEMHEYMRRYNVPATPDGVEYLKNDPEKLDAFIMDKALLDYEVSIDADCKLLTVGKPFAIEGYGIGLPPNSPLTANISELISQYKSHGFMDMLHDKWYRVVPCGKRSFAVTETLQMGIKHFSGLFVLLCIGFGLSILTTIGEHIVYRLLLPRIKNKSKLQYWLHTSQRLHRAINTSFIEEKQQHFKTKRVEKRSNVGPRQLTVWNTSNLSHDNRRKYIFSDEEGQNQLGIRIHQDIPLPPRRRELPALRTTNGKADSLNVSRNSVMQELSELEKQIQVIRQELQLAVSRKTELEEYQRTSRTCES

SEQ ID NO: 1880 - protein, 1043 aa, unidentified
MEFVRALWLGLALALGPGSAGGHPQPCGVLARLGGSVRLGALLPRAPLARARARAALARAALAPRLPHNLSLELVVAAPPARDPASLTRGLCQALVPPGVAALLAFPEARPELLQLHFLAAATETPVLSLLRREARAPLGAPNPFHLQLHWASPLETLLDVLVAVLQAHAWEDVGLALCRTQDPGGLVALWTSRAGRPPQLVLDLSRRDTGDAGLRARLAPMAAPVGGEAPVPAAVLLGCDIARARRVLEAVPPGPHWLLGTPLPPKALPTAGLPPGLLALGEVARPPLEAAIHDIVQLVARALGSAAQVQPKRALLPAPVNCGDLQPAGPESPGRFLARFLANTSFQGRTGPVWVTGSSQVHMSRHFKVWSLRRDPRGAPAWATVGSWRDGQLDLEPGGASARPPPPQGAQVWPKLRVVTLLEHPFVFARDPDEDGQCPAGQLCLDPGTNDSATLDALFAALANGSAPRALRKCCYGYCIDLLERLAEDTPFDFELYLVGDGKYGALRDGRWTGLVGDLLAGRAHMAVTSFSINSARSQVVDFTSPFFSTSLGIMVRARDTASPIGAFMWPLHWSTWLGVFAALHLTALFLTVYEWRSPYGLTPRGRNRSTVFSYSSALNLCYAILFRRTVSSKTPKCPTGRLLMNLWAIFCLLVLSSYTANLAAVMVGDKTFEELSGIHDPKLHHPAQGFRFGTVWESSAEAYIKKSFPDMHAHMRRHSAPTTPRGVAMLTSDPPKLNAFIMDKSLLDYEVSIDADCKLLTVGKPFAIEGYGIGLPQNSPLTSNLSEFISRYKSSGFIDLLHDKWYKMVPCGKRVFAVTETLQMSIYHFAGLFVLLCLGLGSALLSSLGEHAFFRLALPRIRKGSRLQYWLHTSQKIHRALNTEPPEGSKEETAEAEPSGPEVEQQQQQQDQPTAPEGWKRARRAVDKERRVRFLLEPAVVVAPEADAEAEAAPREGPVWLCSYGRPPAARPTGAPQPGELQELERRIEVARERLRQALVRRGQLLAQLGDSARHRPRRLLQARAAPAEAPPHSGRPGSQE

SEQ ID NO: 1881 - protein, 371 aa, unidentified
MSHEKSFLVSGDNYPPPNPGYPGGPQPPMPPYAQPPYPGAPYPQPPFQPSPYGQPGYPHGPSPYPQGGYPQGPYPQGGYPQGPYPQEGYPQGPYPQGGYPQGPYPQSPFPPNPYGQPQVFPGQDPDSPQHGNYQEEGPPSYYDNQDFPATNWDDKSIRQAFIRKVFLVLTLQLSVTLSTVSVFTFVAEVKGFVRENVWTYYVSYAVFFISLIVLSCCGDFRRKHPWNLVALSVLTASLSYMVGMIASFYNTEAVIMAVGITTAVCFTVVIFSMQTRYDFTSCMGVLLVSMVVLFIFAILCIFIRNRILEIVYASLGALLFTCFLAVDTQLLLGNKQLSLSPEEYVFAALNLYTDIINIFLYILTIIGRAKE

SEQ ID NO: 1882 - protein, 1194 aa, unidentified
MVGLLLFFFPAIFLEVSLLPRSPGRKVLLAGASSQRSVARMDGDVIIGALFSVHHQPPAEKVPERKCGEIREQYGIQRVEAMFHTLDKINADPVLLPNITLGSEIRDSCWHSSVALEQSIEFIRDSLISIRDEKDGINRCLPDGQSLPPGRTKKPIAGVIGPGSSSVAIQVQNLLQLFDIPQIAYSATSIDLSDKTLYKYFLRVVPSDTLQARAMLDIVKRYNWTYVSAVHTEGNYGESGMDAFKELAAQEGLCIAHSDKIYSNAGEKSFDRLLRKLRERLPKARVVVCFCEGMTVRGLLSAMRRLGVVGEFSLIGSDGWADRDEVIEGYEVEANGGITIKLQSPEVRSFDDYFLKLRLDTNTRNPWFPEFWQHRFQCRLPGHLLENPNFKRICTGNESLEENYVQDSKMGFVINAIYAMAHGLQNMHHALCPGHVGLCDAMKPIDGSKLLDFLIKSSFIGVSGEEVWFDEKGDAPGRYDIMNLQYTEANRYDYVHVGTWHEGVLNIDDYKIQMNKSGVVRSVCSEPCLKGQIKVIRKGEVSCCWICTACKENEYVQDEFTCKACDLGWWPNADLTGCEPIPVRYLEWSNIESIIAIAFSCLGILVTLFVTLIFVLYRDTPVVKSSSRELCYIILAGIFLGYVCPFTLIAKPTTTSCYLQRLLVGLSSAMCYSALVTKTNRIARILAGSKKKICTRKPRFMSAWAQVIIASILISVQLTLVVTLIIMEPPMPILSYPSIKEVYLICNTSNLGVVAPLGYNGLLIMSCTYYAFKTRNVPANFNEAKYIAFTMYTTCIIWLAFVPIYFGSNYKIITTCFAVSLSVTVALGCMFTPKMYIIIAKPERNVRSAFTTSDVVRMHVGDGKLPCRSNTFLNIFRRKKAGAGNANSNGKSVSWSEPGGGQVPKGQHMWHRLSVHVKTNETACNQTAVIKPLTKSYQGSGKSLTFSDTSTKTLYNVEEEEDAQPIRFSPPGSPSMVVHRRVPSAATTPPLPSHLTAEETPLFLAEPALPKGLPPPLQQQQQPPPQQKSLMDQLQGVVSNFSTAIPDFHAVLAGPGGPGNGLRSLYPPPPPPQHLQMLPLQLSTFGEELVSPPADDDDDSERFKLLQEYVYEHEREGNTEEDELEEEEEDLQAASKLTPDDSPALTPPSPFRDSVASGSSVPSSPVSESVLCTPPNVSYASVILRDYKQSSSTL

SEQ ID NO: 1883 - protein, 872 aa, unidentified [sequence omitted]

SEQ ID NO: 1884 - protein, 879 aa, unidentified
MKMLTRLQVLTLALFSKGFLLSLGDHNFLRREIKIEGDLVLGGLFPINEKGTGTEECGRINEDRGIQRLEAMLFAIDEINKDDYLLPGVKLGVHILDTCSRDTYALEQSLEFVRASLTKVDEAEYMCPDGSYAIQENIPLLIAGVIGGSYSSVSIQVANLLRLFQIPQISYASTSAKLSDKSRYDYFARTVPPDFYQAKAMAEILRFFNWTYVSTVASEGDYGETGIEAFEQEARLRNICIATAEKVGRSNIRKSYDSVIRELLQKPNARVVVLFMRSDDSRELIAAASRANASFTWVASDGWGAQESIIKGSEHVAYGAITLELASQPVRQFDRYFQSLNPYNNHRNPWFRDFWEQKFQCSLQNKRNHRRVCDKHLAIDSSNYEQESKIMFVVNAVYAMAHALHKMQRTLCPNTTKLCDAMKILDGKKLYKDYLLKINFTAPFNPNKDADSIVKFDTFGDGMGRYNVFNFQNVGGKYSYLKVGHWAETLSLDVNSIHWSRNSVPTSQCSDPCAPNEMKNMQPGDVCCWICIPCEPYEYLADEFTCMDCGSGQWPTADLTGCYDLPEDYIRWEDAWAIGPVTIACLGFMCTCMVVTVFIKHNNTPLVKASGRELCYILLFGVGLSYCMTFFFIAKPSPVICALRRLGLGSSFAICYSALLTKTNCIARIFDGVKNGAQRPKFISPSSQVFICLGLILVQIVMVSVWLILEAPGTRRYTLAEKRETVILKCNVKDSSMLISLTYDVILVILCTVYAFKTRKCPENFNEAKFIGFTMYTTCIIWLAFLPIFYVTSSDYRVQTTTMCISVSLSGFVVLGCLFAPKVHIILFQPQKNVVTHRLHLNRFSVSGTGTTYSQSSASTYVPTVCNGREVLDSTTSSL

SEQ ID NO: 1885 - protein, 912 aa, unidentified
MPGKRGLGWWWARLPLCLLLSLYGPWMPSSLGKPKGHPHMNSIRIDGDITLGGLFPVHGRGSEGKPCGELKKEKGIHRLEAMLFALDRINNDPDLLPNITLGARILDTCSRDTHALEQSLTFVQALIEKDGTEVRCGSGGPPIITKPERVVGVIGASGSSVSIMVANILRLFKIPQISYASTAPDLSDNSRYDFFSRVVPSDTYQAQAMVDIVRALKWNYVSTVASEGSYGESGVEAFIQKSREDGGVCIAQSVKIPREPKAGEFDKIIRRLLETSNARAVIIFANEDDIRRVLEAARRANQTGHFFWMGSDSWGSKIAPVLHLEEVAEGAVTILPKRMSVRGFDRYFSSRTLDNNRRNIWFAEFWEDNFHCKLSRHALKKGSHVKKCTNRERIGQDSAYEQEGKVQFVIDAVYAMGHALHAMHRDLCPGRVGLCPRMDPVDGTQLLKYIRNVNFSGIAGNPVTFNENGDAPGRYDIYQYQLRNDSAEYKVIGSWTDHLHLRIERMHWPGSGQQLPRSICSLPCQPGERKKTVKGMPCCWHCEPCTGYQYQVDRYTCKTCPYDMRPTENRTGCRPIPIIKLEWGSPWAVLPLFLAVVGIAATLFVVITFVRYNDTPIVKASGRELSYVLLAGIFLCYATTFLMIAEPDLGTCSLRRIFLGLGMSISYAALLTKTNRIYRIFEQGKRSVSAPRFISPASQLAITFSLISLQLLGICVWFVVDPSHSVVDFQDQRTLDPRFARGVLKCDISDLSLICLLGYSMLLMVTCTVYAIKTRGVPETFNEAKPIGFTMYTTCIVWLAFIPIFFGTSQSADKLYIQTTTLTVSVSLSASVSLGMLYMPKVYIILFHPEQNVPKRKRSLKAVVTAATMSNKFTQKGNFRPNGEAKSELCENLEAPALATKQTYVTYTNHAI

SEQ ID NO: 1886 - protein, 1212 aa, unidentified
MVLLLILSVLLLKEDVRGSAQSSERRVVAHMPGDIIIGALFSVHHQPTVDKVHERKCGAVREQYGIQRVEAMLHTLERINSDPTLLPNITLGCEIRDSCWHSAVALEQSIEFIRDSLISSEEEEGLVRCVDGSSSSFRSKKPIVGVIGPGSSSVAIQVQNLLQLFNIPQIAYSATSMDLSDKTLFKYFMRVVPSDAQQARAMVDIVKRYNWTYVSAVHTEGNYGESGMEAFKDMSAKEGICIAHSYKIYSNAGEQSFDKLLKKLTSHLPKARVVACFCEGMTVRGLLMAMRRLGLAGEFLLLGSDGWADRYDVTDGYQREAVGGITIKLQSPDVKWFDDYYLKLRPETNHRNPWFQEFWQHRFQCRLEGFPQENSKYNKTCNSSLTLKTHHVQDSKMGFVINAIYSMAYGLHNMQMSLCPGYAGLCDAMKPIDGRKLLESLMKTNFTGVSGDTILFDENGDSPGRYEIMNFKEMGKDYFDYINVGSWDNGELKMDDDEVWSKKSNIIRSVCSEPCEKGQIKVIRKGEVSCCWTCTPCKENEYVFDEYTCKACQLGSWPTDDLTGCDLIPVQYLRWGDPEPIAAVVFACLGLLATLFVTVVFIIYRDTPVVKSSSRELCYIILAGICLGYLCTFCLIAKPKQIYCYLQRIGIGLSPAMSYSALVTKTNRIARILAGSKKKICTKKPRFMSACAQLVIAFILICIQLGIIVALFIMEPPDIMHDYPSIREVYLICNTTNLGVVTPLGYNGLLILSCTFYAFKTRNVPANFNEAKYIAFTMYTTCIIWLAFVPIYFGSNYKIITMCFSVSLSATVALGCMFVPKVYIILAKPERNVRSAFTTSTVVRMHVGDGKSSSAASRSSSLVNLWKRRGSSGETLRYKDRRLAQHKSEIECFTPKGSMGNGGRATMSSSNGKSVTWAQNEKSSRGQHLWQRLSIHINKKENPNQTAVIKPFPKSTESRGLGAGAGAGGSAGGVGATGGAGCAGAGPGGPESPDAGPKALYDVAEAEEHFPAPARPRSPSPISTLSHRAGSASRTDDDVPSLHSEPVARSSSSQGSLMEQISSVVTRFTANISELNSMMLSTAAPSPGVGAPLCSSYLIPKEIQLPTTMTTFAEIQPLPAIEVTGGAQPAAGAQAAGDAARESPAAGPEAAAAKPDLEELVALTPPSPFRDSVDSGSTTPNSPVSESALCIPSSPKYDTLIIRDYTQSSSSL

SEQ ID NO: 1887 - protein, 877 aa, unidentified
MARPRRAREPLLVALLPLAWLAQAGLARAAGSVRLAGGLTLGGLFPVHARGAAGRACGQLKKEQGVHRLEAMLYALDRVNADPELLPGVRLGARLLDTCSRDTYALEQALSFVQALIRGRGDGDEVGVRCPGGVPPLRPAPPERVVAVVGASASSVSIMVANVLRLFAIPQISYASTAPELSDSTRYDFFSRVVPPDSYQAQAMVDIVRALGWNYVSTLASEGNYGESGVEAFVQISREAGGVCIAQSIKIPREPKPGEFSKVIRRLMETPNARGIIIFANEDDIRRVLEAARQANLTGHFLWVGSDSWGAKTSPILSLEDVAVGAITILPKRASIDGFDQYFMTRSLENNRRNIWFAEFWEENFNCKLTSSGTQSDDSTRKCTGEERIGRDSTYEQEGKVQFVIDAVYAIAHALHSMHQALCPGHTGLCPAMEPTDGRMLLQYIRAVRFNGSAGTPVMFNENGDAPGRYDIFQYQATNGSASSGGYQAVGQWAETLRLDVEALQWSGDPHEVPSSLCSLPCGPGERKKMVKGVPCCWHCEACDGYRFQVDEFTCEACPGDMRPTPNHTGCRPTPVVRLSWSSPWAAPPLLLAVLGIVATTTVVATFVRYNNTPIVRASGRELSYVLLTGIFLIYAITFLMVAEPGAAVCAARRLFLGLGTTLSYSALLTKTNRIYRIFEQGKRSVTPPPFISPTSQLVITFSLTSLQVVGMIAWLGARPPHSVIDYEEQRTVDPEQARGVLKCDMSDLSLIGCLGYSLLLMVTCTVYAIKARGVPETFNEAKPIGFTMYTTCIIWLAFVPIFFGTAQSAEKIYIQTTTLTVSLSLSASVSLGMLYVPKTYVILFHPEQNVQKRKRSLKATSTVAAPPKGEDAEAHK

SEQ ID NO: 1888 - protein, 915 aa, unidentified
MVQLRKLLRVLTLMKFPCCVLEVLLCALAAAARGQEMYAPHSIRIEGDVTLGGLFPVHAKGPSGVPCGDIKRENGIHRLEAMLYALDQINSDPNLLPNVTLGARILDTCSRDTYALEQSLTFVQALIQKDTSDVRCTNGEPPVFVKPEKVVGVIGASGSSVSIMVANILRLFQIPQISYASTAPELSDDRRYDFFSRVVPPDSFQAQAMVDIVKALGWNYVSTLASEGSYGEKGVESFTQISKEAGGLCIAQSVRIPQERKDRTIDFDRIIKQLLDTPNSRAVVIFANDEDIKQILAAAKRADQVGHFLWVGSDSWGSKINPLHQHEDIAEGAITIQPKRATVEGFDAYFTSRTLENNRRNVWFAEYWEENFNCKLTISGSKKEDTDRKCTGQERIGKDSNYEQEGKVQFVIDAVYAMAHALHHMNKDLCADYRGVCPEMEQAGGKKLLKYIRNVNFNGSAGTPVMFNKNGDAPGRYDIFQYQTTNTSNPGYRLIGQWTDELQLNIEDMQWGKGVREIPASVCTLPCKPGQRKKTQKGTPCCWTCEPCDGYQYQFDEMTCQHCPYDQRPNENRTGCQDIPIIKLEWHSPWAVIPVFLAMLGIIATIFVMATFIRYNDTPIVRASGRELSYVLLTGIFLCYIITFLMIAKPDVAVCSFRRVFLGLGMCISYAALLTKTNRIYRIFEQGKKSVTAPRLISPTSQLAITSSLISVQLLGVFIWFGVDPPNIIIDYDEHKTMNPEQARGVLKCDITDLQIICSLGYSILLMVTCTVYAIKTRGVPENFNEAKPIGFTMYTTCIVWLAFIPIFFGTAQSAEKLYIQTTTLTISMNLSASVALGMLYMPKVYIIIFHPELNVQKRKRSFKAVVTAATMSSRLSHKPSDRPNGEAKTELCENVDPNSPAAKKKYVSYNNLVI

SEQ ID NO: 1889 - protein, 908 aa, unidentified
MVCEGKRSASCPCFFLLTAKFYWILTMMQRTHSQEYAHSIRVDGDIILGGLFPVHAKGERGVPCGELKKEKGIHRLEAMLYAIDQINKDPDLLSNITLGVRILDTCSRDTYALEQSLTFVQALIEKDASDVKCANGDPPIFTKPDKISGVIGAAASSVSIMVANILRLFKIPQISYASTAPELSDNTRYDFFSRVVPPDSYQAQAMVDIVTALGWNYVSTLASEGNYGESGVEAFTQISREIGGVCIAQSQKIPREPRPGEFEKIIKRLLETPNARAVIMFANEDDIRRILEAAKKLNQSGHFLWIGSDSWGSKIAPVYQQEEIAEGAVTILPKRASIDGFDRYFRSRTLANNRRNVWFAEFWEENFGCKLGSHGKRNSHIKKCTGLERIARDSSYEQEGKVQFVIDAVYSMAYALHNMHKDLCPGYIGLCPRMSTIDGKELLGYIRAVNFNGSAGTPVTFNENGDAPGRYDIFQYQITNKSTEYKVIGHWTNQLHLKVEDMQWAHREHTHPASVCSLPCKPGERKKTVKGVPCCWHCERCEGYNYQVDELSCELCPLDQRPNMNRTGCQLIPIIKLEWHSPWAVVPVFVAILGIIATTFVIVTFVRYNDTPIVRASGRELSYVLLTGIFLCYSITFLMIAAPDTIICSFRRVFLGLGMCFSYAALLTKTNRIHRIFEQGKKSVTAPKFISPASQLVITFSLISVQLLGVFVWFVVDPPHIIIDYGEQRTLDPEKARGVLKCDISDLSLICSLGYSILLMVTCTVYAIKTRGVPETFNEAKPIGFTMYTTCIIWLAFIPIFFGTAQSAEKMYIQTTTLTVSMSLSASVSLGMLYMPKVYIIIFHPEQNVQKRKRSFKAVVTAATMQSKLIQKGNDRPNGEVKSELCESLETNTSSTKTTYISYSNHSI

SEQ ID NO: 1890 - protein, 384 aa, unidentified
MALNDCFLLNLEVDHFMHCNISSHSADLPVNDDWSHPGILYVIPAVYGVIILIGLIGNITLIKIFCTVKSMRNVPNLFISSLALGDLLLLITCAPVDASRYLADRWLFGRIGCKLIPFIQLTSVGVSVFTLTALSADRYKAIVRPMDIQASHALMKICLKAAFIWIISMLLAIPEAVFSDLHPFHEESTNQTFISCAPYPHSNELHPKIHSMASFLVFYVIPLSIISVYYYFIAKNLIQSAYNLPVEGNIHVKKQIESRKRLAKTVLVFVGLFAFCWLPNHVIYLYRSYHYSEVDTSMLHFVTSICARLLAFTNSCVNPFALYLLSKSFRKQFNTQLLCCQPGLIIRSHSTGRSTTCMTSLKSTNPSVATFSLINGNICHERYV

SEQ ID NO: 1891 - protein, 349 aa, unidentified
MAKMELSKAFSGQRTLLSAILSMLSLSFSTTSLLSNYWFVGTQKVPKPLCEKGLAAKCFDMPVSLDGDTNTSTQEVVQYNWETGDDRFSFRSFRSGMWLSCEETVEEPALLHPQSWKQFRALRSSGTAAAKGERCRSFIELTPPAKREILWLSLGTQITYIGLQFISFLLLLTDLLLTGNPACGLKLSAFAAVSSVLSGLLGMVAHMMYSQVFQATVNLGPEDWRPHVWNYGWAFYMAWLSFTCCMASAVTTFNTYTRMVLEFKCKHSKSFKENPNCLPHHHQCFPRRLSSAAPTVGPLTSYHQYHNQPIHSVSEGVDFYSELRNKGFQRGASQELKEAVRSSVEEEQC

SEQ ID NO: 1892 - protein, 331 aa, unidentified
MKTSRRGRALLAVALNLLALLFATTAFLTTHWCQGTQRVPKPGCGQGGRANCPNSGANATANGTAAPAAAAAAATASGNGPPGGALYSWETGDDRFLFRNFHTGIWYSCEEELSGLGEKCRSFIDLAPASEKGVLWLSVVSEVLYILLLVVGFSLMCLELFHSSNVIDGLKLNAFAAVFTVLSGLLGMVAHMMYTQVFQVTVSLGPEDWRPHSWDYGWSFCLAWGSFTCCMAASVTTLNSYTKTVIEFRHKRKVFEQGYREEPTFIDPEAIKYFRERMEKRDGSEEDFHLDCRHERYPARHQPHMADSWPRSSAQEAPELNRQCWVLGHWV

SEQ ID NO: 1893 - protein, 633 aa, unidentified
MKAIKKSLTEEEYLYLDFSHQTEGCIFPLHTSVTLFLLSYCDCKIFKICLVVTKEVSRDSSLLRDDLIQDVEIQIISRQELPPIVQNCCLPAVVERSDNFCRAGLAVVLRHIIQKSYEADPLKKELLELLGFKKTCLKACAEVSQWTRLCELTIPLAIENFLRESSDQPPTIPVEILQLEKKLSEPVRVHNDDKLRRQKLKQQKADGVGPPLTKGKAKSKVHTQETSEGLDSSSKSLELKVAFSKLTVQEEPATTNREPSHIRKAKASDLPPLEHVFAEGLYFTLADIVLLPCIHHFLVIISRKFSEKLVEFPLLASWYQRIQEVPGVKTAASKCGIQFLHLPKLLTTSTEQHPNLCEVPGVEEQSDPLFIGGPRPTMAKLMEKGIEVMFSPHPCPTWTLDWNVLPAAVSPKEGKMSSDRALRKQQQLNNLVYVVTNQAKPGDRIVDFCSGGGHVGIVLAHMLPSCQVTLIENKELSLIRAKKRSDELGLSNIWFIQANMEYFTGMFNIGVALHACGVATDMVIEHCIKTRASFVTCPCCYGFIQNTSKFNFPKSEQFKKTLSYKEHMILCRFADQTAVQLPPQRRLIGKQCMCLVDLDRARAAEECGYSVQVISMEPESCSPKNNMIVGVPI

SEQ ID NO: 1894 - protein, 2109 aa, unidentified
MDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKYDILMEKLSVMLSTRTNHIETLGKLREELGLCERTFKRLYQYMLNAGLAKVVSLRLQEIHPECGPCKTKKGTDVMVRCLKLLKEFKRNDHDDDEDEEVISKTVPPVDIVFERDMLTQTYDLIERRGTKGISQAEIRVAMNVGKLEARMLCRLLQRFKVVKGFMEDEGRQRTTKYISCVFAEESDLSRQYQREKARSELLTTVSLASMQEESLLPEGEDTFLSESDSEEERSSSKRRGRGSQKDTRASANLRPKTQPHHSTPTKGGWKVVNLHPLKKQPPSFPGAAEERACQSLASRDSLLDTSSVSEPNVSFVSHCADSNSGDIAVIEEVRMENPKESSSSLKTGRHSSGQDKPHETYRLLKRRNLIIEAVTNLRLIESLFTIQKMIMDQEKQEGVSTKCCKKSIVRLVRNLSEEGLLRLYRTTVIQDGIKKKVDLVVHPSMDQNDPLVRSAIEQVRFRISNSSTANRVKTSQPPVPQGEAEEDSQGKEGPSGSGDSQLSASSRSESGRMKKSDNKMGITPLRNYHPIVVPGLGRSLGFLPKMPRLRVVHMFLWYLIYGHPASNTVEKPSFISERRTIKQESGRAGVRPSSSGSAWEACSEAPSKGSQDGVTWEAEVELATETVYVDDASWMRYIPPIPVHRDFGFGWALVSDILLCLPLSIFIQIVQVSYKVDNLEEFLNDPLKKHTLIRFLPRPIRQQLLYKRRYIFSVVENLQRLCYMGLLQFGPTEKFQDKDQVFIFLKKNAVIVDTTICDPHYNLARSSRPFERRLYVLNSMQDVENYWFDLQCVCLNTPLGVVRCPRVRKNSSTDQGSDEEGSLQKEQESAMDKHNLERKCAMLEYTTGSREVVDEGLIPGDGLGAAGLDSSFYGHLKRNWIWTSYIINQAKKENTAAENGLTVRLQTFLSKRPMPLSARGNSRLNIWGEARVGSELCAGWEEQFEVDREPSLDRNRRVRGGKSQKRKRLKKDPGKKIKRKKKGEFPGEKSKRLRYHDEADQSALQRMTRLRVTWSMQEDGLLVLCRIASNVLNTKVKGPFVTWQVVRDILHATFEESLDKTSHSVGRRARYIVKNPQAYLNYKVCLAEVYQDKALVGDFMNRRGDYDDPKVCANEFKEFVEKLKEKFSSALRNSNLEIPDTLQELFARYRVLAIGDEKDQTRKEDELNSVDDIHFLVLQNLIQSTLALSDSQMKSYQSFQTFRLYREYKDHVLVKAFMECQKRSLVNRRRVNHTLGPKKNRALPFVPMSYQLSQTYYRIFTWRFPSTICTESFQFLDRMRAAGKLDQPDRFSFKDQDNNEPTNDMVAFSLDGPGGNCVAVLTLFSLGLISVDVRIPEQIIVVDSSMVENEVIKSLGKDGSLEDDEDEEDDLDEGVGGKRRSMEVKPAQASHTNYLLMRGYYSPGIVSTRNLNPNDSIVVNSCQMKFQLRCTPVPARLRPAAAPLEELTMGTSCLPDTFTKLINPQENTCSLEEFVLQLELSGYSPEDLTAALEILEAIIATGCFGIDKEELRRRFSALEKAGGGRTRTFADCIQALLEQHQVLEVGGNTARLVAMGSAWPWLLHSVRLKDREDADIQREDPQARPLEGSSSEDSPPEGQAPPSHSPRGTKRRASWASENGETDAEGTQMTPAKRPALQDSNLAPSLGPGAEDGAEAQAPSPPPALEDTAAAGAAQEDQEGVGEFSSPGQEQLSGQAQPPEGSEDPRGFTESFGAANISQAARERDCESVCFIGRPWRVVDGHLNLPVCKGMMEAMLYHIMTRPGIPESSLLRHYQGVLQPVAVLELLQGLESLGCIRKRWLRKPRPVSLFSTPVVEEVEVPSSLDESPMAFYEPTLDCTLRLGRVFPHEVNWNKWIHL

SEQ ID NO: 1895 - protein, 886 aa, unidentified
MSGFSPELIDYLEGKISFEEFERRREERKTREKKSLQEKGKLSAEENPDDSEVPSSSGINSTKSQDKDVNEGETSDGVRKSVHKVFASMLGENEDDEEEEEEEEEEEEEEETPEQPTAGDVFVLEMVLNRETKKMMKEKRPRSKLPRALRGLMGEANIRFARGEREEAILMCMEIIRQAPLAYEPFSTLAMIYEDQGDMEKSLQFELIAAHLNPSDTEEWVRLAEMSLEQDNIKQAIFCYTKALKYEPTNVRYLWERSSLYEQMGDHKMAMDGYRRILNLLSPSDGERFMQLARDMAKSYYEANDVTSAINIIDEAFSKHQGLVSMEDVNIAAELYISNKQYDKALEIITDFSGIVLEKKTSEEGTSEENKAPENVTCTIPDGVPIDITVKLMVCLVHLNILEPLNPLLTTLVEQNPEDMGDLYLDVAEAFLDVGEYNSALPLLSALVCSERYNLAVVWLRHAECLKALGYMERAAESYGKVVDLAPLHLDARISLSTLQQQLGQPEKALEALEPMYDPDTLAQDANAAQQELKLLLHRSTLLFSQGKMYGYVDTLLTMLAMLLKVAMNRAQVCLISSSKSGERHLYLIKVSRDKISDSNDQESANCDAKAIFAVLTSVLTKDDWWNLLLKAIYSLCDLSRFQEAELLVDSSLEYYSFYDDRQKRKELEYFGLSAAILDKNFRKAYNYIRIMVMENVNKPQLWNIFNQVTMHSQDVRHHRFCLRLMLKNPENHALCVLNGHNAFVSGSFKHALGQYVQAFRTHPDEPLYSFCIGLTFIHMASQKYVLRRHALIVQGFSFLNRYLSLRGPCQESFYNLGRGLHQLGLIHLAIHYYQKALELPPLVVEGIELDQLDLRRDIAYNLSLIYQSSGNTGMAQTLLYTYCSI

SEQ ID NO: 1896 - protein, 1073 aa, unidentified
MKTLLLDLALWSLLFQPGWLSFSSQVSQNCHNGSYEISVLMMGNSAFAEPLKNLEDAVNEGLEIVRGRLQNAGLNVTVNATFMYSDGLIHNSGDCRSSTCEGLDLLRKISNAQRMGCVLIGPSCTYSTFQMYLDTELSYPMISAGSFGLSCDYKETLTRLMSPARKLMYFLVNFWKTNDLPFKTYSWSTSYVYKNGTETEDCFWYLNALEASVSYFSHELGFKVVLRQDKEFQDILMDHNRKSNVIIMCGGPEFLYKLKGDRAVAEDIVIILVDLFNDQYFEDNVTAPDYMKNVLVLTLSPGNSLLNSSFSRNLSPTKRDFALAYLNGILLFGHMLKIFLENGENITTPKFAHAFRNLTFEGYDGPVTLDDWGDVDSTMVLLYTSVDTKKYKVLLTYDTHVNKTYPVDMSPTFTWKNSKLPNDITGRGPQILMIAVFTLTGAVVLLLLVALLMLRKYRKDYELRQKKWSHIPPENIFPLETNETNHVSLKIDDDKRRDTIQRLRQCKYDKKRVILKDLKHNDGNFTEKQKIELNKLLQIDYYNLTKFYGTVKLDTMIFGVIEYCERGSLREVLNDTISYPDGTFMDWEFKISVLYDIAKGMSYLHSSKTEVHGRLKSTNCVVDSRMVVKITDFGCNSILPPKKDLWTAPEHLRQANISQKGDVYSYGIIAQEIILRKETFYTLSCRDRNEKIFRVENSNGMKPFRPDLFLETAEEKELEVYLLVKNCWEEDPEKRPDFKKIETTLAKIFGLFHDQKNESYMDTLIRRLQLYSRNLEHLVEERTQLYKAERDRADRLNFMLLPRLVVKSLKEKGFVEPELYEEVTIYFSDIVGFTTICKYSTPMEVVDMLNDIYKSFDHIVDHHDVYKVETIGDAYMVASGLPKRNGNRHAIDIAKMALEILSFMGTFELEHLPGLPIWIRIGVHSGPCAAGVVGIKMPRYCLFGDTVNTASRMESTGLPLRIHVSGSTIAILKRTECQFLYEVRGETYLKGRGNETTYWLTGMKDQKFNLPTPPTVENQQRLQAEFSDMIANSLQKRQAAGIRSQKPRRVASYKKGTLEYLQLNTTDKESTYF

SEQ ID NO: 1897 - protein, 1103 aa, unidentified
MTACARRAGGLPDPGLCGPAWWAPSLPRLPRALPRLPLLLLLLLLQPPALSAVFTVGVLGPWACDPIFSRARPDLAARLAAARLNRDPGLAGGPRFEVALLPEPCRTPGSLGAVSSALARVSGLVGPVNPAACRPAELLAEEAGIALVPWGCPWTQAEGTTAPAVTPAADALYALLRAFGWARVALVTAPQDLWVEAGRSLSTALRARGLPVASVTSMEPLDLSGAREALRKVRDGPRVTAVIMVMHSVLLGGEEQRYLLEAAEELGLTDGSLVFLPFDTIHYALSPGPEALAALANSSQLRRAHDAVLTLTRHCPSEGSVLDSLRRAQERRELPSDLNLQQVSPLFGTIYDAVFLLARGVAEARAAAGGRWVSGAAVARHIRDAQVPGFCGDLGGDEEPPFVLLDTDAAGDRLFATYMLDPARGSFLSAGTRMHFPRGGSAPGPDPSCWFDPNNICGGGLEPGLVFLGFLLVVGMGLAGAFLAHYVRHRLLHMQMVSGPNKIILTVDDITFLHPHGGTSRKVAQGSRSSLGARSMSDIRSGPSQHLDSPNIGVYEGDRVWLKKFPGDQHIAIRPATKTAFSKLQELRHENVALYLGLFLARGAEGPAALWEGNLAVVSEHCTRGSLQDLLAQREIKLDWMFKSSLLLDLIKGIRYLHHRGVAHGRLKSRNCIVDGRFVLKITDHGHGRLLEAQKVLPEPPRAEDQLWTAPELLRDPALERRGTLAGDVFSLAIIMQEVVCRSAPYAMLELTPEEVVQRVRSPPPLCRPLVSMDQAPVECILLMKQCWAEQPELRPSMDHTFDLFKNINKGRKTNIIDSMLRMLEQYSSNLEDLIRERTEELELEKQKTDRLLTQMLPPSVAEALKTGTPVEPEYFEQVTLYFSDIVGFTTISAMSEPIEVVDLLNDLYTLFDAIIGSHDVYKVETIGDAYMVASGLPQRNGQRHAAEIANMSLDILSAVGTFRMRHMPEVPVRIRIGLHSGPCVAGVVGLTMPRYCLFGDTVNTASRMESTGLPYRIHVNLSTVGILRALDSGYQVELRGRTELKGKGAEDTFWLVGRRGFNKPIPKPPDLQPGSSNHGISLQEIPPERRRKLEKARPGQFS

SEQ ID NO: 1898 - protein, 1108 aa, unidentified
MFLGLGRFSRLVLWFAAFRKLLGHHGLASAKFLWCLCLLSVMSLPQQVWTLPYKIGVVGPWACDSLFSKALPEVAARLAIERINRDPSFDLSYSFEYVILNEDCQTSRALSSFISHHQMASGFIGPTNPGYCEAASLLGNSWDKGIFSWACVNYELDNKISYPTFSRTLPSPIRVLVTVMKYFQWAHAGVISSDEDIWVHTANRVASALRSHGLPVGVVLTTGQDSQSMRKALQRIHQADRIRIIIMCMHSALIGGETQMHLLECAHDLKMTDGTYVFVPYDALLYSLPYKHTPYRVLRNNPKLREAYDAVLTITVESQEKTFYQAFTEAAARGEIPEKLEFDQVSPLFGTIYNSIYFIAQAMNNAMKENGQAGAASLVQHSRNMQFHGFNQLMRTDSNGNGISEYVILDTNLKEWELHSTYTVDMEMELLRFGGTPIHFPGGRPPRADAKCWFAEGKICHGGIDPAFAMMVCLTLLIALLSINGFAYFIRRRINKIQLIKGPNRILLTLEDVTFINPHFGSKRGSRASVSFQITSEVQSGRSPRLSFSSGSLTPATYENSNIAIYEGDWVWLKKFSLGDFGDLKSIKSRASDVFEMMKDLRHENINPLLGFFYDSGMFAIVTEFCSRGSLEDILTNQDVKLDWMFKSSLLLDLIKGMKYLHHREFVHGRLKSRNCVVDGRFVLKVTDYGFNDILEMLRLSEEESSMEELLWTAPELLRAPRGSRLGSFAGDVYSFAIIMQEVMVRGTPFCMMDLPAQEIINRLKKPPPVYRPVVPPEHAPPECLQLMKQCWAEAAEQRPTFDEIFNQFKTFNKGKKTNIIDSMLRMLEQYSSNLEDLIRERTEELEIEKQKTEKLLTQMLPPSVAESLKKGCTVEPEGFDLVTLYFSDIVGFTTISAMSEPIEVVDLLNDLYTLFDAIIGSHDVYKVETIGDAYMVASGLPKRNGSRHAAEIANMSLDILSSVGTFKMRHMPEVPVRIRIGLHSGPVVAGVVGLTMPRYCLFGDTVNTASRMESTGLPYRIHVSLSTVTILQNLSEGYEVELRGRTELKGKGTEETFWLIGKKGFMKPLPVPPPVDKDGQVGHGLQPVEIAAFQRRKAERQLVRNKP

SEQ ID NO: 1899 - protein, 304 aa, unidentified
MNRAFSRKKDKTWMHTPEALSKHFIPYNAKFLGSTEVEQPKGTEVVRDAVRKLKFARHIKKSEGQKIPKVELQISIYGVKILEPKTKEVQHNCQLHRISFCADDKTDKRIFTFICKDSESNKHLCYVFDSEKCAEEITLTIGQAFDLAYRKFLESGGKDVETRKQIAGLQKRIQDLETENMELKNKVQDLENQLRITQVSAPPAGSMTPKSPSTDIFDMIPFSPISHQSSMPTRNGTQPPPVPSRSTEIKRDLFGAEPFDPFNCGAADFPPDIQSKLDEMQEGFKMGLTLEGTVFCLDPLDSRC

SEQ ID NO: 1900 - protein, 150 aa, unidentified [sequence omitted]

SEQ ID NO: 1901 - protein, 91 aa, unidentified
MYGKIIFVLLLSEIVSISALSTTEVAMHTSTSSSVTKSYISSQTNGETGQLVHRFTVPAPVVIILIILCVMAGIIGTILLISYSIRRLIKA

SEQ ID NO: 1902 - protein, 128 aa, unidentified
MWSTRSPNSTAWPLSLEPDPGMASASTTMHTTTIAEPDPGMSGWPDGRMETSTPTIMDIVVIAGVIAAVAIVLVSLLFVMLRYMYRHKGTYHTNEAKGTEFAESADAALQGDPALQDAGDSSRKEYFI

SEQ ID NO: 1903 - protein, 78 aa, unidentified
MYGKIIFVLLLSGIVSISASSTTGVAMHTSTSSSVTKSYISSQTNGITLINWWAMARVIFEVMLVVVGMIILISYCIR

SEQ ID NO: 1904 - protein, 288 aa, unidentified
MGRLTEAAAAGSGSRAAGWAGSPPTLLPLSPTSPRCAATMASSDEDGTNGGASEAGEDREAPGERRRLGVLATAWLTFYDIAMTAGWLVLAIAMVRFYMEKGTHRGLYKSIQKTLKFFQTFALLEIVHCLIGIVPTSVIVTGVQVSSRIFMVWLITHSIKPIQNEESVVLFLVAWTVTEITRYSFYTFSLLDHLPYFIKWARYNFFIILYPVGVAGELLTIYAALPHVKKTGMFSIRLPNKYNVSFDYYYFLLITMASYIPLFPQLYFHMLRQRRKVLHGEVIVEKDD

SEQ ID NO: 1905 - protein, 254 aa, unidentified
MAAVAATAAAKGNGGGGGRAGAGDASGTRKKKGPGPLATAYLVIYNVVMTAGWLVIAVGLVRAYLAKGSYHSLYYSIEKPLKFFQTGALLEILHCAIGIVPSSVVLTSFQVMSRVFLIWAVTHSVKEVQSEDSVLLFVIAWTITEIIRYSFYTFSLLNHLPYLIKWARYTLFIVLYPMGVSGELLTIYAALPFVRQAGLYSISLPNKYNFSFDYYAFLILIMISYIPIFPQLYFHMIHQRRKILSHTEEHKKFE

SEQ ID NO: 1906 - protein, 362 aa, unidentified
MENQVLTPHVYWAQRHRELYLRVELSDVQNPAISITENVLHFKAQGHGAKGDNVYEFHLEFLDLVKPEPVYKLTQRQVNITVQKKVSQWWERLTKQEKRPLFLAPDFDRWLDESDAEMELRAKEEERLNKLRLESEGSPETLTNLRKGYLFMYNLVQFLGFSWIFVNLTVRFCILGKESFYDTFHTVADMMYFCQMLAVVETINAAIGVTTSPVLPSLIQLLGRNFILFIIFGTMEEMQNKAVVFFVFYLWSAIEIFRYSFYMLTCIDMDWKVLTWLRYTLWIPLYPLGCLAEAVSVIQSIPIFNETGRFSFTLPYPVKIKVRFSFFLQIYLIMIFLGLYINFRHLYKQRRRRYGQKKKKIH

SEQ ID NO: 1907 - protein, 232 aa, unidentified
MGPLALPAWLQPRYRKNAYLFIYYLIQFCGHSWIFTNMTVRFFSFGKDSMVDTFYAIGLVMRLCQSVSLLELLHIYVGIESNHLLPRFLQLTERIIILFVVITSQEEVQEKYVVCVLFVFWNLLDMVRYTYSMLSVIGISYAVLTWLSQTLWMPIYPLCVLAEAFAIYQSLPYFESFGTYSTKLPFDLSIYFPYVLKIYLMMLFIGMYFTYSHLYSERRDILGIFPIKKKKM

SEQ ID NO: 1908 - protein, 360 aa, unidentified
MGLLLLVPLLLLPGSYGLPFYNGFYYSNSANDQNLGNGHGKDLLNGVKLVVETPEETLFTYQGASVILPCRYRYEPALVSPRRVRVKWWKLSENGAPEKDVLVAIGLRHRSFGDYQGRVHLRQDKEHDVSLEIQDLRLEDYGRYRCEVIDGLEDESGLVELELRGVVFPYQSPNGRYQFNFHEGQQVCAEQAAVVASFEQLFRAWEEGLDWCNAGWLQDATVQYPIMLPRQPCGGPGLAPGVRSYGPRHRRLHRYDVFCFATALKGRVYYLEHPEKLTLTEAREACQEDDATIAKVGQLFAAWKFHGLDRCDAGWLADGSVRYPVVHPHPNCGPPEPGVRSFGFPDPQSRLYGVYCYRQH

SEQ ID NO: 1909 - protein, 578 aa, unidentified
MRQQDAPKPTPAACRCSGLARRVLTIAFALLILGLMTWAYAAGVPLASDRYGLLAFGLYGAFLSAHLVAQSLFAYLEHRRVAAAARGPLDAATARSVALTISAYQEDPAYLRQCLASARALLYPRARLRVLMVVDGNRAEDLYMVDMFREVFADEDPATYVWDGNYHQPWEPAAAGAVGAGAYREVEAEDPGRLAVEALVRTRRCVCVAQRWGGKREVMYTAFKALGDSVDYVQVCDSDTRLDPMALLELVRVLDEDPRVGAVGGDVRILNPLDSWVSFLSSLRYWVAFNVERACQSYFHCVSCISGPLGLYRNNLLQQFLEAWYNQKFLGTHCTFGDDRHLTNRMLSMGYATKYTSRSRCYSETPSSFLRWLSQQTRWSKSYFREWLYNALWWHRHHAWMTYEAVVSGLFPFFVAATVLRLFYAGRPWALLWVLLCVQGVALAKAAFAAWLRGCLRMVLLSLYAPLYMCGLLPAKFLALVTMNQSGWGTSGRRKLAANYVPLLPLALWALLLLGGLVRSVAHEARADWSGPSRAAEAYHLAAGAGAYVGYWVAMLTLYWVGVRRLCRRRTGGYRVQV

SEQ ID NO: 1910 - protein, 552 aa, unidentified
MHCERFLCILRIIGTTLFGVSLLLGITAAYIVGYQFIQTDNYYFSFGLYGAFLASHLIIQSLFAFLEHRKMKKSLETPIKLNKTVALCIAAYQEDPDYLRKCLQSVKRLTYPGIKVVMVIDGNSEDDLYMMDIFSEVMGRDKSATYIWKNNFHEKGPGETDESHKESSQHVTQLVLSNKSICIMQKWGGKREVMYTAFRALGRSVDYVQVCDSDTMLDPASSVEMVKVLEEDPMVGGVGGDVQILNKYDSWISFLSSVRYWMAFNIERACQSYFGCVQCISGPLGMYRNSLLHEFVEDWYNQEFMGNQCSFGDDRHLTNRVLSLGYATKYTARSKCLTETPIEYLRWLNQQTRWSKSYFREWLYNAMWFHKHHLWMTYEAIITGFFPFFLIATVIQLFYRGKIWNILLFLLTVQLVGLIKSSFASCLRGNIVMVFMSLYSVLYMSSLLPAKMFAIATINKAGWGTSGRKTIVVNFIGLIPVSVWFTILLGGVIFTIYKESKRPFSESKQTVLIVGTLLYACYWVMLLTLYVVLINKCGRRKKGQQYDMVLDV

SEQ ID NO: 1911 - protein, 553 aa, unidentified
MPVQLTTALRVVGTSLFALAVLGGILAAYVTGYQFIHTEKHYLSFGLYGAILGLHLLIQSLFAFLEHRRMRRAGQALKLPSPRRGSVALCIAAYQEDPDYLRKCLRSAQRISFPDLKVVMVVDGNRQEDAYMLDIFHEVLGGTEQAGFFVWRSNFHEAGEGETEASLQEGMDRVRDVVRASTFSCIMQKWGGKREVMYTAFKALGDSVDYIQVCDSDTVLDPACTIEMLRVLEEDPQVGGVGGDVQILNKYDSWISFLSSVRYWMAFNVERACQSYFGCVQCISGPLGMYRNSLLQQFLEDWYHQKFLGSKCSFGDDRHLTNRVLSLGYRTKYTARSKCLTETPTKYLRWLNQQTRWSKSYFREWLYNSLWFHKHHLWMTYESVVTGFFPFFLIATVIQLFYRGRIWNILLFLLTVQLVGIIKATYACFLRGNAEMIFMSLYSLLYMSSLLPAKIFAIATINKSGWGTSGRKTIVVNFIGLIPVSIWVAVLLGGLAYTAYCQDLFSETELAFLVSGAILYGCYWVALLMLYLAIIARRCGKKPEQYSLAFAEV

SEQ ID NO: 1912 - protein, 364 aa, unidentified
MHPQVVILSLILHLADSVAGSVKVGGEAGPSVTLPCHYSGAVTSMCWNRGSCSLFTCQNGIVWTNGTHVTYRKDTRYKLLGDLSRRDVSLTIENTAVSDSGVYCCRVEHRGWFNDMKITVSLEIVPPKVTTTPIVTTVPTVTTVRTSTTVPTTTTVPMTTVPTTTVPTTMSIPTTTTVLTTMTVSTTTSVPTTTSIPTTTSVPVTTTVSTFVPPMPLPRQNHEPVATSPSSPQPAETHPTTLQGAIRREPTSSPLYSYTTDGNDTVTESSDGLWNNNQTQLFLEHSLLTANTTKGIYAGVCISVLVLLALLGVIIAKKYFFKKEVQQLSVSFSSLQIKALQNAVEKEVQAEDNIYIENSLYATD

SEQ ID NO: 1913 - protein, 301 aa, unidentified
MFSHLPFDCVLLLLLLLLTRSSEVEYRAEVGQNAYLPCFYTPAAPGNLVPVCWGKGACPVFECGNVVLRTDERDVNYWTSRYWLNGDFRKGDVSLTIENVTLADSGIYCCRIQIPGIMNDEKFNLKLVIKPAKVTPAPTRQRDFTAAFPRMLTTRGHGPAETQTLGSLPDINLTQISTLANELRDSRLANDLRDSGATIRIGIYIGAGICAGLALALIFGALIFKWYSHSKEKIQNLSLISLANLPPSGLANAVAEGIRSEENIYTIEENVYEVEEPNEYYCYVSSRQQPSQPLGCRFAMP

SEQ ID NO: 1914 - protein, 147 aa, unidentified
MVHLTPEEKTAVNALWGKVNVDAVGGEALGRLLVVYPWTQRFFESFGDLSSPDAVMGNPKVKAHGKKVLGAFSDGLAHLDNLKGTFSQLSELHCDKLHVDPENFRLLGNVLVCVLARNFGKEFTPQMQAAYQKVVAGVANALAHKYH

SEQ ID NO: 1915 - protein, 208 aa, unidentified
MKLLPSVVLKLFLAAVLSALVTGESLERLRRGLAAGTSNPDPPTVSTDQLLPLGGGRDRKVRDLQEADLDLLRVTLSSKPQALATPNKEEHGKRKKKGKGLGKKRDPCLRKYKDFCIHGECKYVKELRAPSCICHPGYHGERCHGLSLPVENRLYTYDHTTILAVVAVVLSSVCLLVIVGLLMFRYHRRGGYDVENEEKVKLGMTNSH

SEQ ID NO: 1916 - protein, 684 aa, unidentified
MARHRNVRGYNYDEDFEDDDLYGQSVEDDYCISPSTAAQFIYSRRDKPSVEPVEEYDYEDLKESSNSVSNHQLSGFDQARLYSCLDHMREVLGDAVPDEILIEAVLKNKFDVQKALSGVLEQDRVQSLKDKNEATVSTGKIAKGKPVDSQTSRSESEIVPKVAKMTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPVLLHYQTVSEPAVIKRLISVLNKSTGEVTKKKPKFLTKGQNALVELQTQRPIALELYKDFKELGRFMLRYGGSTIAAGVVTEIKE

SEQ ID NO: 1917 - protein, 346 aa, unidentified
MYNGSCCRIEGDTISQVMPPLLIVAFVLGALGNGVALCGFCFHMKTWKPSTVYLFNLAVADFLLMICLPFRTDYYLRRRHWAFGDIPCRVGLFTLAMNRAGSIVFLTVVAADRYFKVVHPHHAVNTISTRVAAGIVCTLWALVILGTVYLLLENHLCVQETAVSCESFIMESANGWHDIMFQLEFFMPLGIILFCSFKIVWSLRRRQQLARQARMKKATRFIMVVAIVFITCYLPSVSARLYFLWTVPSSACDPSVHGALHITLSFTYMNSMLDPLVYYFSSPSFPKFYNKLKICSLKPKQPGHSKTQRPEEMPISNLGRRSCISVANSFQSQSDGQWDPHIVEWH

SEQ ID NO: 1918 - protein, 363 aa, unidentified [sequence omitted]

SEQ ID NO: 1919 - protein, 387 aa, unidentified
MNRHHLQDHFLEIDKKNCCVFRDDFIAKVLPPVLGLEFIFGLLGNGLALWIFCFHLKSWKSSRIFLFNLAVADFLLIICLPFVMDYYVRRSDWKFGDIPCRLVLFMFAMNRQGSIIFLTVVAVDRYFRVVHPHHALNKISNWTAAIISCLLWGITVGLTVHLLKKKLLIQNGTANVCISFSICHTFRWHEAMFLLEFFLPLGIILFCSARIIWSLRQRQMDRHAKIKRAITFIMVVAIVFVICFLPSVVVRIHIFWLLHTSGTQNCEVYRSVDLAFFITLSFTYMNSMLDPVVYYFSSPSFPNFFSTLINRCLQRKITGEPDNNRSTSVELTGDPNKTRGAPEALIANSGEPWSPSYLGPTSNNHSKKGHCHQEPASLEKQLGCCIE

SEQ ID NO: 1920 - protein, 890 aa, unidentified
MEGGGKPNSSSNSRDDGNSVFPAKASATGAGPAAAEKRLGTPPGGGGAGAKEHGNSVCFKVDGGGGGGGGGGGGEEPAGGFEDAEGPRRQYGFMQRQFTSMLQPGVNKFSLRMFGSQKAVEKEQERVKTAGFWIIHPYSDFRFYWDLIMLIMMVGNLVIIPVGITFFTEQTTTPWIIFNVASDTVFLLDLIMNFRTGTVNEDSSEIILDPKVIKMNYLKSWFVVDFISSIPVDYIFLIVEKGMDSEVYKTARALRIVRFTKILSLLRLLRLSRLIRYIHQWEEIFHMTYDLASAVVRIFNLIGMMLLLCHWDGCLQFLVPLLQDFPPDCWVSLNEMVNDSWGKQYSYALFKAMSHMLCIGYGAQAPVSMSDLWITMLSMIVGATCYAMFVGHATALIQSLDSSRRQYQEKYKQVEQYMSFHKLPADMRQKIHDYYEHRYQGKIFDEENILNELNDPLREEIVNFNCRKLVATMPLFANADPNFVTAMLSKLRFEVFQPGDYIIREGAVGKKMYFIQHGVAGVITKSSKEMKLTDGSYFGEICLLTKGRRTASVRADTYCRLYSLSVDNFNEVLEEYPMMRRAFETVAIDRLDRIGKKNSILLQKFQKDLNTGVFNNQENEILKQIVKHDREMVQAIAPINYPQMTTLNSTSSTTTPTSRMRTQSPPVYTATSLSHSNLHSPSPSTQTPQPSAILSPCSYTTAVCSPPVQSPLAARTFHYASPTASQLSLMQQQPQQQVQQSQPPQTQPQQPSPQPQTPGSSTPKNEVHKSTQALHNTNLTREVRPLSASQPSLPHEVSTLISRPHPTVGESLASIPQPVTAVPGTGLQAGGRSTVPQRVTLFRQMSSGAIPPNRGVPPAPPPPAAALPRESSSVLNTDPDAEKPRFASNL

SEQ ID NO: 1921 - protein, 889 aa, unidentified
MDARGGGGRPGESPGATPAPGPPPPPPPAPPQQQPPPPPPPAPPPGPGPAPPQHPPRAEALPPEAADEGGPRGRLRSRDSSCGRPGTPGAASTAKGSPNGECGRGEPQCSPAGPEGPARGPKVSFSCRGAASGPAPGPGPAEEAGSEEAGPAGEPRGSQASFMQRQFGALLQPGVNKFSLRMFGSQKAVEREQERVKSAGAWIIHPYSDFRFYWDFTMLLFMVGNLIIIPVGITFFKDETTAPWIVFNVVSDTFFLMDLVLNFRTGIVIEDNTEIILDPEKIKKKYLRTWFVVDFVSSIPVDYIFLIVEKGIDSEVYKTARALRIVRFTKILSLLRLLRLSRLIRYIHQWEEIFHMTYDLASAVMRICNLISMMLLLCHWDGCLQFLVPMLQDFPRNCWVSINGMVNHSWSELYSFALFKAMSHMLCIGYGRQAPESMTDIWLTMLSMIVGATCYAMFIGHATALIQSLDSSRRQYQEKYKQVEQYMSFHKLPADFRQKIHDYYEHRYQGKMFDEDSILGELNGPLREEIVNFNCRKLVASMPLFANADPNFVTAMLTKLKFEVFQPGDYIIREGTIGKKMYFIQHGVVSVLTKGNKEMKLSDGSYFGEICLLTRGRRTASVRADTYCRLYSLSVDNFNEVLEEYPMMRRAFETVAIDRLDRIGKKNSILLHKVQHDLNSGVFNNQENAIIQEIVKYDREMVQQAELGQRVGLFPPPPPPPQVTSAIATLQQAAAMSFCPQVARPLVGPLALGSPRLVRRPPPGPAPAAASPGPPPPASPPGAPASPRAPRTSPYGGLPAAPLAGPALPARRLSRASRPLSASQPSLPHGAPGPAASTRPASSSTPRLGPTPAARAAAPSPDRRDSASPGAAGGLDPQDSARSRLSSNL

SEQ ID NO: 1922 - protein, 774 aa, unidentified
MEAEQRPAAGASEGATPGLEAVPPVAPPPATAASGPIPKSGPEPKRRHLGTLLQPTVNKFSLRVFGSHKAVEIEQERVKSAGAWIIHPYSDFRFYWDLIMLLLMVGNLIVLPVGITFFKEENSPPWIVFNVLSDTFFLLDLVLNFRTGIVVEEGAEILLAPRAIRTRYLRTWFLVDLISSIPVDYIFLVVELEPRLDAEVYKTARALRIVRFTKILSLLRLLRLSRLIRYIHQWEEIFHMTYDLASAVVRIFNLIGMMLLLCHWDGCLQFLVPMLQDFPPDCWVSINHMVNHSWGRQYSHALFKAMSHMLCIGYGQQAPVGMPDVWLTMLSMIVGATCYAMFIGHATALIQSLDSSRRQYQEKYKQVEQYMSFHKLPADTRQRIHEYYEHRYQGKMFDEESILGELSEPLREEIINFTCRGLVAHMPLFAHADPSFVTAVLTKLRFEVFQPGDLVVREGSVGRKMYFIQHGLLSVLARGARDTRLTDGSYFGEICLLTRGRRTASVRADTYCRLYSLSVDHFNAVLEEFPMMRRAFETVAMDRLLRIGKKNSILQRKRSEPSPGSSGGIMEQHLVQHDRDMARGVRGRAPSTGAQLSGKPVLWEPLVHAPLQAAAVTSNVAIALTHQRGPLPLSPDSPATLLARSAWRSAGSPASPLVPVRAGPWASTSRLPAPPARTLHASLSRAGRSQVSLLGPPPGGGGRRLGPRGRPLSASQPSLPQRATGDGSPGRKGSGSERLPPSGLLAKPPRTAQPPRPPVPEPATPRGLQLSANM

SEQ ID NO: 1923 - protein, 1203 aa, unidentified
MDKLPPSMRKRLYSLPQQVGAKAWIMDEEEDAEEEGAGGRQDPSRRSIRLRPLPSPSPSAAAGGTESRSSALGAADSEGPARGAGKSSTNGDCRRFRGSLASLGSRGGGSGGTGSGSSHGHLHDSAEERRLIAEGDASPGEDRTPPGLAAEPERPGASAQPAASPPPPQQPPQPASASCEQPSVDTAIKVEGGAAAGDQILPEAEVRLGQAGFMQRQFGAMLQPGVNKFSLRMFGSQKAVEREQERVKSAGFWIIHPYSDFRFYWDLTMLLLMVGNLIIIPVGITFFKDENTTPWIVFNVVSDTFFLIDLVLNFRTGIVVEDNTEIILDPQRIKMKYLKSWFMVDFISSIPVDYIFLIVETRIDSEVYKTARALRIVRFTKILSLLRLLRLSRLIRYIHQWEEIFHMTYDLASAVVRIVNLIGMMLLLCHWDGCLQFLVPMLQDFPDDCWVSINNMVNNSWGKQYSYALFKAMSHMLCIGYGRQAPVGMSDVWLTMLSMIVGATCYAMFIGHATALIQSLDSSRRQYQEKYKQVEQYMSFHKLPPDTRQRIHDYYEHRYQGKMFDEESILGELSEPLREEIINFNCRKLVASMPLFANADPNFVTSMLTKLRFEVFQPGDYIIREGTIGKKMYFIQHGVVSVLTKGNKETKLADGSYFGEICLLTRGRRTASVRADTYCRLYSLSVDNFNEVLEEYPMMRRAFETVALDRLDRIGKKNSILLHKVQHDLNSGVFNYQENEIIQQIVQHDREMAHCAHRVQAAASATPTPTPVIWTPLIQAPLQAAAATTSVAIALTHHPRLPAAIFRPPPGSGLGNLGAGQTPRHLKRLQSLIPSALGSASPASSPSQVDTPSSSSFHIQQLAGFSAPAGLSPLLPSSSSSPPPGACGSPSAPTPSAGVAATTIAGFGHFHKALGGSLSSSDSPLLTPLQPGARSPQAAQPSPAPPGARGGLGLPEHFLPPPPSSRSPSSSPGQLGQPPGELSLGLATGPLSTPETPPRQPEPPSLVAGASGGASPVGFTPRGGLSPPGHSPGPPRTFPSAPPRASGSHGSLLLPPASSPPPPQVPQRRGTPPLTPGRLTQDLKLISASQPALPQDGAQTLRRASPHSSGESMAAFPLFPRAGGGSGGSGSSGGLGPPGRPYGAIPGQHVTLPRKTSSGSLPPPLSLFGARATSSGGPPLTAGPQREPGARPEPVRSKLPSNL

SEQ ID NO: 1924 - protein, 425 aa, unidentified
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALVRNWKRPSDQLGDLEQGLSGEPQPRARAFLAEVKQMRARRKTAKMLMVVLLVFALCYLPISVLNVLKRVFGMFRQASDREAVYACFTFSHWLVYANSAANPIIYNFLSGKFREQFKAAFSCCLPGLGPCGSLKAPSPRSSASHKSLSLQSRCSISKISEHVVLTSVTTVLP

SEQ ID NO: 1925 - protein, 444 aa, unidentified
MSGTKLEDSPPCRNWSSASELNETQEPFLNPTDYDDEEFLRYLWREYLHPKEYEWVLIAGYIIVFVVALIGNVLVCVAVWKNHHMRTVTNYFIVNLSLADVLVTITCLPATLVVDITETWFFGQSLCKVIPYLQTVSVSVSVLTLSCIALDRWYAICHPLMFKSTAKRARNSIVIIWIVSCIIMIPQAIVMECSTVFPGLANKTTLFTVCDERWGGEIYPKMYHICFFLVTYMAPLCLMVLAYLQIFRKLWCRQIPGTSSVVQRKWKPLQPVSQPRGPGQPTKSRMSAVAAEIKQIRARRKTARMLMIVLLVFAICYLPISILNVLKRVFGMFAHTEDRETVYAWFTFSHWLVYANSAANPIIYNFLSGKFREEFKAAFSCCCLGVHHRQEDRLTRGRTSTESRKSLTTQISNFDNISKLSEQVVLTSISTLPAANGAGPLQNW

SEQ ID NO: 1926 - protein, 93 aa, unidentified
MIHLGHILFLLLLPVAAAQTTPGERSSLPAFYPGTSGSCSGCGSLSLPLLAGLVAADAVASLLIVGAVFLCARPRRSPAQEDGKVYINMPGRG

SEQ ID NO: 1927 - protein, 669 aa, unidentified
MGTALVYHEDMTATRLLWDDPECEIERPERLTAALDRLRQRGLEQRCLRLSAREASEEELGLVHSPEYVSLVRETQVLGKEELQALSGQFDAIYFHPSTFHCARLAAGAGLQLVDAVLTGAVQNGLALVRPPGHHGQRAAANGFCVFNNVAIAAAHAKQKHGLHRILVVDWDVHHGQGIQYLFEDDPSVLYFSWHRYEHGRFWPFLRESDADAVGRGQGLGFTVNLPWNQVGMGNADYVAAFLHLLLPLAFEFDPELVLVSAGFDSAIGDPEGQMQATPECFAHLTQLLQVLAGGRVCAVLEGGYHLESLAESVCMTVQTLLGDPAPPLSGPMAPCQSALESIQSARAAQAPHWKSLQQQDVTAVPMSPSSHSPEGRPPPLLPGGPVCKAAASAPSSLLDQPCLCPAPSVRTAVALTTPDITLVLPPDVIQQEASALREETEAWARPHESLAREEALTALGKLLYLLDGMLDGQVNSGIAATPASAAAATLDVAVRRGLSHGAQRLLCVALGQLDRPPDLAHDGRSLWLNIRGKEAAALSMFHVSTPLPVMTGGFLSCILGLVLPLAYGFQPDLVLVALGPGHGLQGPHAALLAAMLRGLAGGRVLALLEENSTPQLAGILARVLNGEAPPSLGPSSVASPEDVQALMYLRGQLEPQWKMLQCHPHLVA

SEQ ID NO: 1928 - protein, 2040 aa, unidentified
MELAHSLLLNEEAYNQLGEVQKAEFIFEWLRYLEKLLLATSRNDVREKQKTLVEQLLSLLNSSPGPPTRKLLAKNLAILYSIGDTFSVHEAIDKCNDLIRSKDDSPSYLPTKLAAVVCLGSLYKKLGRILGNTFTDTVGNILKAMKSAESQGRYEIMLSLQNILNGLGAAAAPCHRDVYKAARSCLTDRSMAVRCAAAKNEAIFMWSTDLDSVATLCFKSFEGSNYDVRISVSKLLGIILAKAVISKHPGTAASRQSIRRVSLEEVLELLGTGFLRGSSGFLRASGDMLKGTSSVSRDVRVGVTQAYVVFVSTLGGAWLEKNFAAFFSHILSLASPSHPKATQTQIDAVCCRRCVSFILRTTIGGLLGEKAQLAAVKDICQAIWKLKKVMDAVMSDGNLETRLGSTDVAASQHMLVCALQELGNLIHNLGTTAAPLLQDSSTGLLDSILSVILHPSISVRLAAAWCLHCIAVALPSYLTPLLDRCLERLTGHKSSPEAVTGFSFAVAALLGAVKHCPLGIPHGKGKIIMTLAEDLLCSAAQNSRLSAQRTQAGWLLISALMTLGPAVVSHHLARVLLLWKCVFPASPKDLETEKSRGDSFTWQVTLEGRAGALCAIKSFVSHCGDLLTEEVTQRLLPPLPCAVDLLTQLSSILKMYGSPLKTPSVVYRQRLYELLILLPPETYEGNLCAILRELAADLTAPDIQVAASTFLLPPLCHQDDLLILSPFLQETDHRFIEEQLLLGNGVACGSLEYDPYSIYEKDVEGDSVPKPLPPALSVISSASKLFGVVCAHVGETQRLLILEQLLDSIKHTKGARQQVVQLHVVSSVSSFLKYVAGSKGCLGPEEMKRFALTLVMGALESPNPLLRCAAAESWARLAQVVDDGAFTAGLAQVSFDKLKSARDVVTRTGHSLALGSLHRYLGGISSSQHLNSCIGILYTLAQDSTSPDVQTWALHSLSLIIDSAGPLYYVHVEPTLSLIIMLLLNVPPTHAEVHQSLGRCLNALITTLGPELQGNSTSISTLRTSCLLGCAVMQDNPDCLVQAQAISCLQQLHMFAPRHVNLSSLVSCLCVNLCSPYLLLRRAVLACLRQLVQREAAEVSEHAVMLAKDSREELTPDANIREVGLEGALLILLDKETDERLCHDIKETLNYMLTSMAVEKLSLWLKLCKDVLAASADFTAVTCVDTMQEEEGDKGDDASVLTTRRDEKSHPFTNPRWATRVFAAECVCRIINQCENANSAHFDIALAQEMKKRDSRNDFLVLHLADLIRMAFMAATDHSDQLRLSGLEMLLVVIRRFATVPEPEFPGHVILEQYQANVGAALRPAFTSETPPDVTAKACQVCSAWIASGVVSDLNDLRRVHQLLVSSLTKIQAGKEALSHLYNESASTMEILAVLKAWAEVYIIAVQRHKNHRQPLKTTTCLEDGIRNGSCSSDGLLDLVYADLGTLSRLWLAALQDFALLTLPSEFASQLPAEGGAFYTAETSENAKLHYYNSWALILHATALWLTSTGFVVADPDEGASNLSRPVTPTSMCQGSSSGATIKSPEDVYTDRFHLILGISVEFLCSLRSDATMESITACLHALQALLDVPWPRSKIGSDQDLGIELLNVLHRVILTRESPSIQLASLEVVRQIICAAQEHVKEKRRSAEVDDGAAEKETLPEFGEGKDTGGLVPGKSLVFATLELCVCILVRQLPELNPKLTGSPGVKATKPQILLEDGSRLVSAALVILSELPAVCSPEGSISILPTILYLTIGVLRETAVKLPGGQLSSTVAASLQALKGILSSPMARAEKSRTAWTDLLRSALTTILDCWDPVDETHQELDEVSLLTAITVFILSTSPEVTTIPCLQKRCIDKFKATLEIKDPVVQIKTYQLLHSIFQYPNPAVSYPYIYSLASCIMEKLQEIDKRKPENTAELEIFQEGIKVLETLVTVAEEHHRAQLVACLLPILISFLLDENSLGSATSIMRNLHDFALQNLMQIGPQYSSVFKSLVASSPALKARLEAAIKGNQESVKVKIPTSKYTKSPGKNSSIQLKTSFL

SEQ ID NO: 1929 - protein, 1381 aa, unidentified
MASPRASRWPPPLLLLLLPLLLLPPAAPGTRDPPPSPARRALSLAPLAGAGLELQLERRPEREPPPTPPRERRGPATPGPSYRAPEPGAATQRGPSGRAPRGGSADAAWKHWPESNTEAHVENITFYQNQEDFSTVSSKEGVMVQTSGKSHAASDAPENLTLLAETADARGRSGSSSRTNFTILPVGYSLEIATALTSQSGNLASESLHLPSSSSEFDERIAAFQTKSGTASEMGTERAMGLSEEWTVHSQEATTSAWSPSFLPALEMGELTTPSRKRNSSGPDLSWLHFYRTAASSPLLDLSSSSESTEKLNNSTGLQSSSVSQTKTMHVATVFTDGGPRTLRSLTVSLGPVSKTEGFPKDSRIATTSSSVLLSPSAVESRRNSRVTGNPGDEEFIEPSTENEFGLTSLRWQNDSPTFGEHQLASSSEVQNGSPMSQTETVSRSVAPMRGGEITAHWLLTNSTTSADVTGSSASYPEGVNASVLTQFSDSTVQSGGSHTALGDRSYSESSSTSSSESLNSSAPRGERSIAGISYGQVRGTAIEQRTSSDHTDHTYLSSTFTKGERALLSITDNSSSSDIVESSTSYIKISNSSHSEYSSFFHAQTERSNISSYDGEYAQPSTESPVLHTSNLPSYTPTINMPNTSVVLDTDAEFVSDSSSSSSSSSSSSSSGPPLPLPSVSQSHHLFSSILPSTRASVHLLKSTSDASTPWSSSPSPLPVSLTTSTSAPLSVSQTTLPQSSSTPVLPRARETPVTSFQTSTMTSFMTMLHSSQTADLKSQSTPHQEKVITESKSPSLVSLPTESTKAVTTNSPLPPSLTESSTEQTLPATSTNLAQMSPTFTTTILKTSQPLMTTPGTLSSTASLVTGPIAVQTTAGKQLSLTHPEILVPQISTEGGISTERNRVIVDATTGLIPLTSVPTSAKEMTTKLGVTAEYSPASRSLGTSPSPQTTVVSTAEDLAPKSATFAVQSSTQSPTTVSSSASVNSCAVNPCLHNGECVADNTSRGYHCRCPPSWQGDDCSVDVNECLSNPCPSTAMCNNTQGSFICKCPVGYQLEKGICNLVRTFVTEFKLKRTFLNTTVEKHSDLQEVENEITKTLNMCFSALPSYIRSTVHASRESNAVVISLQTTFSLASNVTLFDLADRMQKCVNSCKSSAEVCQLLGSQRRIFRAGSLCKRKSPECDKDTSICTDLDGVALCQCKSGYFQFNKMDHSCRACEDGYRLENETCMSCPFGLGGLNCGNPYQLITVVIAAAGGGLLLILGIALIVTCCRKNKNDISKLIFKSGDFQMSPYAEYPKNPRSQEWGREAIEMHENGSTKNLLQMTDVYYSPTSVRNPELERNGLYPAYTGLPGSRHSCIFPGQYNPSFISDESRRRDYF

SEQ ID NO: 1930 - protein, 1943 aa, unidentified
MEDRRAEKSCEQACESLKRQDYEMALKHCTEALLSLGQYSMADFTGPCPLEIERIKIESLLYRIASFLQLKNYVQADEDCRHVLGEGLAKGEDAFRAVLCCMQLKGKLQPVSTILAKSLTGESLNGMVTKDLTRLKTLLSETETATSNALSGYHVEDLDEGSCNGWHFRPPPRGITSSEEYTLCKRFLEQGICRYGAQCTSAHSQEELAEWQKRYASRLIKLKQQNENKQLSGSYMETLIEKWMNSLSPEKVLSECIEGVKVEHNPDLSVTVSTKKSHQTWTFALTCKPARMLYRVALLYDAHRPHFSIIAISAGDSTTQVSQEVPENCQEWIGGKMAQNGLDHYVYKVGIAFNTEIFGTFRQTIVFDFGLEPVLMQRVMIDAASTEDLEYLMHAKQQLVTTAKRWDSSSKTIIDFEPNETTDLEKSLLIRYQIPLSADQLFTQSVLDKSLTKSNYQSRLHDLLYIEEIAQYKEISKFNLKVQLQILASFMLTGVSGGAKYAQNGQLFGRFKLTETLSEDTLAGRLVMTKVNAVYLLPVPKQKLVQTQGTKEKVYEATIEEKTKEYIFLRLSRECCEELNLRPDCDTQVELQFQLNRLPLCEMHYALDRIKDNGVLFPDISMTPTIPWSPNRQWDEQLDPRLNAKQKEAVLAITTPLAIQLPPVLIIGPYGTGKTFTLAQAVKHILQQQETSRILICTHSNSAADLYIKDYLHPYVEAGNPQARPLRVYFRNRWVKTVHPVVHQYCLISSAHSTFQMPQKEDILKHRVVVVTLNTSQYLCQLDLEPGFFTHILLDEAAQAMECETIMPLALATQNTRIVLAGDHMQLSPFVYSEFARERNLHVSLLDRLYEHYPAEFPCRILLCENYRSHEAIINYTSELFYEGKLMASGKQPAHKDFYPLTFFTARGEDVQEKNSTAFYNNAEVFEVVERVEELRRKWPVAWGKLDDGSIGVVTPYADQVFRIRAELRKKRLSDVNVERVLNVQGKQFRVLFLSTVRTRHTCKHKQTPIKKKEQLLEDSTEDLDYGFLSNYKLLNTAITRAQSLVAVVGDPIALCSIGRCRKFWERFIALCHENSSLHGITFEQIKAQLEALELKKTYVLNPLAPEFIPRALRLQHSGSTNKQQQSPPKGKSLHHTQNDHFQNDGIVQPNPSVLIGNPIRAYTPPPPLGPHPNLGKSPSPVQRIDPHTGTSILYVPAVYGGNVVMSVPLPVPWTGYQGRFAVDPRIITHQAAMAYNMNLLQTHGRGSPIPYGLGHHPPVTIGQPQNQHQEKDQHEQNRNGKSDTNNSGPEINKIRTPEKKPTEPKQVDLESNPQNRSPESRPSVVYPSTKFPRKDNLNPRHINLPLPAPHAQYAIPNRHFHPLPQLPRPPFPIPQQHTLLNQQQNNLPEQPNQIPPQPNQVVQQQSQLNQQPQQPPPQLSPAYQAGPNNAFFNSAVAHRPQSPPAEAVIPEQQPPPMLQEGHSPLRAIAQPGPILPSHLNSFIDENPSGLPIGEALDRIHGSVALETLRQQQARFQQWSEHHAFLSQGSAPYPHHHHPHLQHLPQPPLGLHQPPVRADWKLTSSAEDEVETTYSRFQDLIRELSHRDQSETRELAEMPPPQSRLLQYRQVQSRSPPAVPSPPSSTDHSSHFSNFNDNSRDIEVASNPAFPQRLPPQIFNSPFSLPSEHLAPPPLKYLAPDGAWTFANLQQNHLMGPGFPYGLPPLPHRPPQNPFVQIQNHQHAIGQEPFHPLSSRTVSSSSLPSLEEYEPRGPGRPLYQRRISSSSVQPCSEEVSTPQDSLAQCKELQDHSNQSSFNFSSPESWVNTTSSTPYQNIPCNGSSRTAQPRELIAPPKTVKPPEDQLKSENLEVSSSFNYSVLQHLGQFPPLMPNKQIAESANSSSPQSSAGGKPAMSYASALRAPPKPRPPPEQAKKSSDPLSLFQELSLGSSSGSNGFYSYFK

SEQ ID NO: 1931 - protein, 416 aa, unidentified
MKRERGALSRASRALRLAPFVYLLLIQTDPLEGVNITSPVRLIHGTVGKSALLSVQYSSTSSDRPVVKWQLKRDKPVTVVQSIGTEVIGTLRPDYRDRIRLFENGSLLLSDLQLADEGTYEVEISITDDTFTGEKTINLTVDVPISRPQVLVASTTVLELSEAFTLNCSHENGTKPSYTWLKDGKPLLNDSRMLLSPDQKVLTITRVLMEDDDLYSCMVENPISQGRSLPVKITVYRRSSLYIILSTGGIFLLVTLVTVCACWKPSKRKQKKLEKQNSLEYMDQNDDRLKPEADTLPRSGEQERKNPMALYILKDKDSPETEENPAPEPRSATEPGPPGYSVSPAVPGRSPGLPIRSARRYPRSPARSPATGRTHSSPPRAPSSPGRSRSASRTLRTAGVHIIREQDEAGPVEISA

SEQ ID NO: 1932 - protein, 462 aa, unidentified
MGQDAFMEPFGDTLGVFQCKIYLLLFGACSGLKVTVPSHTVHGVRGQALYLPVHYGFHTPASDIQIIWLFERPHTMPKYLLGSVNKSVVPDLEYQHKFTMMPPNASLLINPLQFPDEGNYIVKVNIQGNGTLSASQKIQVTVDDPVTKPVVQIHPPSGAVEYVGNMTLTCHVEGGTRLAYQWLKNGRPVHTSSTYSFSPQNNTLHIAPVTKEDIGNYSCLVRNPVSEMESDIIMPIIYYGPYGLQVNSDKGLKVGEVFTVDLGEAILFDCSADSHPPNTYSWIRRTDNTTYIIKHGPRLEVASEKVAQKTMDYVCCAYNNITGRQDETHFTVIITSVGLEKLAQKGKSLSPLASITGISLFLIISMCLLFLWKKYQPYKVIKQKLEGRPETEYRKAQTFSGHEDALDDFGIYEFVAFPDVSGVSRIPSRSVPASDCVSGQDLHSTVYEVIQHIPAQQQDHPE

SEQ ID NO: 1933 - protein, 1158 aa, unidentified
MESGHLLWALLFMQSLWPQLTDGATRVYYLGIRDVQWNYAPKGRNVITNQPLDSDIVASSFLKSDKNRIGGTYKKTIYKEYKDDSYTDEVAQPAWLGFLGPVLQAEVGDVILIHLKNFATRPYTIHPHGVFYEKDSEGSLYPDGSSGPLKADDSVPPGGSHIYNWTIPEGHAPTDADPACLTWIYHSHVDAPRDIATGLIGPLITCKRGALDGNSPPQRQDVDHDFFLLFSVVDENLSWHLNENIATYCSDPASVDKEDETFQESNRMHAINGFVFGNLPELNMCAQKRVAWHLFGMGNEIDVHTAFFHGQMLTTRGHHTDVANIFPATFVTAEMVPWEPGTWLISCQVNSHFRDGMQALYKVKSCSMAPPVDLLTGKVRQYFIEAHEIQWDYGPMGHDGSTGKNLREPGSISDKFFQKSSSRIGGTYWKVRYEAFQDETFQEKMHLEEDRHLGILGPVIRAEVGDTIQVVFYNRASQPFSMQPHGVFYEKDYEGTVYNDGSSYPGLVAKPFEKVTYRWTVPPHAGPTAQDPACLTWMYFSAADPIRDTNSGLVGPLLVCRAGALGADGKQKGVDKEFFLLFTVLDENKSWYSNANQAAAMLDFRLLSEDIEGFQDSNRMHAINGFLFSNLPRLDMCKGDTVAWHLLGLGTETDVHGVMFQGNTVQLQGMRKGAAMLFPHTFVMAIMQPDNLGTFEIYCQAGSHREAGMRAIYNVSQCPGHQATPRQRYQAARIYYIMAEEVEWDYCPDRSWEREWHNQSEKDSYGYIFLSNKDGLLGSRYKKAVFREYTDGTFRIPRPRTGPEEHLGILGPLIKGEVGDILTVVFKNNASRPYSVHAHGVLESTTVWPLAAEPGEVVTYQWNIPERSGPGPNDSACVSWIYYSAVDPIKDMYSGLVGPLAICQKGILEPHGGRSDMDREFALLFLIFDENKSWYLEENVATHGSQDPGSINLQDETFLESNKMHAINGKLYANLRGLTMYQGERVAWYMLAMGQDVDLHTIHFHAESFLYRNGENYRADVVDLFPGTFEVVEMVASNPGTWLMHCHVTDHVHAGMETLFTVFSRTEHLSPLTVITKETEKAVPPRDIEEGNVKMLGMQIPIKNVEMLASVLVAISVTLLLVVLALGGVVWYQHRQRKLRRNRRSILDDSFKLLSFKQ

SEQ ID NO: 1934 - protein, 1159 aa, unidentified
MPRKQPAGCIFLLTFLGLSGLVGTVTRTYYIGIVEEYWNYVPQGKNVITGKSFTEDKLATLFLERGPNRIGSIYKKAVYRRFTDGTYSIEIPKPPWLGFLGPILRAEVGDVIVIHLKNFASRPYSLHPHGVFYNKDSEGALYPDGTSGRNKNDDMVPPGKNYTYVWPVREEYAPTPADANCLTWVYHSHIDAPKDICSGLIGPLLVCKEGILNRYSGTRNDVDREFVIMFTLVDENQSWYLNENIKHFCTNPDSVDKKDAVFQRSNKMHALNGYLFGNFPEPDMCVGESVSWHLFGMGNEIDIHSIYFYGNTFISRGHRTDVVNLFPATFLTTEMIAENPGKWMITCQVSDHLQAGMLGQYNVDNCKSDIFYPKMKGQQRRYFIAAEKILWDYAPQGYNKFSGLPLNASGSDSDLYFTQGDNRIGGKYWKVRYTEFVDATFTKRKRLSAEEAHLGILGPVIKAEVGDTLLVTFANKADKVYSILPHGVIYDKASDAAPNLDGFVKPGAHVKPGETFTYKWTVPESVSPTAGDPPCLTYLYFSAVDPIKDTSSGLVGPLLVCKKGVLNADGTQKGIDKEFYLLFTVFDENLSRYFDENIQKFIWHPFSIDKEDKEFVKSNRMHAVNGYMYGNQPGLNMCKRDRVSWHLIGLGTDTDMHGIVFQGNTIHLRGTHRDSLALFPHMATTAFMQPDHAGIFRVFCATMPHLSRGMGQIYEVSSCDNRDPSEQRYGMIRTFYIAAEEVEWDYAPNKNWEFEKQHVDARGERHGDIFMNRTENWIGSQYKKVVYREYTDGEFVEIKARPPREEHLELLGPMIHAEVGNTVLIIFKNKASRPYSISAQGVEEMDSGKQFQVPMTKPGEVKTYRWNIPKRSGPGPSDPNCIPWVYYSTVNFVKDTYSGLMGPLITCRKGVLNEKGRRSDVDYEFALLFLVFNENESWYLDDNIKKYLNKDPRDFKRTDDFEESNRMHAINGKIFGNLHGLIMNEDTMTNWYLLGIGSEVDIHTIHYHAESFLFKIDKSYREDVYDLFPGTFQTIELFADHPGTWLLHCHVSDHIHAGMETTYTVLRNIDNRIPYSTTSPGVASHPATVPSNERPGKEQLYFFGKNLGPTGAKAALVILFIIGLLLLITTVILSLRLCSAMKQTDYQQVQSCALPTDAL

SEQ ID NO: 1935 - protein, 4834 aa, unidentified
MPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGEDADLCSELLQESLDALRALPEASLFDESTVSSVWLEVVERATRFLRSVVTGDVHGTPATKGPGSIPLQDQHLALAILLELAVQRGTLSQMLSAILLLLQLWDSGAQETDNERSAQGTSAPLLPLLQRFQSIICRKDAPHSEGDMHLLSGPLSPNESFLRYLTLPQDNELAIDLRQTAVVVMAHLDRLATPCMPPLCSSPTSHKGSLQEVIGWGLIGWKYYANVIGPIQCEGLANLGVTQIACAEKRFLILSRNGRVYTQAYNSDTLAPQLVQGLASRNIVKIAAHSDGHHYLALAATGEVYSWGCGDGGRLGHGDTVPLEEPKVISAFSGKQAGKHVVHIACGSTYSAAITAEGELYTWGRGNYGRLGHGSSEDEAIPMLVAGLKGLKVIDVACGSGDAQTLAVTENGQVWSWGDGDYGKLGRGGSDGCKTPKLIEKLQDLDVVKVRCGSQFSIALTKDGQVYSWGKGDNQRLGHGTEEHVRYPKLLEGLQGKKVIDVAAGSTHCLALTEDSEVHSWGSNDQCQHFDTLRVTKPEPAALPGLDTKHIVGIACGPAQSFAWSSCSEWSIGLRVPFVVDICSMTFEQLDLLLRQVSEGMDGSADWPPPQEKECVAVATLNLLRLQLHAAISHQVDPEFLGLGLGSILLNSLKQTVVTLASSAGVLSTVQSAAQAVLQSGWSVLLPTAEERARALSALLPCAVSGNEVNISPGRRFMIDLLVGSLMADGGLESALHAAITAEIQDIEAKKEAQKEKEIDEQEANASTFHRSRTPLDKDLINTGICESSGKQCLPLVQLIQQLLRNIASQTVARLKDVARRISSCLDFEQHSRERSASLDLLLRFQRLLISKLYPGESIGQTSDISSPELMGVGSLLKKYTALLCTHIGDILPVAASIASTSWRHFAEVAYIVEGDFTGVLLPELVVSIVLLLSKNAGLMQEAGAVPLLGGLLEHLDRFNHLAPGKERDDHEELAWPGIMESFFTGQNCRNNEEVTLIRKADLENHNKDGGFWTVIDGKVYDIKDFQTQSLTGNSILAQFAGEDPVVALEAALQFEDTRESMHAFCVGQYLEPDQEIVTIPDLGSLSSPLIDTERNLGLLLGLHASYLAMSTPLSPVEIECAKWLQSSIFSGGLQTSQIHYSYNEEKDEDHCSSPGGTPASKSRLCSHRRALGDHSQAFLQAIADNNIQDHNVKDFLCQIERYCRQCHLTTPIMFPPEHPVEEVGRLLLCCLLKHEDLGHVALSLVHAGALGIEQVKHRTLPKSVVDVCRVVYQAKCSLIKTHQEQGRSYKEVCAPVIERLRFLFNELRPAVCNDLSIMSKFKLLSSLPRWRRIAQKIIRERRKKRVPKKPESTDDEEKIGNEESDLEEACILPHSPINVDKRPIAIKSPKDKWQPLLSTVTGVHKYKWLKQNVQGLYPQSPLLSTIAEFALKEEPVDVEKMRKCLLKQLERAEVRLEGIDTILKLASKNFLLPSVQYAMFCGWQRLIPEGIDIGEPLTDCLKDVDLIPPFNRMLLEVTFGKLYAWAVQNIRNVLMDASAKFKELGIQPVPLQTITNENPSGPSLGTIPQARFLLVMLSMLTLQHGANNLDLLLNSGMLALTQTALRLIGPSCDNVEEDMNASAQGASATVLEETRKETAPVQLPVSGPELAAMMKIGTRVMRGVDWKWGDQDGPPPGLGRVIGELGEDGWIRVQWDTGSTNSYRMGKEGKYDLKLAELPAAAQPSAEDSDTEDDSEAEQTERNIHPTAMMFTSTINLLQTLCLSAGVHAEIMQSEATKTLCGLLRMLVESGTTDKTSSPNRLVYREQHRSWCTLGFVRSIALTPQVCGALSSPQWITLLMKVVEGHAPFTATSLQRQILAVHLLQAVLPSWDKTERARDMKCLVEKLFDFLGSLLTTCSSDVPLLRESTLRRRRVRPQASLTATHSSTLAEEVVALLRTLHSLTQWNGLINKYINSQLRSITHSFVGRPSEGAQLEDYFPDSENPEVGGLMAVLAVIGGIDGRLRLGGQVMHDEFGEGTVTRITPKGKITVQFSDMRTCRVCPLNQLKPLPAVAFNVNNLPFTEPMLSVWAQLVNLAGSKLEKHKIKKSTKQAFAGQVDLDLLRCQQLKLYILKAGRALLSHQDKLRQILSQPAVQETGTVHTDDGAVVSPDLGDMSPEGPQPPMILLQQLLASATQPSPVKAIFDKQELEAAALAVCQCLAVESTHPSSPGFEDCSSSEATTPVAVQHIRPARVKRRKQSPVPALPIVVQLMEMGFSRRNIEFALKSLTGASGNASSLPGVEALVGWLLDHSDIQVTELSDADTVSDEYSDEEVVEDVDDAAYSMSTGAVVTESQTYKKRADFLSNDDYAVYVRENIQVGMMVRCCRAYEEVCEGDVGKVIKLDRDGLHDLNVQCDWQQKGGTYWVRYIHVELIGYPPPSSSSHIKIGDKVRVKASVTTPKYKWGSVTHQSVGVVKAFSANGKDIIVDFPQQSHWTGLLSEMELVPSIHPGVTCDGCQMFPINGSRFKCRNCDDFDFCETCFKTKKHNTRHTFGRINEPGQSAVFCGRSGKQLKRCHSSQPGMLLDSWSRMVKSLNVSSSVNQASRLIDGSEPCWQSSGSQGKHWIRLEIFPDVLVHRLKMIVDPADSSYMPSLVVVSGGNSLNNLIELKTININPSDTTVPLLNDCTEYHRYIEIAIKQCRSSGIDCKIHGLILLGRIRAEEEDLAAVPFLASDNEEEEDEKGNSGSLIRKKAAGLESAATIRTKVFVWGLNDKDQLGGLKGSKIKVPSFSETLSALNVVQVAGGSKSLFAVTVEGKVYACGEATNGRLGLGISSGTVPIPRQITALSSYVVKKVAVHSGGRHATALTVDGKVFSWGEGDDGKLGHFSRMNCDKPRLIEALKTKRIRDIACGSSHSAALTSSGELYTWGLGEYGRLGHGDNTTQLKPKMVKVLLGHRVIQVACGSRDAQTLALTDEGLVFSWGDGDFGKLGRGGSEGCNIPQNIERLNGQGVCQIECGAQFSLALTKSGVVWTWGKGDYFRLGHGSDVHVRKPQVVEGLRGKKIVHVAVGALHCLAVTDSGQVYAWGDNDHGQQGNGTTTVNRKPTLVQGLEGQKITRVACGSSHSVAWTTVDVATPSVHEPVLFQTARDPLGASYLGVPSDADSSAASNKISGASNSKPNRPSLAKILLSLDGNLAKQQALSHILTALQIMYARDAVVGALMPAAMIAPVECPSFSSAAPSDASAMASPMNGEECMLAVDIEDRLSPNPWQEKREIVSSEDAVTPSAVTPSAPSASARPFIPVTDDLGAASIIAETMTKTKEDVESQNKAAGPEPQALDEFTSLLIADDTRVVVDLLKLSVCSRAGDRGRDVLSAVLSGMGTAYPQVADMLLELCVTELEDVATDSQSGRLSSQPVVVESSHPYTDDTSTSGTVKIPGAEGLRVEFDRQCSTERRHDPLTVMDGVNRIVSVRSGREWSDWSSELRIPGDELKWKFISDGSVNGWGWRFTVYPIMPAAGPKELLSDRCVLSCPSMDLVTCLLDFRLNLASNRSIVPRLAASLAACAQLSALAASHRMWALQRLRKLLTTEFGQSININRLLGENDGETRALSFTGSALAALVKGLPEALQRQFEYEDPIVRGGKQLLHSPFFKVLVALACDLELDTLPCCAETHKWAWFRRYCMASRVAVALDKRTPLPRLFLDEVAKKIRELMADSENMDVLHESHDIFKREQDEQLVQWMNRRPDDWTLSAGGSGTIYGWGHNHRGQLGGIEGAKVKVPTPCEALATLRPVQLIGGEQTLFAVTADGKLYATGYGAGGRLGIGGTESVSTPTLLESIQHVFIKKVAVNSGGKHCLALSSEGEVYSWGEAEDGKLGHGNRSPCDRPRVIESLRGIEVVDVAAGGAHSACVTAAGDLYTWGKGRYGRLGHSDSEDQLKPKLVEALQGHRVVDIACGSGDAQTLCLTDDDTVWSWGDGDYGKLGRGGSDGCKVPMKIDSLTGLGVVKVECGSQFSVALTKSGAVYTWGKGDYHRLGHGSDDHVRRPRQVQGLQGKKVIAIATGSLHCVCCTEDGEVYTWGDNDEGQLGDGTTNAIQRPRLVAALQGKKVNRVACGSAHTLAWSTSKPASAGKLPAQVPMEYNHLQEIPIIALRNRLLLLHHLSELFCPCIPMFDLEGSLDETGLGPSVGFDTLRGILISQGKEAAFRKVVQATMVRDRQHGPVVELNRIQVKRSRSKGGLAGPDGTKSVFGQMCAKMSSFGPDSLLLPHRVWKVKFVGESVDDCGGGYSESIAEICEELQNGLTPLLIVTPNGRDESGANRDCYLLSPAARAPVHSSMFRFLGVLLGIAIRTGSPLSLNLAEPVWKQLAGMSLTIADLSEVDKDFIPGLMYIRDNEATSEEFEAMSLPFTVPSASGQDIQLSSKHTHITLDNRAEYVRLAINYRLHEFDEQVAAVREGMARVVPVPLLSLFTGYELETMVCGSPDIPLHLLKSVATYKGIEPSASLIQWFWEVMESFSNTERSLFLRFVWGRTRLPRTIADFRGRDFVIQVLDKYNPPDHFLPESYTCFFLLKLPRYSCKQVLEEKLKYAIHFCKSIDTDDYARIALTGEPAADDSSDDSDNEDVDSFASDSTQDYLTGH

SEQ ID NO: 1936 - protein, 1057 aa, unidentified
MLCWGNASFGQLGLGGIDEEIVLEPRKSDFFINKRVRDVGCGLRHTVFVLDDGTVYTCGCNDLGQLGHEKSRKKPEQVVALDAQNIVAVSCGEAHTLALNDKGQVYAWGLDSDGQLGLVGSEECIRVPRNIKSLSDIQIVQVACGYYHSLALSKASEVFCWGQNKYGQLGLGTDCKKQTSPQLLKSLLGIPFMQVAAGGAHSFVLTLSGAIFGWGRNKFGQLGLNDENDRYVPNLLKSLRSQKIVYICCGEDHTAALTKEGGVFTFGAGGYGQLGHNSTSHEINPRKVFELMGSIVTEIACGRQHTSAFVPSSGRIYSFGLGGNGQLGTGSTSNRKSPFTVKGNWYPYNGQCLPDIDSEEYFCVKRIFSGGDQSFSHYSSPQNCGPPDDFRCPNPTKQIWTVNEALIQKWLSYPSGRFPVEIANEIDGTFSSSGCLNGSFLAVSNDDHYRTGTRFSGVDMNAARLLFHKLIQPDHPQISQQVAASLEKNLIPKLTSSLPDVEALRFYLTLPECPLMSDSNNFTTIAIPFGTALVNLEKAPLKVLENWWSVLEPPLFLKIVELFKEVVVHLLKLYKIGIPPSERRIFNSFLHTALKVLEILHRVNEKMGQIIQYDKFYIHEVQELIDIRNDYINWVQQQAYGMDVNHGLTELADIPVTICTYPFVFDAQAKTTLLQTDAVLQMQMAIDQAHRQNVSSLFLPVIESVNPCLILVVRRENIVGDAMEVLRKTKNIDYKKPLKVIFVGEDAVDAGGVRKEFFLLIMRELLDPKYGMFRYYEDSRLIWFSDKTFEDSDLFHLIGVICGLAIYNCTIVDLHFPLALYKKLLKKKPSLDDLKELMPDVGRSMQQLLDYPEDDIEETFCLNFTITVENFGATEVKELVLNGADTAVNKQNRQEFVDAYVDYIFNKSVASLFDAFHAGFHKVCGGKVLLLFQPNELQAMVIGNTNYDWKELEKNTEYKGEYWAEHPTIKIFWEVFHELPLEKKKQFLLFLTGSDRIPILGMKSLKLVIQSTGGGEEYLPVSHTCFNLLDLPKYTEKETLRSKLIQAIDHNEGFSLI

SEQ ID NO: 1937 - protein, 1024 aa, unidentified
MERRSRRKSRRNGRSTAGKAAATQPAKSPGAQLWLFPSAAGLHRALLRRVEVTRQLCCSPGRLAVLERGGAGVQVHQLLAGSGGARTPKCIKLGKNMKIHSVDQGAEHMLILSSDGKPFEYDNYSMKHLRFESILQEKKIIQITCGDYHSLALSKGGELFAWGQNLHGQLGVGRKFPSTTTPQIVEHLAGVPLAQISAGEAHSMALSMSGNIYSWGKNECGQLGLGHTESKDDPSLIEGLDNQKVEFVACGGSHSALLTQDGLLFTFGAGKHGQLGHNSTQNELRPCLVAELVGYRVTQIACGRWHTLAYVSDLGKVFSFGSGKDGQLGNGGTRDQLMPLPVKVSSSEELKLESHTSEKELIMIAGGNQSILLWIKKENSYVNLKRTIPTLNEGTVKRWIADVETKRWQSTKREIQEIFSSPACLTGSFLRKRRTTEMMPVYLDLNKARNIFKELTQKDWITNMITTCLKDNLLKRLPFHSPPQEALEIFFLLPECPMMHISNNWESLVVPFAKVVCKMSDQSSLVLEEYWATLQESTFSKLVQMFKTAVICQLDYWDESAEENGNVQALLEMLKKLHRVNQVKCQLPESIFQVDELLHRLNFFVEVCRRYLWKMTVDASENVQCCVIFSHFPFIFNNLSKIKLLHTDTLLKIESKKHKAYLRSAAIEEERESEFALRPTFDLTVRRNHLIEDVLNQLSQFENEDLRKELWVSFSGEIGYDLGGVKKEFFYCLFAEMIQPEYGMFMYPEGASCMWFPVKPKFEKKRYFFFGVLCGLSLFNCNVANLPFPLALFKKLLDQMPSLEDLKELSPDLGKNLQTLLDDEGDNFEEVFYIHFNVHWDRNDTNLIPNGSSITVNQTNKRDYVSKYINYIFNDSVKAVYEEFRRGFYKMCDEDIIKLFHPEELKDVIVGNTDYDWKTFEKNARYEPGYNSSHPTIVMFWKAFHKLTLEEKKKFLVFLTGTDRLQMKDLNNMKITFCCPESWNERDPIRALTCFSVLFLPKYSTMETVEEALQEAINNNRGFG

SEQ ID NO: 1938 - protein, 1022 aa, unidentified
MYFCWGADSRELQRRRTAGSPGAELLQAASGERHSLLLLTNHRVLSCGDNSRGQLGRRGAQRGELPEPIQALETLIVDLVSCGKEHSLAVCHKGRVFAWGAGSEGQLGIGEFKEISFTPKKIMTLNDIKIIQVSCGHYHSLALSKDSQVFSWGKNSHGQLGLGKEFPSQASPQRVRSLEGIPLAQVAAGGAHSFALSLCGTSFGWGSNSAGQLALSGRNVPVQSNKPLSVGALKNLGVVYISCGDAHTAVLTQDGKVFTFGDNRSGQLGYSPTPEKRGPQLVERIDGLVSQIDCGSYHTLAYVHTTGQVVSFGHGPSDTSKPTHPEALTENFDISCLISAEDFVDVQVKHIFAGTYANFVTTHQDTSSTRAPGKTLPEISRISQSMAEKWIAVKRRSTEHEMAKSEIRMIFSSPACLTASFLKKRGTGETTSIDVDLEMARDTFKKLTKKEWISSMITTCLEDDLLRALPCHSPHQEALSVFLLLPECPVMHDSKNWKNLVVPFAKAVCEMSKQSLQVLKKCWAFLQESSLNPLIQMLKAAIISQLLHQTKTEQDHCNVKALLGMMKELHKVNKANCRLPENTFNINELSNLLNFYIDRGRQLFRDNHLIPAETPSPVIFSDFPFIFNSLSKIKLLQADSHIKMQMSEKKAYMLMHETILQKKDEFPPSPRFILRVRRSRLVKDALRQLSQAEATDFCKVLVVEFINEICPESGGVSSEFFHCMFEEMTKPEYGMFMYPEMGSCMWFPAKPKPEKKRYFLFGMLCGLSLFNLNVANLPFPLALYKKLLDQKPSLEDLKELSPRLGKSLQEVLDDAADDIGDALCIRFSIHWDQNDVDLIPNGISIPVDQTNKRDYVSKYIDYIFNVSVKAVYEEFQRGFYRVCEKEILRHFYPEELMTAIIGNTDYDWKQFEQNSKYEQGYQKSHPTIQLFWKAFHKLTLDEKKKFLFFLTGRDRLHARGIQKMEIVFRCPETFSERDHPTSITCHNILSLPKYSTMERMEEALQVAINNNRGFVSPMLTQS

SEQ ID NO: 1939 - protein, 391 aa, unidentified
MESETEPEPVTLLVKSPNQRHRDLELSGDRGWSVGHLKAHLSRVYPERPRPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 1940 - protein, 406 aa, unidentified
MDQSGMEIPVTLIIKAPNQKYSDQTISCFLNWTVGKLKTHLSNVYPSKPLTKDQRLVYSGRLLPDHLQLKDILRKQDEYHMVHLVCTSRTPPSSPKSSTNRESHEALASSSNSSSDHSGSTTPSSGQETLSLAVGSSSEGLRQRTLPQAQTDQAQSHQFPYVMQGNVDNQFPGQAAPPGFPVYPAFSPLQMLWWQQMYAHQYYMQYQAAVSAQATSNVNPTQPTTSQPLNLAHVPGEEPPPAPNLVAQENRPMNENVQMNAQGGPVLNEEDFNRDWLDWMYTFSRAAILLSIVYFYSSFSRFIMVMGAMLLVYLHQAGWFPFRQEGGHQQAPNNNAEVNNDGQNANNLELEEMERLMDDGLEDESGEDGGEDASAIQRPGLMASAWSFITTFFTSLIPEGPPQVAN

SEQ ID NO: 1941 - protein, 348 aa, unidentified
MGPRARPALLLLMLLQTAVLQGRLLRSHSLHYLFMGASEQDLGLSLFEALGYVDDQLFVFYDHESRRVEPRTPWVSSRISSQMWLQLSQSLKGWDHMFTVDFWTIMENHNHSKESHTLQVILGCEMQEDNSTEGYWKYGYDGQDHLEFCPDTLDWRAAEPRAWPTKLEWERHKIRARQNRAYLERDCPAQLQQLLELGRGVLDQQVPPLVKVTHHVTSSVTTLRCRALNYYPQNITMKWLKDKQPMDAKEFEPKDVLPNGDGTYQGWITLAVPPGEEQRYTCQVEHPGLDQPLIVIWEPSPSGTLVIGVISGIAVFVVILFIGILFIILRKRQGSRGAMGHYVLAERE

SEQ ID NO: 1942 - protein, 426 aa, unidentified
MGEPGQSPSPRSSHGSPPTLSTLTLLLLLCGHAHSQCKILRCNAEYVSSTLSLRGGGSSGALRGGGGGGRGGGVGSGGLCRALRSYALCTRRTARTCRGDLAFHSAVHGIEDLMIQHNCSRQGPTAPPPPRGPALPGAGSGLPAPDPCDYEGRFSRLHGRPPGFLHCASFGDPHVRSFHHHFHTCRVQGAWPLLDNDFLFVQATSSPMALGANATATRKLTIIFKNMQECIDQKVYQAEVDNLPVAFEDGSINGGDRPGGSSLSIQTANPGNHVEIQAAYIGTTIIIRQTAGQLSFSIKVAEDVAMAFSAEQDLQLCVGGCPPSQRLSRSERNRRGAITIDTARRLCKEGLPVEDAYFHSCVFDVLISGDPNFTVAAQAALEDARAFLPDLEKLHLFPSDAGVPLSSATLLAPLLSGLFVLWLCIQ

SEQ ID NO: 1943 - protein, 663 aa, unidentified
MTGARASAAEQRRAGRSGQARAAERAAGMSGAGRALAALLLAASVLSAALLAPGGSSGRDAQAAPPRDLDKKRHAELKMDQALLLIHNELLWTNLTVYWKSECCYHCLFQVLVNVPQSPKAGKPSAAAASVSTQHGSILQLNDTLEEKEVCRLEYRFGEFGNYSLLVKNIHNGVSEIACDLAVNEDPVDSNLPVSIAFLIGLAVIIVISFLRLLLSLDDFNNWISKAISSRETDRLINSELGSPSRTDPLDGDVQPATWRLSALPPRLRSVDTFRGIALILMVFVNYGGGKYWYFKHASWNGLTVADLVFPWFVFIMGSSIFLSMTSILQRGCSKFRLLGKIAWRSFLLICIGIIIVNPNYCLGPLSWDKVRIPGVLQRLGVTYFVVAVLELLFAKPVPEHCASERSCLSLRDITSSWPQWLLILVLEGLWLGLTFLLPVPGCPTGYLGPGGIGDFGKYPNCTGGAAGYIDRLLLGDDHLYQHPSSAVLYHTEVAYDPEGILGTINSIVMAFLGVQAGKILLYYKARTKDILIRFTAWCCILGLISVALTKVSENEGFIPVNKNLWSLSYVTTLSSFAFFILLVLYPVVDVKGLWTGTPFFYPGMNSILVYVGHEVFENYFPFQWKLKDNQSHKEHLTQNIVATALWVLIAYILYRKKIFWKI

SEQ ID NO: 1944 - protein, 493 aa, unidentified
MLPRWELALYLLASLGFHFYSFYEVYKVSREHEEELDQEFELETDTLFGGLKKDATDFEWSFWMEWGKQWLVWLLLGHMVVSQMATLLARKHRPWILMLYGMWACWCVLGTPGVAMVLLHTTISFCVAQFRSQLLTWLCSLLLLSTLRLQGVEEVKRRWYKTENEYYLLQFTLTVRCLYYTSFSLELCWQQLPAASTSYSFPWMLAYVFYYPVLHNGPILSFSEFIKQMQQQEHDSLKASLCVLALGLGRLLCWWWLAELMAHLMYMHAIYSSIPLLETVSCWTLGGLALAQVLFFYVKYLVLFGVPALLMRLDGLTPPALPRCVSTMFSFTGMWRYFDVGLHNFLIRYVYIPVGGSQHGLLGTLFSTAMTFAFVSYWHGGYDYLWCWAALNWLGVTVENGVRRLVETPCIQDSLARYFSPQARRRFHAALASCSTSMLILSNLVFLGGNEVGKTYWNRIFIQGWPWVTLSVLGFLYCYSHVGIAWAQTYATD

SEQ ID NO: 1945 - protein, 504 aa, unidentified
MGIKTALPAAELGLYSLVLSGALAYAGRGLLEASQDGAHRKAFRESVRPGWEYIGRKMDVADFEWVMWFTSFRNVIIFALSGHVLFAKLCTMVAPKLRSWMYAVYGALAVMGTMGPWYLLLLLGHCVGLYVASLLGQPWLCLGLGLASLASFKMDPLISWQSGFVTGTFDLQEVLFHGGSSFTVLRCTSFALESCAHPDRHYSLADLLKYNFYLPFFFFGPIMTFDRFHAQVSQVEPVRREGELWHIRAQAGLSVVAIMAVDIFFHFFYILTIPSDLKFANRLPDSALAGLAYSNLVYDWVKAAVLFGVVNTVACLDHLDPPQPPKCITALYVFAETHFDRGINDWLCKYVYNHIGGEHSAVIPELAATVATFAITTLWLGPCDIVYLWSFLNCFGLNFELWMQKLAEWGPLARIEASLSVQMSRRVRALFGAMNFWAIIMYNLVSLNSLKFTELVARRLLLTGFPQTTLSILFVTYCGVQLVKERERTLALEEEQKQDKEKPE

SEQ ID NO: 1946 - protein, 700 aa, unidentified
MLKMLSFKLLLLAVALGFFEGDAKFGERNEGSGARRRRCLNGNPPKRLKRRDRRMMSQLELLSGGEMLCGGFYPRLSCCLRSDSPGLGRLENKIFSVTNNTECGKLLEEIKCALCSPHSQSLFHSPEREVLERDLVLPLLCKDYCKEFFYTCRGHIPGFLQTTADEFCFYYARKDGGLCFPDFPRKQVRGPASNYLDQMEEYDKVEEISRKHKHNCFCIQEVVSGLRQPVGALHSGDGSQRLFILEKEGYVKILTPEGEIFKEPYLDIHKLVQSGIKGGDERGLLSLAFHPNYKKNGKLYVSYTTNQERWAIGPHDHILRVVEYTVSRKNPHQVDLRTARVFLEVAELHRKHLGGQLLFGPDGFLYIILGDGMITLDDMEEMDGLSDFTGSVLRLDVDTDMCNVPYSIPRSNPHFNSTNQPPEVFAHGLHDPGRCAVDRHPTDININLTILCSDSNGKNRSSARILQIIKGKDYESEPSLLEFKPFSNGPLVGGFVYRGCQSERLYGSYVFGDRNGNFLTLQQSPVTKQWQEKPLCLGTSGSCRGYFSGHILGFGEDELGEVYILSSSKSMTQTHNGKLYKIVDPKRPLMPEECRATVQPAQTLTSECSRLCRNGYCTPTGKCCCSPGWEGDFCRTAKCEPACRHGGVCVRPNKCLCKKGYLGPQCEQVDRNIRRVTRAGILDQIIDMTSYLLDLTSYIV

SEQ ID NO: 1947 - protein, 414 aa, unidentified
MKAQTALSFFLILITSLSGSQGIFPLAFFIYVPMNEQIVIGRLDEDIILPSSFERGSEVVIHWKYQDSYKVHSYYKGSDHLESQDPRYANRTSLFYNEIQNGNASLFFRRVSLLDEGIYTCYVGTAIQVITNKVVLKVGVFLTPVMKYEKRNTNSFLICSVLSVYPRPIITWKMDNTPISENNMEETGSLDSFSINSPLNITGSNSSYECTIENSLLKQTWTGRWTMKDGLHKMQSEHVSLSCQPVNDYFSPNQDFKVTWSRMKSGTFSVLAYYLSSSQNTIINESRFSWNKELINQSDFSMNLMDLNLSDSGEYLCNISSDEYTLLTIHTVHVEPSQETASHNKGLWILVPSAILAAFLLIWSVKCCRAQLEARRSRHPADGAQQERCCVPPGERCPSAPDNGEENVPLSGKV

SEQ ID NO: 1948 - protein, 93 aa, unidentified [sequence omitted]

SEQ ID NO: 1949 - protein, 99 aa, unidentified
MSANRRWWVPPDDEDCVSEKLLRKTRESPLVPIGLGGCLVVAAYRIYRLRSRGSTKMSIHLIHTRVAAQACAVGAIMLGAVYTMYSDYVKRMAQDAGEK

SEQ ID NO: 1950 - protein, 97 aa, unidentified
MSSDNQWSADEDEGQLSRLIRKSRDSPFVPIGIAGFVTVVSCGLYKLKYRRDQKMSIHLIHMRVAAQGFVVGAVTLGVLYSMYKDYIRPRFFSESKK

SEQ ID NO: 1951 - protein, 106 aa, unidentified
MATPGPVIPEVPFEPSKPPVIEGLSPTVYRNPESFKEKFVRKTRENPVVPIGCLATAAALTYGLYSFHRGNSQRSQLMMRTRIAAQGFTVAAILLGLAVTAMKSRP

SEQ ID NO: 1952 - protein, 63 aa, unidentified
MKHVLNLYLLGVVLTLLSIFVRVMESLEGLLESPSPGTSWTTRSQLANTEPTKGLPDHPSRSM

SEQ ID NO: 1953 - protein, 1210 aa, unidentified
MASQLQVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSSSGLKPRSNVISYVTVNDSPDSDSSLSSPYSTDTLSALRGNSGSVLEGPGRVVADGTGTRTIIVPPLKTQLGDCTVATQASGLLSNKTKPVASVSGQSSGCCITPTGYRAQRGGTSAAQPLNLSQNQQSSAAPTSQERSSNPAPRRQQAFVAPLSQAPYTFQHGSPLHSTGHPHLAPAPAHLPSQAHLYTYAAPTSAAALGSTSSIAHLFSPQGSSRHAAAYTTHPSTLVHQVPVSVGPSLLTSASVAPAQYQHQFATQSYIGSSRGSTIYTGYPLSPTKISQYSYL

SEQ ID NO: 1954 - protein, 1198 aa, unidentified
MAPVYEGMASHVQVFSPHTLQSSAFCSVKKLKIEPSSNWDMTGYGSHSKVYSQSKNIPLSQPATTTVSTSLPVPNPSLPYEQTIVFPGSTGHIVVTSASSTSVTGQVLGGPHNLMRRSTVSLLDTYQKCGLKRKSEEIENTSSVQIIEEHPPMIQNNASGATVATATTSTATSKNSGSNSEGDYQLVQHEVLCSMTNTYEVLEFLGRGTFGQVVKCWKRGTNEIVAIKILKNHPSYARQGQIEVSILARLSTESADDYNFVRAYECFQHKNHTCLVFEMLEQNLYDFLKQNKFSPLPLKYIRPVLQQVATALMKLKSLGLIHADLKPENIMLVDPSRQPYRVKVIDFGSASHVSKAVCSTYLQSRYYRAPEIILGLPFCEAIDMWSLGCVIAELFLGWPLYPGASEYDQIRYISQTQGLPAEYLLSAGTKTTRFFNRDTDSPYPLWRLKTPDDHEAETGIKSKEARKYIFNCLDDMAQVNMTTDLEGSDMLVEKADRREFIDLLKKMLTIDADKRITPIETLNHPFVTMTHLLDFPHSTHVKSCFQNMEICKRRVNMYDTVNQSKTPFITHVAPSTSTNLTMTFNNQLTTVHNQAPSSTSATISLANPEVSILNYPSTLYQPSAASMAAVAQRSMPLQTGTAQICARPDPFQQALIVCPPGFQGLQASPSKHAGYSVRMENAVPIVTQAPGAQPLQIQPGLLAQQAWPSGTQQILLPPAWQQLTGVATHTSVQHATVIPETMAGTQQLADWRNTHAHGSHYNPIMQQPALLTGHVTLPAAQPLNVGVAHVMRQQPTSTTSSRKSKQHQSSVRNVSTCEVSSSQAISSPQRSKRVKENTPPRCAMVHSSPACSTSVTCGWGDVASSTTRERQRQTIVIPDTPSPTVSVITISSDTDEEEEQKHAPTSTVSKQRKNVISCVTVHDSPYSDSSSNTSPYSVQQRAGHNNANAFDTKGSLENHCTGNPRTIIVPPLKTQASEVLVECDSLVPVNTSHHSSSYKSKSSSNVTSTSGHSSGSSSGAITYRQQRPGPHFQQQQPLNLSQAQQHITTDRTGSHRRQQAYITPTMAQAPYSFPHNSPSHGTVHPHLAAAAAAAHLPTQPHLYTYTAPAALGSTGTVAHLVASQGSARHTVQHTAYPASIVHQVPVSMGPRVLPSPTIHPSQYPAQFAHQTYISASPASTVYTGYPLSPAKVNQYPYI

SEQ ID NO: 1955 - protein, 1215 aa, unidentified
MASQVLVYPPYVYQTQSSAFCSVKKLKVEPSSCVFQERNYPRTYVNGRNFGNSHPPTKGSAFQTKIPFNRPRGHNFSLQTSAVVLKNTAGATKVIAAQAQQAHVQAPQIGAWRNRLHFLEGPQRCGLKRKSEELDNHSSAMQIVDELSILPAMLQTNMGNPVTVVTATTGSKQNCTTGEGDYQLVQHEVLCSMKNTYEVLDFLGRGTFGQVVKCWKRGTNEIVAIKILKNHPSYARQGQIEVSILARLSTENADEYNFVRAYECFQHRNHTCLVFEMLEQNLYDFLKQNKFSPLPLKVIRPILQQVATALKKLKSLGLIHADLKPENIMLVDPVRQPYRVKVIDFGSASHVSKTVCSTYLQSRYYRAPEIILGLPFCEAIDMWSLGCVIAELFLGWPLYPGALEYDQIRYISQTQGLPGEQLLNVGTKSTRFFCKETDMSHSGWRLKTLEEHEAETGMKSKEARKYIFNSLDDVAHVNTVMDLEGSDLLAEKADRREFVSLLKKMLLIDADLRITPAETLNHPFVNMKHLLDFPHSNHVKSCFHIMDICKSHLNSCDTNNHNKTSLLRPVASSSTATLTANFTKIGTLRSQALTTSAHSVVHHGIPLQAGTAQFGCGDAFQQTLIICPPAIQGIPATHGKPTSYSIRVDNTVPLVTQAPAVQPLQIRPGVLSQTWSGRTQQMLVPAWQQVTPLAPATTTLTSESVAGSHRLGDWGKMISCSNHYNSVMPQPLLTNQITLSAPQPVSVGIAHVVWPQPATTKKNKQCQNRGILVKLMEWEPGREEINAFSWSNSLQNTNIPHSAFISPKIINGKDVEEVSCIETQDNQNSEGEARNCCETSIRQDSDSSVSDKQRQTIIIADSPSPAVSVITISSDTDEEETSQRHSLRECKGSLDCEACQSTLNIDRMCSLSSPDSTLSTSSSGQSSPSPCKRPNSMSDEEQESSCDTVDGSPTSDSSGHDSPFAESTFVEDTHENTELVSSADTETKPAVCSVVVPPVELENGLNADEHMANTDSICQPLIKGRSAPGRLNQPSAVGTRQQKLTSAFQQQHLNFSQVQHFGSGHQEWNGNFGHRRQQAYIPTSVTSNPFTLSHGSPNHTAVHAHLAGNTHLGGQPTLLPYPSSATLSSAAPVAHLLASPCTSRPMLQHPTYNISHPSGIVHQVPVGLNPRLLPSPTIHQTQYKPIFPPHSYIAASPAYTGFPLSPTKLSQYPYM

SEQ ID NO: 1956 - protein, 365 aa, unidentified
MAVMAPRTLLLLLSGALALTQTWAGSHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDGTCVEWLRRYLENGKETLQRTDPPKTHMTHHPISDHEATLRCWALGFYPAEITLTWQRDGEDQTQDTELVETRPAGDGTFQKWAAVVVPSGEEQRYTCHVQHEGLPKPLTLRWELSSQPTIPIVGIIAGLVLLGAVITGAVVAAVMWRRKSSDRKGGSYTQAASSDSAQGSDVSLTACKV

SEQ ID NO: 1957 - protein, 362 aa, unidentified
MLVMAPRTVLLLLSAALALTETWAGSHSMRYFYTSVSRPGRGEPRFISVGYVDDTQFVRFDSDAASPREEPRAPWIEQEGPEYWDRNTQIYKAQAQTDRESLRNLRGYYNQSEAGSHTLQSMYGCDVGPDGRLLRGHDQYAYDGKDYIALNEDLRSWTAADTAAQITQRKWEAAREAEQRRAYLEGECVEWLRRYLENGKDKLERADPPKTHVTHHPISDHEATLRCWALGFYPAEITLTWQRDGEDQTQDTELVETRPAGDRTFQKWAAVVVPSGEEQRYTCHVQHEGLPKPLTLRWEPSSQSTVPIVGIVAGLAVLAVVVIGAVVAAVMCRRKSSGGKGGSYSQAACSDSAQGSDVSLTA

SEQ ID NO: 1958 - protein, 366 aa, unidentified
MRVMAPRALLLLLSGGLALTETWACSHSMRYFDTAVSRPGRGEPRFISVGYVDDTQFVRFDSDAASPRGEPRAPWVEQEGPEYWDRETQKYKRQAQADRVSLRNLRGYYNQSEDGSHTLQRMSGCDLGPDGRLLRGYDQSAYDGKDYIALNEDLRSWTAADTAAQITQRKLEAARAAEQLRAYLEGTCVEWLRRYLENGKETLQRAEPPKTHVTHHPLSDHEATLRCWALGFYPAEITLTWQRDGEDQTQDTELVETRPAGDGTFQKWAAVVVPSGQEQRYTCHMQHEGLQEPLTLSWEPSSQPTIPIMGIVAGLAVLVVLAVLGAVVTAMMCRRKSSGGKGGSCSQAACSNSAQGSDESLITCKA

SEQ ID NO: 1959 - protein, 227 aa, unidentified
MGHEQNQGAALLQMLPLLWLLPHSWAVPEAPTPMWPDDLQNHTFLHTVYCQDGSPSVGLSEAYDEDQLFFFDFSQNTRVPRLPEFADWAQEQGDAPAILFDKEFCEWMIQQIGPKLDGKIPVSRVNWQHHSVPVEGFGPTFVSAVDGLSFQAFSYLNFTPEPSDIFSCIVTHEIDRYTAIAYWVPRNALPSDLLENVLCGVAFGLGVLGIIVGIVLIIYFRKPCSGD

SEQ ID NO: 1960 - protein, 263 aa, unidentified
MITFLPLLLGLSLGCTGAGGFVAHVESTCLLDDAGTPKDFTYCISFNKDLLTCWDPEENKMAPCEFGVLNSLANVLSQHLNQKDTLMQRLRNGLQNCATHTQPFWGSLTNRTRPPSVQVAKTTPFNTREPVMLACYVWGFYPAEVTITWRKNGKLVMPHSSAHKTAQPNGDWTYQTLSHLALTPSYGDTYTCVVEHIGAPEPILRDWTPGLSPMQTLKVSVSAVTLGLGLIIFSLGVISWRRAGHSSYTPLPGSNYSEGWHIS

SEQ ID NO: 1961 - protein, 250 aa, unidentified
MALRAGLVLGFHTLMTLLSPQEAGATKADHMGSYGPAFYQSYGASGQFTHEFDEEQLFSVDLKKSEAVWRLPEFGDFARFDPQGGLAGIAAIKAHLDILVERSNRSRAINVPPRVTVLPKSRVELGQPNILICIVDNIFPPVINITWLRNGQTVTEGVAQTSFYSQPDHLFRKFHYLPFVPSAEDVYDCQVEHWGLDAPLLRHWELQVPIPPPDAMETLVCALGLAIGLVGFLVGTVLIIMGTYVSSVPR

SEQ ID NO: 1962 - protein, 273 aa, unidentified
MGSGWVPWVVALLVNLTRLDSSMTQGTDSPEDFVIQAKADCYFTNGTEKVQFVVRFIFNLEEYVRFDSDVGMFVALTKLGQPDAEQWNSRLDLLERSRQAVDGVCRHNYRLGAPFTVGRKVQPEVTVYPERTPLLHQHNLLHCSVTGFYPGDIKIKWFLNGQEERAGVMSTGPIRNGDWTFQTVVMLEMTPELGHVYTCLVDHSSLLSPVSVEWRAQSEYSWRKMLSGIAAFLLGLIFLLVGIVIQLRAQKGYVRTQMSGNEVSRAVLLPQSC

SEQ ID NO: 1963 - protein, 260 aa, unidentified
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 1964 - protein, 258 aa, unidentified
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 1965 - protein, 254 aa, unidentified
MILNKALMLGALALTTVMSPCGGEDIVADHVASYGVNLYQSYGPSGQYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETVVCALGLSVGLVGIVVGTVFIIRGLRSVGASRHQGPL

SEQ ID NO: 1966 - protein, 255 aa, unidentified
MILNKALLLGALALTAVMSPCGGEDIVADHVASYGVNFYQSHGPSGQYTHEFDGDEEFYVDLETKETVWQLPMFSKFISFDPQSALRNMAVGKHTLEFMMRQSNSTAATNEVPEVTVFSKFPVTLGQPNTLICLVDNIFPPVVNITWLSNGHSVTEGVSETSFLSKSDHSFFKISYLTFLPSADEIYDCKVEHWGLDEPLLKHWEPEIPAPMSELTETLVCALGLSVGLMGIVVGTVFIIQGLRSVGASRHQGLL

SEQ ID NO: 1967 - protein, 261 aa, unidentified
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRAQSESAQSKMLSGVGGFVLGLIFLGLGLIIRQRSQKGLLH

SEQ ID NO: 1968 - protein, 268 aa, unidentified
MSWKMALQIPGGFWAAAVTVMLVMLSTPVAEARDFPKDFLVQFKGMCYFTNGTERVRGVARYIYNREEYGRFDSDVGEFQAVTELGRSIEDWNNYKDFLEQERAAVDKVCRHNYEAELRTTLQRQVEPTVTISPSRTEALNHHNLLVCSVTDFYPAQIKVRWFRNDQEETAGVVSTSLIRNGDWTFQILVMLEITPQRGDIYTCQVEHPSLQSPITVEWRAQSESAQSKMLSGIGGFVLGLIFLGLGLIIRHRGQKGPRGPPPAGLLH

SEQ ID NO: 1969 - protein, 254 aa, unidentified
MAISGVPVLGFFIIAVLMSAQESWAIKEEHVIIQAEFYLNPDQSGEFMFDFDGDEIFHVDMAKKETVWRLEEFGRFASFEAQGALANIAVDKANLEIMTKRSNYTPITNVPPEVTVLTNSPVELREPNVLICFIDKFTPPVVNVTWLRNGKPVTTGVSETVFLPREDHLFRKFHYLPFLPSTEDVYDCRVEHWGLDEPLLKHWEFDAPSPLPETTENVVCALGLTVGLVGIIIGTIFIIKGVRKSNAAERRGPL

SEQ ID NO: 1970 - protein, 266 aa, unidentified
MVCLKLPGGSCMTALTVTLMVLSSPLALSGDTRPRFLWQPKRECHFFNGTERVRFLDRYFYNQEESVRFDSDVGEFRAVTELGRPDAEYWNSQKDILEQARAAVDTYCRHNYGVVESFTVQRRVQPKVTVYPSKTQPLQHHNLLVCSVSGFYPGSIEVRWFLNGQEEKAGMVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 1971 - protein, 266 aa, unidentified
MVCLKLPGGSYMAKLTVTLMVLSSPLALAGDTRPRFLQQDKYECHFFNGTERVRFLHRDIYNQEEDLRFDSDVGEYRAVTELGRPDAEYWNSQKDFLEDRRAAVDTYCRHNYGVGESFTVQRRVEPKVTVYPARTQTLQHHNLLVCSVNGFYPGSIEVRWFRNSQEEKAGVVSTGLIQNGDWTFQTLVMLETVPRSGEVYTCQVEHPSVTSPLTVEWRAQSESAQSKMLSGVGGFVLGLLFLGAGLFIYFKNQKGHSGLHPTGLVS

SEQ ID NO: 1972 - protein, 346 aa, unidentified
MAPRSLLLLLSGALALTDTWAGSHSLRYFSTAVSRPGRGEPRYIAVEYVDDTQFLRFDSDAAIPRMEPREPWVEQEGPQYWEWTTGYAKANAQTDRVALRNLLRRYNQSEAGSHTLQGMNGCDMGPDGRLLRGYHQHAYDGKDYISLNEDLRSWTAADTVAQITQRFYEAEEYAEEFRTYLEGECLELLRRYLENGKETLQRADPPKAHVAHHPISDHEATLRCWALGFYPAEITLTWQRDGEEQTQDTELVETRPAGDGTFQKWAAVVVPPGEEQRYTCHVQHEGLPQPLILRWEQSPQPTIPIVGIVAGLVVLGAVVTGAVVAAVMWRKKSSDRNRGSYSQAAV

SEQ ID NO: 1973 - protein, 338 aa, unidentified
MVVMAPRTLFLLLSGALTLTETWAGSHSMRYFSAAVSRPGRGEPRFIAMGYVDDTQFVRFDSDSACPRMEPRAPWVEQEGPEYWEEETRNTKAHAQTDRMNLQTLRGYYNQSEASSHTLQWMIGCDLGSDGRLLRGYEQYAYDGKDYLALNEDLRSWTAADTAAQISKRKCEAANVAEQRRAYLEGTCVEWLHRYLENGKEMLQRADPPKTHVTHHPVFDYEATLRCWALGFYPAEIILTWQRDGEDQTQDVELVETRPAGDGTFQKWAAVVVPSGEEQRYTCHVQHEGLPEPLMLRWKQSSLPTIPIMGIVAGLVVLAAVVTGAAVAAVLWRKKSSD

SEQ ID NO: 1974 - protein, 377 aa, unidentified
MDSALSDPHNGSAEAGGPTNSTTRPPSTPEGIALAYGSLLLMALLPIFFGALRSVRCARGKNASDMPETITSRDAARFPIIASCTLLGLYLFFKIFSQEYINLLLSMYFFVLGILALSHTISPFMNKFFPASFPNRQYQLLFTQGSGENKEEIINYEFDTKDLVCLGLSSIVGVWYLLRKHWIANNLFGLAFSLNGVELLHLNNVSTGCILLGGLFIYDVFWVFGTNVMVTVAKSFEAPIKLVFPQDLLEKGLEANNFAMLGLGDVVIPGIFIALLLRFDISLKKNTHTYFYTSFAAYIFGLGLTIFIMHIFKHAQPALLYLVPACIGFPVLVALAKGEVTEMFSYEESNPKDPAAVTESKEGTEASASKGLEKKEK

SEQ ID NO: 1975 - protein, 888 aa, unidentified [sequence omitted]

SEQ ID NO: 1976 - protein, 288 aa, unidentified
MERPQPDSMPQDLSEALKEATKEVHTQAENAEFMRNFQKGQVTRDGFKLVMASLYHIYVALEEEIERNKESPVFAPVYFPEELHRKAALEQDLAFWYGPRWQEVIPYTPAMQRYVKRLHEVGRTEPELLVAHAYTRYLGDLSGGQVLKKIAQKALDLPSSGEGLAFFTFPNIASATKFKQLYRSRMNSLEMTPAVRQRVIEEAKTAFLLNIQLFEELQELLTHDTKDQSPSRAPGLRQRASNKVQDSAPVETPRGKPPLNTRSQAPLLRWVLTLSFLVATVAVGLYAM

SEQ ID NO: 1977 - protein, 316 aa, unidentified
MSAEVETSEGVDESEKKNSGALEKENQMRMADLSELLKEGTKEAHDRAENTQFVKDFLKGNIKKELFKLATTALYFTYSALEEEMERNKDHPAFAPLYFPMELHRKEALTKDMEYFFGENWEEQVQCPKAAQKYVERIHYIGQNEPELLVAHAYTRYMGDLSGGQVLKKVAQRALKLPSTGEGTQFYLFENVDNAQQFKQLYRARMNALDLNMKTKERIVEEANKAFEYNMQIFNELDQAGSTLARETLEDGFPVHDGKGDMRKCPFYAAEQDKGALEGSSCPFRTAMAVLRKPSLQFILAAGVALAAGLLAWYYM

SEQ ID NO: 1978 - protein, 304 aa, unidentified
MFNSVNLGNFCSPSRKERGADFGERGSCASNLYLPSCTYYMPEFSTVSSFLPQAPSRQISYPYSAQVPPVREVSYGLEPSGKWHHRNSYSSCYAAADELMHRECLPPSTVTEILMKNEGSYGGHHHPSAPHATPAGFYSSVNKNSVLPQAFDRFFDNAYCGGGDPPAEPPCSGKGEAKGEPEAPPASGLASRAEAGAEAEAEEENTNPSSSGSAHSVAKEPAKGAAPNAPRTRKKRCPYSKFQIRELEREFFFNVYINKEKRLQLSRMLNLTDRQVKIWFQNRRMKEKKLSRDRLQYFSGNPLL

SEQ ID NO: 1979 - protein, 417 aa, unidentified
MAQKEGGRTVPCCSRPKVAALTAGTLLLLTAIGAASWAIVAVLLRSDQEPLYPVQVSSADARLMVFDKTEGTWRLLCSSRSNARVAGLSCEEMGFLRALTHSELDVRTAGANGTSGFFCVDEGRLPHTQRLLEVISVCDCPRGRFLAAICQDCGRRKLPVDRIVGGRDTSLGRWPWQVSLRYDGAHLCGGSLLSGDWVLTAAHCFPERNRVLSRWRVFAGAVAQASPHGLQLGVQAVVYHGGYLPFRDPNSEENSNDIALVHLSSPLPLTEYIQPVCLPAAGQALVDGKICTVTGWGNTQYYGQQAGVLQEARVPIISNDVCNGADFYGNQIKPKMFCAGYPEGGIDACQGDSGGPFVCEDSISRTPRWRLCGIVSWGTGCALAQKPGVYTKVSDFREWIFQAIKTHSEASGMVTQL

SEQ ID NO: 1980 - protein, 839 aa, unidentified
MVQLYNLHPFGSQQVVPCKLEPDRFCGGGRDALFVAAGCKVEAFAVAGQELCQPRCAFSTLGRVLRLAYSEAGISNEISQLESDDFVICQKPLELLGEKSEQSGLSVTLESTGLADEKRKYSHFQHLLYRRFAPDISSYVLSDDIKLHSLQLLPIYQTGSLTSDGKNLSQEKELLSLFCFFSLPHVGYLYMVVKSVELMSVYQYPEKSQQAVLTPQFLHVITSNNLQCFTVRCSAAAAREEDPYMDTTLKACPPVSMDVCALRIQLFIGLKAICHFKNHIILLTKAEPEAIPERRQSPKRLLSRKDTSVKIKIPPVAEAGWNLYIVNTISPVQLYKEMVDYSNTYKTVKTQSCIHLLSEAHLLVRAALMDASQLEPGEKAELLEAFKESCGHLGDCYSRLDSQHSHLTLPYYKMSGLSMAEVLARTDWTVEDGLQKYERGLIFYINHSLYENLDEELNEELAAKVVQMFYVAEPKQVPHILCSPSMKNINPLTAMSYLRKLDTSGFSSILVTLTKAAVALKMGDLDMHRNEMKSHSEMKLVCGFILEPRLLIQQRKGQIVPTELALHLKETQPGLLVASVLGLQKNNKIGIEEADSFFKVLCAKDEDTIPQLLVDFWEAQLVACLPDVVLQELFFKLTSQYIWRLSKRQPPDTTPLRTSEDLINACSHYGLIYPWVHVVISSDSLADKNYTEDLSKLQSLICGPSFDIASIIPFLEPLSEDTIAGLSVHVLCRTRLKEYEQCIDILLERCPEAVIPYANHELKEENRTLWWKKLLPELCQRIKCGGEKYQLYLSSLKETLSIVAVELELKDFMNVLPEDGTATFFLPYLLYCSRKKPLT

SEQ ID NO: 1981 - protein, 162 aa, unidentified
MALARPRPRLGDLIEISRFGYAHWAIYVGDGYVVHLAPASEIAGAGAASVLSALTNKAIVKKELLSVVAGGDNYRVNNKHDDRYTPLPSNKIVKRAEELVGQELPYSLTSDNCEHFVNHLRYGVSRSDQVTGAVTTVGVAAGLLAAASLVGILLARSKRERQ

SEQ ID NO: 1982 - protein, 487 aa, unidentified
MSLPNSSCLLEDKMCEGNKTTMASPQLMPLVVVLSTICLVTVGLNLLVLYAVRSERKLHTVGNLYIVSLSVADLIVGAVVMPMNILYLLMSKWSLGRPLCLFWLSMDYVASTASIFSVFILCIDRYRSVQQPLRYLKYRTKTRASATILGAWFLSFLWVIPILGWNHFMQQTSVRREDKCETDFYDVTWFKVMTAIINFYLPTLLMLWFYAKIYKAVRQHCQHRELINRSLPSFSEIKLRPENPKGDAKKPGKESPWEVLKRKPKDAGGGSVLKSPSQTPKEMKSPVVFSQEDDREVDKLYCFPLDIVHMQAAAEGSSRDYVAVNRSHGQLKTDEQGLNTHGASEISEDQMLGDSQSFSRTDSDTTTETAPGKGKLRSGSNTGLDYIKFTWKRLRSHSRQYVSGLHMNRERKAAKQLGFIMAAFILCWIPYFIFFMVIAFCKNCCNEHLHMFTIWLGYINSTLNPLIYPLCNENFKKTFKRILHIRS

SEQ ID NO: 1983 - protein, 359 aa, unidentified
MAPNGTASSFCLDSTACKITITVVLAVLILITVAGNVVVCLAVGLNRRLRNLTNCFIVSLAITDLLLGLLVLPFSAIYQLSCKWSFGKVFCNIYTSLDVMLCTASILNLFMISLDRYCAVMDPLRYPVLVTPVRVAISLVLIWVISITLSFLSIHLGWNSRNETSKGNHTTSKCKVQVNEVYGLVDGLVTFYLPLLIMCITYYRIFKVARDQAKRINHISSWKAATIREHKATVTLAAVMGAFIICWFPYFTAFVYRGLRGDDAINEVLEAIVLWLGYANSALNPILYAALNRDFRTGYQQLFCCRLANRNSHKTSLRSNASQLSRTQSREPRQQEEKPLKLQVWSGTEVTAPQGATDR

SEQ ID NO: 1984 - protein, 445 aa, unidentified
MERAPPDGPLNASGALAGEAAAAGGARGFSAAWTAVLAALMALLIVATVLGNALVMLAFVADSSLRTQNNFFLLNLAISDFLVGAFCIPLYVPYVLTGRWTFGRGLCKLWLVVDYLLCTSSAFNIVLISYDRFLSVTRAVSYRAQQGDTRRAVRKMLLVWVLAFLLYGPAILSWEYLSGGSSIPEGHCYAEFFYNWYFLITASTLEFFTPFLSVTFFNLSIYLNIQRRTRLRLDGAREAAGPEPPPEAQPSPPPPPGCWGCWQKGHGEAMPLHRYGVGEAAVGAEAGEATLGGGGGGGSVASPTSSSGSSSRGTERPRSLKRGSKPSASSASLEKRMKMVSQSFTQRFRLSRDRKVAKSLAVIVSIFGLCWAPYTLLMIIRAACHGHCVPDYWYETSFWLLWANSAVNPVLYPLCHHSFRRAFTKLLCPQKLKIQPHSSLEHCWK

SEQ ID NO: 1985 - protein, 390 aa, unidentified
MPDTNSTINLSLSTRVTLAFFMSLVAFAIMLGNALVILAFVVDKNLRHRSSYFFLNLAISDFFVGVISIPLYIPHTLFEWDFGKEICVFWLTTDYLLCTASVYNIVLISYDRYLSVSNAVSYRTQHTGVLKIVTLMVAVWVLAFLVNGPMILVSESWKDEGSECEPGFFSEWYILAITSFLEFVIPVILVAYFNMNIYWSLWKRDHLSRCQSHPGLTAVSSNICGHSFRGRLSSRRSLSASTEVPASFHSERQRRKSSLMFSSRTKMNSNTIASKMGSFSQSDSVALHQREHVELLRARRLAKSLAILLGVFAVCWAPYSLFTIVLSFYSSATGPKSVWYRIAFWLQWFNSFVNPLLYPLCHKRFQKAFLKIFCIKKQPLPSQHSRSVSS

SEQ ID NO: 1986 - protein, 91 aa, unidentified
MCPCPLHRGRGPPAVCACSAGRLGLRSSAAQLTAARLKALGDELHQRTMWRRRARSRRAPAPGALPTYWPWLCAAAQVAALAAWLLGRRNL

SEQ ID NO: 1987 - protein, 456 aa, unidentified
MARWPAPPPPPPPPPPLAAPPPPGASAKGPPARKLLFMCTLSLSVTYLCYSLLGGSGSLQFPLALQESPGAAAEPPPSPPPPSLLPTPVRLGAPSQPPAPPPLDNASHGEPPEPPEQPAAPGTDGWGLPSGGGGAQDAWLRTPLAPSEMITAQSALPEREAQESSTTDEDLAGRRAANGSSERGGAVSTPDYGEKKLPQALIIGVKKGGTRALLEAIRVHPDVRAVGVEPHFFDRNYEKGLEWYRNVMPKTLDGQITMEKTPSYFVTNEAPKRIHSMAKDIKLIVVVRNPVTRAISDYTQTLSKKPEIPTFEVLAFKNRTLGLIDASWSAIRIGIYALHLENWLQYFPLSQILFVSGERLIVDPAGEMAKVQDFLGLKRVVTEKHFYFNKTKGFPCLKKPEDSSAPRCLGKSKGRTHPRIDPDVIHRLRKFYKPFNLMFYQMTGQDFQWEQEEGDK

SEQ ID NO: 1988 - protein, 605 aa, unidentified
MALPACAVREFEPPRQPERGAPVRTTCPRRHSRVEAELAASRPGSVAASVRAGPPRGVSHGFHTRPLLDKPRKASSSLAGAACAPLFALLSRGRRRRMHVLRRRWDLGSLCRALLTRGLAALGHSLKHVLGAIFSKIFGPMASVGNMDEKSNKLLLALVMLFLFAVIVLQYVCPGTECQLLRLQAFSSPVPDPYRSEDESSARFVPRYNFTRGDLLRKVDFDIKGDDLIVFLHIQKTGGTTFGRHLVRNIQLEQPCECRVGQKKCTCHRPGKRETWLFSRFSTGWSCGLHADWTELTSCVPSVVDGKRDARLRPSRNFHYITILRDPVSRYLSEWRHVQRGATWKASLHVCDGRPPTSEELPSCYTGDDWSGCPLKEFMDCPYNLANNRQVRMLSDLTLVGCYNLSVMPEKQRNKVLLESAKSNLKHMAFFGLTEFQRKTQYLFEKTFNMNFISPFTQYNTTRASSVEINEEIQKRIEGLNFLDMELYSYAKDLFLQRYQFMRQKEHQEARRKRQEQRKFLKGRLLQTHFQSQGQGQSQNPNQNQSQNPNPNANQNLTQNLMQNLTQSLSQKENRESPKQNSGKEQNDNTSNGTNDYIGSVEKWR

SEQ ID NO: 1989 - protein, 315 aa, unidentified
MKVLLLTGLGALFFAYYWDDNFDPASLQGARVLLTGANAGVGEELAYHYARLGSHLVLTAHTEALLQKVVGNCRKLGAPKVFYIAADMASPEAPESVVQFALDKLGGLDYLVLNHIGGAPAGTRARSPQATRWLMQVNFVSYVQLTSRALPSLTDSKGSLVVVSSLLGRVPTSFSTPYSAAKFALDGFFGSLRRELDVQDVNVAITMCVLGLRDRASAAEAVRSSTSRPRQPEHRGVPLQSQTAMFLPPTVPGARTLTETPLRGWPQPKMKSSRQKSKTEKNDGHLEPVTAWEVQVPRVRRLCRGLARPHLFGHD

SEQ ID NO: 1990 - protein, 405 aa, unidentified
MERWPWPSGGAWLLVAARALLQLLRSDLRLGRPLLAALALLAALDWLCQRLLPPPAALAVLAAAGWIALSRLARPQRLPVATRAVLITGCDSGFGKETAKKLDSMGFTVLATVLELNSPGAIELRTCCSPRLRLLQMDLTKPGDISRVLEFTKAHTTSTGLWGLVNNAGHNEVVADAELSPVATFRSCMEVNFFGALELTKGLLPLLRSSRGRIVTVGSPAGDMPYPCLGAYGTSKAAVALLMDTFSCELLPWGVKVSIIQPGCFKTESVRNVGQWEKRKQLLLANLPQELLQAYGKDYIEHLHGQFLHSLRLAMSDLTPVVDAITDALLAARPRRRYYPGQGLGLMYFIHYYLPEGLRRRFLQAFFISHCLPRALQPGQPGTTPPQDAAQDPNLSPGPSPAVAR

SEQ ID NO: 1991 - protein, 312 aa, unidentified
MESALPAAGFLYWVGAGTVAYLALRISYSLFTALRVWGVGNEAGVGPGLGEWAVVTGSTDGIGKSYAEELAKHGMKVVLISRSKDKLDQVSSEIKEKFKVETRTIAVDFASEDIYDKIKTGLAGLEIGILVNNVGMSYEYPEYFLDVPDLDNVIKKMININILSVCKMTQLVLPGMVERSKGAILNISSGSGMLPVPLLTIYSATKTFVDFFSQCLHEEYRSKGVFVQSVLPYFVATKLAKIRKPTLDKPSPETFVKSAIKTVGLQSRTNGYLIHALMGSIISNLPSWIYLKIVMNMNKSTRAHYLKKTKKN

SEQ ID NO: 1992 - protein, 387 aa, unidentified
MSTFFSDTAWICLAVPTVLCGTVFCKYKKSSGQLWSWMVCLAGLCAVCLLILSPFWGLILFSVSCFLMYTYLSGQELLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 1993 - protein, 310 aa, unidentified
MGDVLEQFFILTGLLVCLACLAKCVRFSRCVLLNYWKVLPKSFLRSMGQWAVITGAGDGIGKAYSFELAKRGLNVVLISRTLEKLEAIATEIERTTGRSVKIIQADFTKDDIYEHIKEKLAGLEIGILVNNVGMLPNLLPSHFLNAPDEIQSLIHCNITSVVKMTQLILKHMESRQKGLILNISSGIALFPWPLYSMYSASKAFVCAFSKALQEEYKAKEVIIQVLTPYAVSTAMTKYLNTNVITKTADEFVKESLNYVTIGGETCGCLAHEILAGFLSLIPAWAFYSGAFQRLLLTHYVAYLKLNTKVR

SEQ ID NO: 1994 - protein, 341 aa, unidentified
MRKVVLITGASSGIGLALCKRLLAEDDELHLCLACRNMSKAEAVCAALLASHPTAEVTIVQVDVSNLQSVFRASKELKQRFQRLDCIYLNAGIMPNPQLNIKALFFGLFSRKVIHMFSTAEGLLTQGDKITADGLQEVFETNVFGHFILIRELEPLLCHSDNPSQLIWTSSRSARKSNFSLEDFQHSKGKEPYSSSKYATDLLSVALNRNFNQQGLYSNVACPGTALTNLTYGILPPFIWTLLMPAILLLRFFANAFTLTPYNGTEALVWLFHQKPESLNPLIKYLSATTGFGRNYIMTQKMDLDEDTAEKFYQKLLELEKHIRVTIQKTDNQARLSGSCL

SEQ ID NO: 1995 - protein, 373 aa, unidentified
MTGWSCLVTGAGGFLGQRIIRLLVKEKELKEIRVLDKAFGPELREEFSKLQNKTKLTVLEGDILDEPFLKRACQDVSVIIHTACIIDVFGVTHRESIMNVNVKGTQLLLEACVQASVPVFIYTSSIEVAGPNSYKEIIQNGHEEEPLENTWPAPYPHSKKLAEKAVLAANGWNLKNGGTLYTCALRPMYIYGEGSRFLSASINEALNNNGILSSVGKFSTVNPVYVGNVAWAHILALRALQDPKKAPSIRGQFYYISDDTPHQSYDNLNYTLSKEFGLRLDSRWSFPLSLMYWIGFLLEIVSFLLRPIYTYRPPFNRHIVTLSNSVFTFSYKKAQRDLAYKPLYSWEEAKQKTVEWVGSLVDRHKETLKSKTQ

SEQ ID NO: 1996 - protein, 372 aa, unidentified
MGWSCLVTGAGGLLGQRIVRLLVEEKELKEIRALDKAFRPELREEFSKLQNRTKLTVLEGDILDEPFLKRACQDVSVVIHTACIIDVFGVTHRESIMNVNVKGTQLLLEACVQASVPVFIYTSSIEVAGPNSYKEIIQNGHEEEPLENTWPTPYPYSKKLAEKAVLAANGWNLKNGDTLYTCALRPTYIYGEGGPFLSASINEALNNNGILSSVGKFSTVNPVYVGNVAWAHILALRALRDPKKAPSVRGQFYYISDDTPHQSYDNLNYILSKEFGLRLDSRWSLPLTLMYWIGFLLEVVSFLLSPIYSYQPPFNRHTVTLSNSVFTFSYKKAQRDLAYKPLYSWEEAKQKTVEWVGSLVDRHKETLKSKTQ

SEQ ID NO: 1997 - protein, 369 aa, unidentified
MADSAQAQKLVYLVTGGCGFLGEHVVRMLLQREPRLGELRVFDQHLGPWLEELKTGPVRVTAIQGDVTQAHEVAAAVAGAHVVIHTAGLVDVFGRASPKTIHEVNVQGTRNVIEACVQTGTRFLVYTSSMEVVGPNTKGHPFYRGNEDTPYEAVHRHPYPCSKALAEWLVLEANGRKVRGGLPLVTCALRPTGIYGEGHQIMRDFYRQGLRLGGWLFRAIPASVEHGRVYVGNVAWMHVLAARELEQRATLMGGQVYFCYDGSPYRSYEDFNMEFLGPCGLRLVGARPLLPYWLLVFLAALNALLQWLLRPLVLYAPLLNPYTLAVANTTFTVSTDKAQRHFGYEPLFSWEDSRTRTILWVQAATGSAQ

SEQ ID NO: 1998 - protein, 330 aa, unidentified
MAAVDSFYLLYREIARSCNCYMEALALVGAWYTARKSITVICDFYSLIRLHFIPRLGSRADLIKQYGRWAVVSGATDGIGKAYAEELASRGLNIILISRNEEKLQVVAKDIADTYKVETDIIVADFSSGREIYLPIREALKDKDVGILVNNVGVFYPYPQYFTQLSEDKLWDIINVNIAAASLMVHVVLPGMVERKKGAIVTISSGSCCKPTPQLAAFSASKAYLDHFSRALQYEYASKGIFVQSLIPFYVATSMTAPSNFLHRCSWLVPSPKVYAHHAVSTLGISKRTTGYWSHSIQFLFAQYMPEWLWVWGANILNRSLRKEALSCTA

SEQ ID NO: 1999 - protein, 242 aa, unidentified
MAETEALSKLREDFRMQNKSVFILGASGETGRVLLKEILEQGLFSKVTLIGRRKLTFDEEAYKNVNQEVVDFEKLDDYASAFQGHDVGFCCLGTTRGKAGAEGFVRVDRDYVLKSAELAKAGGCKHFNLLSSKGADKSSNFLYLQVKGEVEAKVEELKFDRYSVFRPGVLLCDRQESRPGEWLVRKFFGSLPDSWASGHSVPVVTVVRAMLNNVVRPRDKQMELLENKAIHDLGKAHGSLKP

SEQ ID NO: 2000 - protein, 422 aa, unidentified
MDVLSPGQGNNTTSPPAPFETGGNTTGISDVTVSYQVITSLLLGTLIFCAVLGNACVVAAIALERSLQNVANYLIGSLAVTDLMVSVLVLPMAALYQVLNKWTLGQVTCDLFIALDVLCCTSSILHLCAIALDRYWAITDPIDYVNKRTPRRAAALISLTWLIGFLISIPPMLGWRTPEDRSDPDACTISKDHGYTIYSTFGAFYIPLLLMLVLYGRIFRAARFRIRKTVKKVEKTGADTRHGASPAPQPKKSVNGESGSRNWRLGVESKAGGALCANGAVRQGDDGAALEVIEVHRVGNSKEHLPLPSEAGPTPCAPASFERKNERNAEAKRKMALARERKTVKTLGIIMGTFILCWLPFFIVALVLPFCESSCHMPTLLGAIINWLGYSNSLLNPVIYAYFNKDFQNAFKKIIKCKFCRQ

SEQ ID NO: 2001 - protein, 390 aa, unidentified
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQLITDSPGSTSSVTSINSRVPDVPSESGSPVYVNQVKVRVSDALLEKKKLMAARERKATKTLGIILGAFIVCWLPFFIISLVMPICKDACWFHLAIFDFFTWLGYLNSLINPIIYTMSNEDFKQAFHKLIRFKCTS

SEQ ID NO: 2002 - protein, 377 aa, unidentified
MSPLNQSAEGLPQEASNRSLNATETSEAWDPRTLQALKISLAVVLSVITLATVLSNAFVLTTILLTRKLHTPANYLIGSLATTDLLVSILVMPISIAYTITHTWNFGQILCDIWLSSDITCCTASILHLCVIALDRYWAITDALEYSKRRTAGHAATMIAIVWAISICISIPPLFWRQAKAQEEMSDCLVNTSQISYTIYSTCGAFYIPSVLLIILYGRIYRAARNRILNPPSLYGKRFTTAHLITGSAGSSLCSLNSSLHEGHSHSAGSPLFFNHVKIKLADSALERKRISAARERKATKILGIILGAFIICWLPFFVVSLVLPICRDSCWIHPALFDFFTWLGYLNSLINPIIYTVFNEEFRQAFQKIVPFRKAS

SEQ ID NO: 2003 - protein, 365 aa, unidentified
MNITNCTTEASMAIRPKTITEKMLICMTLVVITTLTTLLNLAVIMAIGTTKKLHQPANYLICSLAVTDLLVAVLVMPLSIIYIVMDRWKLGYFLCEVWLSVDMTCCTCSILHLCVIALDRYWAITNAIEYARKRTAKRAALMILTVWTISIFISMPPLFWRSHRRLSPPPSQCTIQHDHVIYTIYSTLGAFYIPLTLILILYYRIYHAAKSLYQKRGSSRHLSNRSTDSQNSFASCKLTQTFCVSDFSTSDPTTEFEKFHASIRIPPFDNDLDHPGERQQISSTRERKAARILGLILGAFILSWLPFFIKELIVGLSIYTVSSEVADFLTWLGYVNSLINPLLYTSFNEDFKLAFKKLIRCREHT

SEQ ID NO: 2004 - protein, 366 aa, unidentified
MDFLNSSDQNLTSEELLNRMPSKILVSLTLSGLALMTTTINSLVIAAIIVTRKLHHPANYLICSLAVTDFLVAVLVMPFSIVYIVRESWIMGQVVCDIWLSVDITCCTCSILHLSAIALDRYRAITDAVEYARKRTPKHAGIMITIVWIISVFISMPPLFWRHQGTSRDDECIIKHDHIVSTIYSTFGAFYIPLALILILYYKIYRAAKTLYHKRQASRIAKEEVNGQVLLESGEKSTKSVSTSYVLEKSLSDPSTDFDKIHSTVRSLRSEFKHEKSWRRQKISGTRERKAATTLGLILGAFVICWLPFFVKELVVNVCDKCKISEEMSNFLAWLGYLNSLINPLIYTIFNEDFKKAFQKLVRCRC

SEQ ID NO: 2005 - protein, 471 aa, unidentified
MDILCEENTSLSSTTNSLMQLNDDTRLYSNDFNSGEANTSDAFNWTVDSENRTNLSCEGCLSPSCLSLLHLQEKNWSALLTAVVIILTIAGNILVIMAVSLEKKLQNATNYFLMSLAIADMLLGFLVMPVSMLTILYGYRWPLPSKLCAVWIYLDVLFSTASIMHLCAISLDRYVAIQNPIHHSRFNSRTKAFLKIIAVWTISVGISMPIPVFGLQDDSKVFKEGSCLLADDNFVLIGSFVSFFIPLTIMVITYFLTIKSLQKEATLCVSDLGTRAKLASFSFLPQSSLSSEKLFQRSIHREPGSYTGRRTMQSISNEQKACKVLGIVFFLFVVMWCPFFITNIMAVICKESCNEDVIGALLNVFVWIGYLSSAVNPLVYTLFNKTYRSAFSRYIQCQYKENKKPLQLILVNTIPALAYKSSQLQMGQKKNSKQDAKTTDNDCSMVALGKQHSEEASKDNSDGVNEKVSCV

SEQ ID NO: 2006 - protein, 481 aa, unidentified
MALSYRVSELQSTIPEHILQSTFVHVISSNWSGLQTESIPEEMKQIVEEQGNKLHWAALLILMVIIPTIGGNTLVILAVSLEKKLQYATNYFLMSLAVADLLVGLFVMPIALLTIMFEAMWPLPLVLCPAWLFLDVLFSTASIMHLCAISVDRYIAIKKPIQANQYNSRATAFIKITVVWLISIGIAIPVPIKGIETDVDNPNNITCVLTKERFGDFMLFGSLAAFFTPLAIMIVTYFLTIHALQKKAYLVKNKPPQRLTWLTVSTVFQRDETPCSSPEKVAMLDGSRKDKALPNSGDETLMRRTSTIGKKSVQTISNEQRASKVLGIVFFLFLLMWCPFFITNITLVLCDSCNQTTLQMLLEIFVWIGYVSSGVNPLVYTLFNKTFRDAFGRYITCNYRATKSVKTLRKRSSKIYFRNPMAENSKFFKKHGIRNGINPAMYQSPMRLRSSTIQSSSIILLDTLLLTENEGDKTEEQVSYV

SEQ ID NO: 2007 - protein, 458 aa, unidentified
MVNLRNAVHSFLVHLIGLLVWQCDISVSPVAAIVTDIFNTSDGGRFKFPDGVQNWPALSIVIIIIMTIGGNILVIMAVSMEKKLHNATNYFLMSLAIADMLVGLLVMPLSLLAILYDYVWPLPRYLCPVWISLDVLFSTASIMHLCAISLDRYVAIRNPIEHSRFNSRTKAIMKIAIVWAISIGVSVPIPVIGLRDEEKVFVNNTTCVLNDPNFVLIGSFVAFFIPLTIMVITYCLTIYVLRRQALMLLHGHTEEPPGLSLDFLKCCKRNTAEEENSANPNQDQNARRRKKKERRPRGTMQAINNERKASKVLGIVFFVFLIMWCPFFITNILSVLCEKSCNQKLMEKLLNVFVWIGYVCSGINPLVYTLFNKIYRRAFSNYLRCNYKVEKKPPVRQIPRVAATALSGRELNVNIYRHTNEPVIEKASDNEPGIEMQVENLELPVNPSSVVSERISSV

SEQ ID NO: 2008 - protein, 478 aa, unidentified
MLLWVQQALLALLLPTLLAQGEARRSRNTTRPALLRLSDYLLTNYRKGVRPVRDWRKPTTVSIDVIVYAILNVDEKNQVLTTYIWYRQYWTDEFLQWNPEDFDNITKLSIPTDSIWVPDILINEFVDVGKSPNIPYVYIRHQGEVQNYKPLQVVTACSLDIYNFPFDVQNCSLTFTSWLHTIQDINISLWRLPEKVKSDRSVFMNQGEWELLGVLPYFREFSMESSNYYAEMKFYVVIRRRPLFYVVSLLLPSIFLMVMDIVGFYLPPNSGERVSFKITLLLGYSVFLIIVSDTLPATAIGTPLIGVYFVVCMALLVISLAETIFIVRLVHKQDLQQPVPAWLRHLVLERIAWLLCLREQSTSQRPPATSQATKTDDCSAMGNHCSHMGGPQDFEKSPRDRCSPPPPPREASLAVCGLLQELSSIRQFLEKRDEIREVARDWLRVGSVLDKLLFHIYLLAVLAYSITLVMLWSIWQYA

SEQ ID NO: 2009 - protein, 441 aa, unidentified
MLSSVMAPLWACILVAAGILATDTHHPQDSALYHLSKQLLQKYHKEVRPVYNWTKATTVYLDLFVHAILDVDAENQILKTSVWYQEVWNDEFLSWNSSMFDEIREISLPLSAIWAPDIIINEFVDIERYPDLPYVYVNSSGTIENYKPIQVVSACSLETYAFPFDVQNCSLTFKSILHTVEDVDLAFLRSPEDIQHDKKAFLNDSEWELLSVSSTYSILQSSAGGFAQIQFNVVMRRHPLVYVVSLLIPSIFLMLVDLGSFYLPPNCRARIVFKTSVLVGYTVFRVNMSNQVPRSVGSTPLIGHFFTICMAFLVLSLAKSIVLVKFLHDEQRGGQEQPFLCLRGDTDADRPRVEPRAQRAVVTESSLYGEHLAQPGTLKEVWSQLQSISNYLQTQDQTDQQEAEWLVLLSRFDRLLFQSYLFMLGIYTITLCSLWALWGGV

SEQ ID NO: 2010 - protein, 447 aa, unidentified
MEGGWPARQSALLCLTVSLLLQGRGDAFTINCSGFDQHGVDPAVFQAVFDRKAFRPFTNYSIPTRVNISFTLSAILGVDAQLQLLTSFLWMDLVWDNPFINWNPKECVGINKLTVLAENLWLPDIFIVESMDVDQTPSGLTAYISSEGRIKYDKPMRVTSICNLDIFYFPFDQQNCTFTFSSFLYTVDSMLLGMDKEVWEITDTSRKVIQTQGEWELLGINKATPKMSMGNNLYDQIMFYVAIRRRPSLYIINLLVPSSFLVAIDALSFYLPAESENRAPFKITLLLGYNVFLLMMNDLLPASGTPLISVYFALCLSLMVVSLLETVFITYLLHVATTQPPPMPRWLHSLLLHCTSPGRCCPTAPQKGNKGLGLTLTHLPGPKEPGELAGKKLGPRETEPDGGSGWTKTQLMELWVQFSHAMDTLLFRLYLLFMASSILTVIVLWNT

SEQ ID NO: 2011 - protein, 454 aa, unidentified
MQKHSPGPPALALLSQSLLTTGNGDTLIINCPGFGQHRVDPAAFQAVFDRKAIGPVTNYSVATHVNISFTLSAIWNCYSRIHTFNCHHARPWHNQFVQWNPDECGGIKKSGMATENLWLSDVFIEESVDQTPAGLMASMSIVKATSNTISQCGWSASANWTPSISPSMDRARAWRRMSRSFQIHHRTSFRTRREWVLLGIQKRTIKVTVATNQYEQAIFHVAIRRRCRPSPYVVNFLVPSGILIAIDALSFYLPLESGNCAPFKMTVLLGYSVFLLMMNDLLPATSTSSHASLVAPLALMQTPLPAGVYFALCLSLMVGSLLETIFITHLLHVATTQPLPLPRWLHSLLLHCTGQGRCCPTAPQKGNKGPGLTPTHLPGVKEPEVSAGQMPGPGEAELTGGSEWTRAQREHEAQKQHSVELWVQFSHAMDALLFRLYLLFMASSIITVICLWNT

SEQ ID NO: 2012 - protein, 456 aa, unidentified
MEGSWFHRKRFSFYLLLGFLLQGRGVTFTINCSGFGQHGADPTALNSVFNRKPFRPVTNISVPTQVNISFAMSAILDVNEQLHLLSSFLWLEMVWDNPFISWNPEECEGITKMSMAAKNLWLPDIFIIELMDVDKTPKGLTAYVSNEGRIRYKKPMKVDSICNLDIFYFPFDQQNCTLTFSSFLYTVDSMLLDMEKEVWEITDASRNILQTHGEWELLGLSKATAKLSRGGNLYDQIVFYVAIRRRPSLYVINLLVPSGFLVAIDALSFYLPVKSGNRVPFKITLLLGYNVFLLMMSDLLPTSGTPLIGVYFALCLSLMVGSLLETIFITHLLHVATTQPPPLPRWLHSLLLHCNSPGRCCPTAPQKENKGPGLTPTHLPGVKEPEVSAGQMPGPAEAELTGGSEWTRAQREHEAQKQHSVELWLQFSHAMDAMLFRLYLLFMASSIITVICLWNT

SEQ ID NO: 2013 - protein, 388 aa, unidentified
MDKLDANVSSEEGFGSVEKVVLLTFLSTVILMAILGNLLVMVAVCWDRQLRKIKTNYFIVSLAFADLLVSVLVMPFGAIELVQDIWIYGEVFCLVRTSLDVLLTTASIFHLCCISLDRYYAICCQPLVYRNKMTPLRIALMLGGCWVIPTFISFLPIMQGWNNIGIIDLIEKRKFNQNSNSTYCVFMVNKPYAITCSVVAFYIPFLLMVLAYYRIYVTAKEHAHQIQMLQRAGASSESRPQSADQHSTHRMRTETKAAKTLCIIMGCFCLCWAPFFVTNIVDPFIDYTVPGQVWTAFLWLGYINSGLNPFLYAFLNKSFRRAFLIILCCDDERYRRPSILGQTVPCSTTTINGSTHVLRDAVECGGQWESQCHPPATSPLVAAQPSDT

SEQ ID NO: 2014 - protein, 357 aa, unidentified
MDLPVNLTSFSLSTPSPLETNHSLGKDDLRPSSPLLSVFGVLILTLLGFLVAATFAWNLLVLATILRVRTFHRVPHNLVASMAVSDVLVAALVMPLSLVHELSGRRWQLGRRLCQLWIACDVLCCTASIWNVTAIALDRYWSITRHMEYTLRTRKCVSNVMIALTWALSAVISLAPLLFGWGETYSEGSEECQVSREPSYAVFSTVGAFYLPLCVVLFVYWKIYKAAKFRVGSRKTNSVSPISEAVEVKDSAKQPQMVFTVRHATVTFQPEGDTWREQKEQRAALMVGILIGVFVLCWIPFFLTELISPLCSCDIPAIWKSIFLWLGYSNSFFNPLIYTAFNKNYNSAFKNFFSRQH

SEQ ID NO: 2015 - protein, 440 aa, unidentified
MVPEPGPTANSTPAWGAGPPSAPGGSGWVAAALCVVIALTAAANSLLIALICTQPALRNTSNFFLVSLFTSDLMVGLVVMPPAMLNALYGRWVLARGLCLLWTAFDVMCCSASILNLCLISLDRYLLILSPLRYKLRMTPLRALALVLGAWSLAALASFLPLLLGWHELGHARPPVPGQCRLLASLPFVLVASGLTFFLPSGAICFTYCRILLAARKQAVQVASLTTGMASQASETLQVPRTPRPGVESADSRRLATKHSRKALKASLTLGILLGMFFVTWLPFFVANIVQAVCDCISPGLFDVLTWLGYCNSTMNPIIYPLFMRDFKRALGRFLPCPRCPRERQASLASPSLRTSHSGPRPGLSLQQVLPLPLPPDSDSDSDAGSGGSSGLRLTAQLLLPGEATQDPPLPTRAAAAVNFFNIDPAEPELRPHPLGIPTN

SEQ ID NO: 2016 - protein, 479 aa, unidentified
MMDVNSSGRPDLYGHLRSFLLPEVGRGLPDLSPDGGADPVAGSWAPHLLSEVTASPAPTWDAPPDNASGCGEQINYGRVEKVVIGSILTLITLLTIAGNCLVVISVCFVKKLRQPSNYLIVSLALADLSVAVAVMPFVSVTDLIGGKWIFGHFFCNVFIAMDVMCCTASIMTLCVISIDRYLGITRPLTYPVRQNGKCMAKMILSVWLLSASITLPPLFGWAQNVNDDKVCLISQDFGYTIYSTAVAFYIPMSVMLFMYYQIYKAARKSAAKHKFPGFPRVEPDSVIALNGIVKLQKEVEECANLSRLLKHERKNISIFKREQKAATTLGIIVGAFTVCWLPFFLLSTARPFICGTSCSCIPLWVERTFLWLGYANSLINPFIYAFFNRDLRTTYRSLLQCQYRNINRKLSAAGMHEALKLAERPERPEFVLRACTRRVLLRPEKRPPVSVWVLQSPDHHNWLADKMLTTVEKKVMIHD

SEQ ID NO: 2017 - protein, 458 aa, unidentified
MAAPRAGRGAGWSLRAWRALGGIRWGRRPRLTPDLRALLTSGTSDPRARVTYGTPSLWARLSVGVTEPRACLTSGTPGPRAQLTAVTPDTRTREASENSGTRSRAWLAVALGAGGAVLLLLWGGGRGPPAVLAAVPSPPPASPRSQYNFIADVVEKTAPAVVYIEILDRHPFLGREVPISNGSGFVVAADGLIVTNAHVVADRRRVRVRLLSGDTYEAVVTAVDPVADIATLRIQTKEPLPTLPLGRSADVRQGEFVVAMGSPFALQNTITSGIVSSAQRPARDLGLPQTNVEYIQTDAAIDFGNSGGPLVNLDGEVIGVNTMKVTAGISFAIPSDRLREFLHRGEKKNSSSGISGSQRRYIGVMMLTLSPSILAELQLREPSFPDVQHGVLIHKVILGSPAHRAGLRPGDVILAIGEQMVQNAEDVYEAVRTQSQLAVQIRRGRETLTLYVTPEVTE

SEQ ID NO: 2018 - protein, 3142 aa, unidentified
MATLEKLMKAFESLKSFQQQQQQQQQQQQQQQQQQQQQPPPPPPPPPPPQLPQPPPQAQPLLPQPQPPPPPPPPPPGPAVAEEPLHRPKKELSATKKDRVNHCLTICENIVAQSVRNSPEFQKLLGIAMELFLLCSDDAESDVRMVADECLNKVIKALMDSNLPRLQLELYKEIKKNGAPRSLRAALWRFAELAHLVRPQKCRPYLVNLLPCLTRTSKRPEESVQETLAAAVPKIMASFGNFANDNEIKVLLKAFIANLKSSSPTIRRTAAGSAVSICQHSRRTQYFYSWLLNVLLGLLVPVEDEHSTLLILGVLLTLRYLVPLLQQQVKDTSLKGSFGVTRKEMEVSPSAEQLVQVYELTLHHTQHQDHNVVTGALELLQQLFRTPPPELLQTLTAVGGIGQLTAAKEESGGRSRSGSIVELIAGGGSSCSPVLSRKQKGKVLLGEEEALEDDSESRSDVSSSALTASVKDEISGELAASSGVSTPGSAGHDIITEQPRSQHTLQADSVDLASCDLTSSATDGDEEDILSHSSSQVSAVPSDPAMDLNDGTQASSPISDSSQTTTEGPDSAVTPSDSSEIVLDGTDNQYLGLQIGQPQDEDEEATGILPDEASEAFRNSSMALQQAHLLKNMSHCRQPSDSSVDKFVLRDEATEPGDQENKPCRIKGDIGQSTDDDSAPLVHCVRLLSASFLLTGGKNVLVPDRDVRVSVKALALSCVGAAVALHPESFFSKLYKVPLDTTEYPEEQYVSDILNYIDHGDPQVRGATAILCGTLICSILSRSRFHVGDWMGTIRTLTGNTFSLADCIPLLRKTLKDESSVTCKLACTAVRNCVMSLCSSSYSELGLQLIIDVLTLRNSSYWLVRTELLETLAEIDFRLVSFLEAKAENLHRGAHHYTGLLKLQERVLNNVVIHLLGDEDPRVRHVAAASLIRLVPKLFYKCDQGQADPVVAVARDQSSVYLKLLMHETQPPSHFSVSTITRIYRGYNLLPSITDVTMENNLSRVIAAVSHELITSTTRALTFGCCEALCLLSTAFPVCIWSLGWHCGVPPLSASDESRKSCTVGMATMILTLLSSAWFPLDLSAHQDALILAGNLLAASAPKSLRSSWASEEEANPAATKQEEVWPALGDRALVPMVEQLFSHLLKVINICAHVLDDVAPGPAIKAALPSLTNPPSLSPIRRKGKEKEPGEQASVPLSPKKGSEASAASRQSDTSGPVTTSKSSSLGSFYHLPSYLKLHDVLKATHANYKVTLDLQNSTEKFGGFLRSALDVLSQILELATLQDIGKCVEEILGYLKSCFSREPMMATVCVQQLLKTLFGTNLASQFDGLSSNPSKSQGRAQRLGSSSVRPGLYHYCFMAPYTHFTQALADASLRNMVQAEQENDTSGWFDVLQKVSTQLKTNLTSVTKNRADKNAIHNHIRLFEPLVIKALKQYTTTTCVQLQKQVLDLLAQLVQLRVNYCLLDSDQVFIGFVLKQFEYIEVGQFRESEAIIPNIFFFLVLLSYERYHSKQIIGIPKIIQLCDGIMASGRKAVTHAIPALQPIVHDLFVLRGTNKADAGKELETQKEVVVSMLLRLIQYHQVLEMFILVLQQCHKENEDKWKRLSRQIADIILPMLAKQQMHIDSHEALGVLNTLFEILAPSSLRPVDMLLRSMFVTPNTMASVSTVQLWISGILAILRVLISQSTEDIVLSRIQELSFSPYLISCTVINRLRDGDSTSTLEEHSEGKQIKNLPEETFSRFLLQLVGILLEDIVTKQLKVEMSEQQHTFYCQELGTLLMCLIHIFKSGMFRRITAAATRLFRSDGCGGSFYTLDSLNLRARSMITTHPALVLLWCQILLLVNHTDYRWWAEVQQTPKRHSLSSTKLLSPQMSGEEEDSDLAAKLGMCNREIVRRGALILFCDYVCQNLHDSEHLTWLIVNHIQDLISLSHEPPVQDFISAVHRNSAASGLFIQAIQSRCENLSTPTMLKKTLQCLEGIHLSQSGAVLTLYVDRLLCTPFRVLARMVDILACRRVEMLLAANLQSSMAQLPMEELNRIQEYLQSSGLAQRHQRLYSLLDRFRLSTMQDSLSPSPPVSSHPLDGDGHVSLETVSPDKDWYVHLVKSQCWTRSDSALLEGAELVNRIPAEDMNAFMMNSEFNLSLLAPCLSLGMSEISGGQKSALFEAAREVTLARVSGTVQQLPAVHHVFQPELPAEPAAYWSKLNDLFGDAALYQSLPTLARALAQYLVVVSKLPSHLHLPPEKEKDIVKFVVATLEALSWHLIHEQIPLSLDLQAGLDCCCLALQLPGLWSVVSSTEFVTHACSLIYCVHFILEAVAVQPGEQLLSPERRTNTPKAISEEEEEVDPNTQNPKYITAACEMVAEMVESLQSVLALGHKRNSGVPAFLTPLLRNIIISLARLPLVNSYTRVPPLVWKLGWSPKPGGDFGTAFPEIPVEFLQEKEVFKEFIYRINTLGWTSRTQFEETWATLLGVLVTQPLVMEQEESPPEEDTERTQINVLAVQAITSLVLSAMTVPVAGNPAVSCLEQQPRNKPLKALDTRFGRKLSIIRGIVEQEIQAMVSKRENIATHHLYQAWDPVPSLSPATTGALISHEKLLLQINPERELGSMSYKLGQVSIHSVWLGNSITPLREEEWDEEEEEEADAPAPSSPPTSPVNSRKHRAGVDIHSCSQFLLELYSRWILPSSSARRTPAILISEVVRSLLVVSDLFTERNQFELMYVTLTELRRVHPSEDEILAQYLVPATCKAAAVLGMDKAVAEPVSRLLESTLRSSHLPSRVGALHGVLYVLECDLLDDTAKQLIPVISDYLLSNLKGIAHCVNIHSQQHVLVMCATAFYLIENYPLDVGPEFSASIIQMCGVMLSGSEESTPSIIYHCALRGLERLLLSEQLSRLDAESLVKLSVDRVNVHSPHRAMAALGLMLTCMYTGKEKVSPGRTSDPNPAAPDSESVIVAMERVSVLFDRIRKGFPCEARVVARILPQFLDDFFPPQDIMNKVIGEFLSNQQPYPQFMATVVYKVFQTLHSTGQSSMVRDWVMLSLSNFTQRAPVAMATWSLSCFFVSASTSPWVAAILPHVISRMGKLEQVDVNLFCLVATDFYRHQIEEELDRRAFQSVLEVVAAPGSPYHRLLTCLRNVHKVTTC

SEQ ID NO: 2019 - protein, 4374 aa, unidentified
MKVDRTKLKKTPTEAPADCRALIDKLKVCNDEQLLLELQQIKTWNIGKCELYHWVDLLDRFDGILADAGQTVENMSWMLVCDRPEREQLKMLLLAVLNFTALLIEYSFSRHLYSSIEHLTTLLASSDMQVVLAVLNLLYVFSKRSNYITRLGSDKRTPLLTRLQHLAESWGGKENGFGLAECCRDLHMMKYPPSATTLHFEFYADPGAEVKIEKRTTSNTLHYIHIEQLDKISESPSEIMESLTKMYSIPKDKQMLLFTHIRLAHGFSNHRKRLQAVQARLHAISILVYSNALQESANSILYNGLIEELVDVLQITDKQLMEIKAASLRTLTSIVHLERTPKLSSIIDCTGTASYHGFLPVLVRNCIQAMIDPSMDPYPHQFATALFSFLYHLASYDAGGEALVSCGMMEALLKVIKFLGDEQDQITFVTRAVRVVDLITNLDMAAFQSHSGLSIFIYRLEHEVDLCRKECPFVIKPKIQRPNTTQEGEEMETDMDGVQCIPQRAALLKSMLNFLKKAIQDPAFSDGIRHVMDGSLPTSLKHIISNAEYYGPSLFLLATEVVTVFVFQEPSLLSSLQDNGLTDVMLHALLIKDVPATREVLGSLPNVFSALCLNARGLQSFVQCQPFERLFKVLLSPDYLPAMRRRRSSDPLGDTASNLGSAVDELMRHQPTLKTDATTAIIKLLEEICNLGRDPKYICQKPSIQKADGTATAPPPRSNHAAEEASSEDEEEEEVQAMQSFNSTQQNETEPNQQVVGTEERIPIPLMDYILNVMKFVESILSNNTTDDHCQEFVNQKGLLPLVTILGLPNLPIDFPTSAACQAVAGVCKSILTLSHEPKVLQEGLLQLDSILSSLEPLHRPIESPGGSVLLRELACAGNVADATLSAQATPLLHALTAAHAYIMMFVHTCRVGQSEIRSISVNQWGSQLGLSVLSKLSQLYCSLVWESTVLLSLCTPNSLPSGCEFGQADMQKLVPKDEKAGTTQGGKRSDGEQDGAAGSMDASTQGLLEGIGLDGDTLAPMETDEPTASDSKGKSKITPAMAARIKQIKPLLSASSRLGRALAELFGLLVKLCVGSPVRQRRSHHAASTTTAPTPAARSTASALTKLLTKGLSWQPPPYTPTPRFRLTFFICSVGFTSPMLFDERKYPYHLMLQKFLCSGGHNALFETFNWALSMGGKVPVSEGLEHSDLPDGTGEFLDAWLMLVEKMVNPTTVLESPHSLPAKLPGGVQNFPQFSALRFLVVTQKAAFTCIKNLWNRKPLKVYGGRMAESMLAILCHILRGEPVIRERLSKEKEGSRGEEDTGQEEGGSRREPQVNQQQLQQLMDMGFTREHAMEALLNTSTMEQATEYLLTHPPPIMGGVVRDLSMSEEDQMMRAIAMSLGQDIPMDQRAESPEEVACRKEEEERKAREKQEEEEAKCLEKFQDADPLEQDELHTFTDTMLPGCFHLLDELPDTVYRVCDLIMTAIKRNGADYRDMILKQVVNQVWEAADVLIKAALPLTTSDTKTVSEWISQMATLPQASNLATRILLLTLLFEELKLPCAWVVESSGILNVLIKLLEVVQPCLQAAKEQKEVQTPKWITPVLLLIDFYEKTAISSKRRAQMTKYLQSNSNNWRWFDDRSGRWCSYSASNNSTIDSAWKSGETSVRFTAGRRRYTVQFTTMVQVNEETGNRRPVMLTLLRVPRLNKNSKNSNGQELEKTLEESKEMDIKRKENKGNDTPLALESTNTEKETSLEETKIGEILIQGLTEDMVTVLIRACVSMLGVPVDPDTLHATLRLCLRLTRDHKYAMMFAELKSTRMILNLTQSSGFNGFTPLVTLLLRHIIEDPCTLRHTMEKVVRSAATSGAGSTTSGVVSGSLGSREINYILRVLGPAACRNPDIFTEVANCCIRIALPAPRGSGTASDDEFENLRIKGPNAVQLVKTTPLKPSPLPVIPDTIKEVIYDMLNALAAYHAPEEADKSDPKPGVMTQEVGQLLQDMGDDVYQQYRSLTRQSSDFDTQSGFSINSQVFAADGASTETSASGTSQGEASTPEESRDGKKDKEGDRASEEGKQKGKGSKPLMPTSTILRLLAELVRSYVGIATLIANYSYTVGQSELIKEDCSVLAFVLDHLLPHTQNAEDKDTPALARLFLASLAAAGSGTDAQVALVNEVKAALGRALAMAESTEKHARLQAVMCIISTIMESCPSTSSFYSSATAKTQHNGMNNIIRLFLKKGLVNDLARVPHSLDLSSPNMANTVNAALKPLETLSRIVNQPSSLFGSKSASSKNKSEQDAQGASQDSSSNQQDPGEPGEAEVQEEDHDVTQTEVADGDIMDGEAETDSVVIAGQPEVLSSQEMQVENELEDLIDELLERDGGSGNSTIIVSRSGEDESQEDVLMDEAPSNLSQASTLQANREDSMNILDPEDEEEHTQEEDSSGSNEDEDDSQDEEEEEEEDEEDDQEDDEGEEGDEDDDDDGSEMELDEDYPDMNASPLVRFERFDREDDLIIEFDNMFSSATDIPPSPGNIPTTHPLMVRHADHSSLTLGSGSSTTRLTQGIGRSQRTLRQLTANTGHTIHVHYPGNRQPNPPLILQRLLGPSAAADILQLSSSLPLQSRGRARLLVGNDDVHIIARSDDELLDDFFHDQSTATSQAGTLSSIPTALTRWTEECKVLDAESMHDCVSVVKVSIVNHLEFLRDEELEERREKRRKQLAEEETKITDKGKEDKENRDQSAQCTASKSNDSTEQNLSDGTPMPDSYPTTPSSTDAATSESKETLGTLQSSQQQPTLPTPPALGEVPQELQSPAGEGGSSTQLLMPVEPEELGPTRPSGEAETTQMELSPAPTITSLSPERAEDSDALTAVSSQLEGSPMDTSSLASCTLEEAVGDTSAAGSSEQPRAGSSTPGDAPPAVAEVQGRSDGSGESAQPPEDSSPPASSESSSTRDSAVAISGADSRGILEEPLPSTSSEEEDPLAGISLPEGVDPSFLAALPDDIRREVLQNQLGIRPPTRTAPSTNSSAPAVVGNPGVTEVSPEFLAALPPAIQEEVLAQQRAEQQRRELAQNASSDTPMDPVTFIQTLPSDLRRSVLEDMEDSVLAVMPPDIAAEAQALRREQEARQRQLMHERLFGHSSTSALSAILRSPAFTSRLSGNRGVQYTRLAVQRGGTFQMGGSSSHNRPSGSNVDTLLRLRGRLLLDHEALSCLLVLLFVDEPKLNTSRLHRVLRNLCYHAQTRHWVIRSLLSILQRSSESELCIETPKLTTSEEKGKKSSKSCGSSSHENRPLDLLHKMESKSSNQLSWLSVSMDAALGCRTNIFQIQRSGGRKHTEKHASGGSTVHIHPQAAPVVCRHVLDTLIQLAKVFPSHFTQQRTKETNCESDRERGNKACSPCSSQSSSSGICTDFWDLLVKLDNMNVSRKGKNSVKSVPVSAGGEGETSPYSLEASPLGQLMNMLSHPVIRRSSLLTEKLLRLLSLISIALPENKVSEAQANSGSGASSTTTATSTTSTTTTTAASTTPTPPTAPTPVTSAPALVAATAISTIVVAASTTVTTPTTATTTVSISPTTKGSKSPAKVSDGGSSSTDFKMVSSGLTENQLQLSVEVLTSHSCSEEGLEDAANVLLQLSRGDSGTRDTVLKLLLNGARHLGYTLCKQIGTLLAELREYNLEQQRRAQCETLSPDGLPEEQPQTTKLKGKMQSRFDMAENVVIVASQKRPLGGRELQLPSMSMLTSKTSTQKFFLRVLQVIIQLRDDTRRANKKAKQTGRLGSSGLGSASSIQAAVRQLEAEADAIIQMVREGQRARRQQQAATSESSQSEASVRREESPMDVDQPSPSAQDTQSIASDGTPQGEKEKEERPPELPLLSEQLSLDELWDMLGECLKELEESHDQHAVLVLQPAVEAFFLVHATERESKPPVRDTRESQLAHIKDEPPPLSPAPLTPATPSSLDPFFSREPSSMHISSSLPPDTQKFLRFAETHRTVLNQILRQSTTHLADGPFAVLVDYIRVLDFDVKRKYFRQELERLDEGLRKEDMAVHVRRDHVFEDSYRELHRKSPEEMKNRLYIVFEGEEGQDAGGLLREWYMIISREMFNPMYALFRTSPGDRVTYTINPSSHCNPNHLSYFKFVGRIVAKAVYDNRLLECYFTRSFYKHILGKSVRYTDMESEDYHFYQGLVYLLENDVSTLGYDLTFSTEVQEFGVCEVRDLKPNGANILVTEENKKEYVHLVCQMRMTGAIRKQLAAFLEGFYEIIPKRLISIFTEQELELLISGLPTIDIDDLKSNTEYHKYQSNSIQIQWFWRALRSFDQADRAKFLQFVTGTSKVPLQGFAALEGMNGIQKFQIHRDDRSTDRLPSAHTCFNQLDLPAYESFEKLRHMLLLAIQECSEGFGLA

SEQ ID NO: 2020 - protein, 273 aa, unidentified
MATWDEKAVTRRAKVAPAERMSKFLRHFTVVGDDYHAWNINYKKWENEEEEEEEEQPPPTPVSGEEGRAAAPDVAPAPGPAPRAPLDFRGMLRKLFSSHRFQVIIICLVVLDALLVLAELILDLKIIQPDKNNYAAMVFHYMSITILVFFMMEIIFKLFVFRLEFFHHKFEILDAVVVVVSFILDIVLLFQEHQFEALGLLILLRLWRVARIINGIIISVKTRSERQLLRLKQMNVQLAAKIQHLEFSCSEKEQEIERLNKLLRQHGLLGEVN

SEQ ID NO: 2021 - protein, 473 aa, unidentified
MRAGPGPTVTLALVLAVSWAMELKPTAPPIFTGRPFVVAWDVPTQDCGPRLKVPLDLNAFDVQASPNEGFVNQNITIFYRDRLGLYPRFDSAGRSVHGGVPQNVSLWAHRKMLQKRVEHYIRTQESAGLAVIDWEDWRPVWVRNWQDKDVYRRLSRQLVASRHPDWPPDRIVKQAQYEFEFAAQQFMLETLRYVKAVRPRHLWGFYLFPDCYNHDYVQNWESYTGRCPDVEVARNDQLAWLWAESTALFPSVYLDETLASSRHGRNFVSFRVQEALRVARTHHANHALPVYVFTRPTYSRRLTGLSEMDLISTIGESAALGAAGVILWGDAGYTTSTETCQYLKDYLTRLLVPYVVNVSWATQYCSRAQCHGHGRCVRRNPSASTFLHLSTNSFRLVPGHAPGEPQLRPVGELSWADIDHLQTHFRCQCYLGWSGEQCQWDHRQAAGGASEAWAGSHLTSLLALAALAFTWTL

SEQ ID NO: 2022 - protein, 481 aa, unidentified
MKVLSEGQLKLCVVQPVHLTSWLLIFFILKSISCLKPARLPIYQRKPFIAAWNAPTDQCLIKYNLRLNLKMFPVIGSPLAKARGQNVTIFYVNRLGYYPWYTSQGVPINGGLPQNISLQVHLEKADQDINYYIPAEDFSGLAVIDWEYWRPQWARNWNSKDVYRQKSRKLISDMGKNVSATDIEYLAKVTFEESAKAFMKETIKLGIKSRPKGLWGYYLYPDCHNYNVYAPNYSGSCPEDEVLRNNELSWLWNSSAALYPSIGVWKSLGDSENILRFSKFRVHESMRISTMTSHDYALPVFVYTRLGYRDEPLFFLSKQDLVSTIGESAALGAAGIVIWGDMNLTASKANCTKVKQFVSSDLGSYIANVTRAAEVCSLHLCRNNGRCIRKMWNAPSYLHLNPASYHIEASEDGEFTVKGKASDTDLAVMADTFSCHCYQGYEGADCREIKTADGCSGVSPSPGSLMTLCLLLLASYRSIQL

SEQ ID NO: 2023 - protein, 483 aa, unidentified
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 2024 - protein, 532 aa, unidentified
MAPSSPRPALPALLVLLGALFPGPGNAQTSVSPSKVILPRGGSVLVTCSTSCDQPKLLGIETPLPKKELLLPGNNRKVYELSNVQEDSQPMCYSNCPDGQSTAKTFLTVYWTPERVELAPLPSWQPVGKNLTLRCQVEGGAPRANLTVVLLRGEKELKREPAVGEPAEVTTTVLVRRDHHGANFSCRTELDLRPQGLELFENTSAPYQLQTFVLPATPPQLVSPRVLEVDTQGTVVCSLDGLFPVSEAQVHLALGDQRLNPTVTYGNDSFSAKASVSVTAEDEGTQRLTCAVILGNQSQETLQTVTIYSFPAPNVILTKPEVSEGTEVTVKCEAHPRAKVTLNGVPAQPLGPRAQLLLKATPEDNGRSFSCSATLEVAGQLIHKNQTRELRVLYGPRLDERDCPGNWTWPENSQQTPMCQAWGNPLPELKCLKDGTFPLPIGESVTVTRDLEGTYLCRARSTQGEVTRKVTVNVLSPRYEIVIITVVAAAVIMGTAGLSTYLYNRQRKIKKYRLQQAQKGTPMKPNTQATPP

SEQ ID NO: 2025 - protein, 275 aa, unidentified
MSSFGYRTLTVALFTLICCPGSDEKVFEVHVRPKKLAVEPKGSLEVNCSTTCNQPEVGGLETSLDKILLDEQAQWKHYLVSNISHDTVLQCHFTCSGKQESMNSNVSVYQPPRQVILTLQPTLVAVGKSFTIECRVPTVEPLDSLTLFLFRGNETLHYETFGKAAPAPQEATATFNSTADREDGHRNFSCLAVLDLMSRGGNIFHKHSAPKMLEIYEPVSDSQMVIIVTVVSVLLSLFVTSVLLCFIFGQHLRQQRMGTYGVRAAWRRLPQAFRP

SEQ ID NO: 2026 - protein, 547 aa, unidentified
MATMVPSVLWPRACWTLLVCCLLTPGVQGQEFLLRVEPQNPVLSAGGSLFVNCSTDCPSSEKIALETSLSKELVASGMGWAAFNLSNVTGNSRILCSVYCNGSQITGSSNITVYRLPERVELAPLPPWQPVGQNFTLRCQVEDGSPRTSLTVVLLRWEEELSRQPAVEEPAEVTATVLASRDDHGAPFSCRTELDMQPQGLGLFVNTSAPRQLRTFVLPVTPPRLVAPRFLEVETSWPVDCTLDGLFPASEAQVYLALGDQMLNATVMNHGDTLTATATATARADQEGAREIVCNVTLGGERREARENLTVFSFLGPIVNLSEPTAHEGSTVTVSCMAGARVQVTLDGVPAAAPGQPAQLQLNATESDDGRSFFCSATLEVDGEFLHRNSSVQLRVLYGPKIDRATCPQHLKWKDKTRHVLQCQARGNPYPELRCLKEGSSREVPVGIPFFVNVTHNGTYQCQASSSRGKYTLVVVMDIEAGSSHFVPVFVAVLLTLGVVTIVLALMYVFREHQRSGSYHVREESTYLPLTSMQPTEAMGEEPSRAE

SEQ ID NO: 2027 - protein, 271 aa, unidentified
MGSLFPLSLLFFLAAAYPGVGSALGRRTKRAQSPKGSPLAPSGTSVPFWVRMSPEFVAVQPGKSVQLNCSNSCPQPQNSSLRTPLRQGKTLRGPGWVSYQLLDVRAWSSLAHCLVTCAGKTRWATSRITAYKPPHSVILEPPVLKGRKYTLRCHVTQVFPVGYLVVTLRHGSRVIYSESLERFTGLDLANVTLTYEFAAGPRDFWQPVICHARLNLDGLVVRNSSAPITLMLAWSPAPTALASGSIAALVGILLTVGAAYLCKCLAMKSQA

SEQ ID NO: 2028 - protein, 924 aa, unidentified
MPGPSPGLRRALLGLWAALGLGLFGLSAVSQEPFWADLQPRVAFVERGGSLWLNCSTNCPRPERGGLETSLRRNGTQRGLRWLARQLVDIREPETQPVCFFRCARRTLQARGLIRTFQRPDRVELMPLPPWQPVGENFTLSCRVPGAGPRASLTLTLLRGAQELIRRSFAGEPPRARGAVLTATVLARREDHGANFSCRAELDLRPHGLGLFENSSAPRELRTFSLSPDAPRLAAPRLLEVGSERPVSCTLDGLFPASEARVYLALGDQNLSPDVTLEGDAFVATATATASAEQEGARQLVCNVTLGGENRETRENVTIYSFPAPLLTLSEPSVSEGQMVTVTCAAGAQALVTLEGVPAAVPGQPAQLQLNATENDDRRSFFCDATLDVDGETLIKNRSAELRVLYAPRLDDSDCPRSWTWPEGPEQTLRCEARGNPEPSVHCARSDGGAVLALGLLGPVTRALSGTYRCKAANDQGEAVKDVTLTVEYAPALDSVGCPERITWLEGTEASLSCVAHGVPPPDVICVRSGELGAVIEGLLRVAREHAGTYRCEATNPRGSAAKNVAVTVEYGPRFEEPSCPSNWTWVEGSGRLFSCEVDGKPQPSVKCVGSGGATEGVLLPLAPPDPSPRAPRIPRVLAPGIYVCNATNRHGSVAKTVVVSAESPPEMDESTCPSHQTWLEGAEASALACAARGRPSPGVRCSREGIPWPEQQRVSREDAGTYHCVATNAHGTDSRTVTVGVEYRPVVAELAASPPGGVRPGGNFTLTCRAEAWPPAQISWRAPPGALNIGLSSNNSTLSVAGAMGSHGGEYECAATNAHGRHARRITVRVAGPWLWVAVGGAAGGAALLAAGAGLAFYVQSTACKKGEYNVQEAESSGEAVCLNGAGGGAGGAAGAEGGPEAAGGAAESPAEGEVFAIQLTSA

SEQ ID NO: 2029 - protein, 284 aa, unidentified
MAGCAARAPPGSEARLSLATFLLGASVLALPLLTRAGLQGRTGLALYVAGLNALLLLLYRPPRYQIAIRACFLGFVFGCGTLLSFSQSSWSHFGWYMCSLSLFHYSEYLVTAVNNPKSLSLDSFLLNHSLEYTVAALSSWLEFTLENIFWPELKQITWLSVTGLLMVVFGECLRKAAMFTAGSNFNHVVQNEKSDTHTLVTSGVYAWFRHPSYVGWFYWSIGTQVMLCNPICGVSYALTVWRFFRDRTEEEEISLIHFFGEEYLEYKKRVPTGLPFIKGVKVDL

SEQ ID NO: 2030 - protein, 199 aa, unidentified
MKSGLWYFFLFCLRIKVLTGEINGSANYEMFIFHNGGVQILCKYPDIVQQFKMQLLKGGQILCDLTKTKGSGNTVSIKSLKFCHSQLSNNSVSFFLYNLDHSHANYYFCNLSIFDPPPFKVTLTGGYLHIYESQLCCQLKFWLPIGCAAFVVVCILGCILICWLTKKKYSSSVHDPNGEYMFMRAVNTAKKSRLTDVTL

SEQ ID NO: 2031 - protein, 302 aa, unidentified
MRLGSPGLLFLLFSSLRADTQEKEVRAMVGSDVELSCACPEGSRFDLNDVYVYWQTSESKTVVTYHIPQNSSLENVDSRYRNRALMSPAGMLRGDFSLRLFNVTPQDEQKFHCLVLSQSLGFQEVLSVEVTLHVAANFSVPVVSAPHSPSQDELTFTCTSINGYPRPNVYWINKTDNSLLDQALQNDTVFLNMRGLYDVVSVLRIARTPSVNIGCCIENVLLQQNLTVGSQTGNDIGERDKITENPVSTGEKNAATWSILAVLCLLVVVAVAIGWVCRDRCLQHSYAGAWAVSPETELTGHV

SEQ ID NO: 2032 - protein, 156 aa, unidentified
MCHSRSCHPTMTILQAPTPAPSTIPGPRRGSGPEIFTFDPLPEPAAAPAGRPSASRGHRKRSRRVLYPRVVRRQLPVEEPNPAKRLLFLLLTIVFCQILMAEEGVPAPLPPEDAPNAASLAPTPVSAVLEPFNLTSEPSDYALDLSTFLQQHPAAF

SEQ ID NO: 2033 - protein, 82 aa, unidentified
MAFTLYSLLQAALLCVNAIAVLHEERFLKNIGWGTDQGIGGFGEEPGIKSQLMNLIRSVRTVMRVPLIIVNSIAIVLLLLFG

SEQ ID NO: 2034 - protein, 122 aa, unidentified
MEASALTSSAVTSVAKVVRVASGSAVVLPLARIATVVIGGVVAMAAVPMVLSAMGFTAAGIASSSIAAKMMSAAAIANGGGVASGSLVATLQSLGATGLSGLTKFILGSIGSAIAAVIARFY

SEQ ID NO: 2035 - protein, 250 aa, unidentified
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 2036 - protein, 130 aa, unidentified
MRQKAVSLFLCYLLLFTCSGVEAGKKKCSESSDSGSGFWKALTFMAVGGGLAVAGLPALGFTGAGIAANSVAASLMSWSAILNGGGVPAGGLVATLQSLGAGGSSVVIGNIGALMGYATHKYLDSEEDEE

SEQ ID NO: 2037 - protein, 125 aa, unidentified
MHKEEHEVAVLGPPPSTILPRSTVINIHSETSVPDHVVWSLFNTLFLNWCCLGFIAFAYSVKSRDRKMVGDVTGAQAYASTAKCLNIWALILGILMTIGFILLLVFGSVTVYHIMLQIIQEKRGY

SEQ ID NO: 2038 - protein, 228 aa, unidentified
MREGKRGPPCILSFRGTLERVEAQWELEAQGPGQCPAPLGDPASTTDGAQEARVPLDGAFWIPRPPAGSPKGCFACVSKPPALQAPAAPAPEPSASPPMAPTLFPMESKSSKTDSVRAAGAPPACKHLAEKKTMTNPTTVIEVYPDTTEVNDYYLWSIFNFVYLNFCCLGFIALAYSLKVRDKKLLNDLNGAVEDAKTARLFNITSSALAASCIILVFIFLRYPLTDY

SEQ ID NO: 2039 - protein, 132 aa, unidentified
MNHIVQTFSPVNSGQPPNYEMLKEEQEVAMLGVPHNPAPPMSTVIHIRSETSVPDHVVWSLFNTLFMNTCCLGFIAFAYSVKSRDRKMVGDVTGAQAYASTAKCLNIWALILGIFMTILLIIIPVLVVQAQR

SEQ ID NO: 2040 - protein, 133 aa, unidentified
MNHTVQTFFSPVNSGQPPNYEMLKEEHEVAVLGAPHNPAPPTSTVIHIRSETSVPDHVVWSLFNTLFMNPCCLGFIAFAYSVKSRDRKMVGDVTGAQAYASTAKCLNIWALILGILMTILLIVIPVLIFQAYG

SEQ ID NO: 2041 - protein, 132 aa, unidentified
MDTAYPREDTRAPTPSKAGAHTALTLGAPHPPPRDHLIWSVFSTLYLNLCCLGFLALAYSIKARDQKVVGDLEAARRFGSKAKCYNILAAMWTLVPPLLLLGLVVTGALHLARLAKDSAAFFSTKFDDADYD

SEQ ID NO: 2042 - protein, 557 aa, unidentified
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANMTFQVQWLHAFLKRNPGNHLYKWKQIPDCENVKTTQCVFPQNVFQKGIYLLRVQASDGNNTSFWSEEIKFDTEIQAFLLPPVFNIRSLSDSFHIYIGAPKQSGNTPVIQDYPLIYEIIFWENTSNAERKIIEKKTDVTVPNLKPLTVYCVKARAHTMDEKLNKSSVFSDAVCEKTKPGNTSKIWLIVGICIALFALPFVIYAAKVFLRCINYVFFPSLKPSSSIDEYFSEQPLKNLLLSTSEEQIEKCFIIENISTIATVEETNQTDEDHKKYSSQTSQDSGNYSNEDESESKTSEELQQDFV

SEQ ID NO: 2043 - protein, 515 aa, unidentified [sequence omitted]

SEQ ID NO: 2044 - protein, 489 aa, unidentified
MALLFLLPLVMQGVSRAEMGTADLGPSSVPTPTNVTIESYNMNPIVYWEYQIMPQVPVFTVEVKNYGVKNSEWIDACINISHHYCNISDHVGDPSNSLWVRVKARVGQKESAYAKSEEFAVCRDGKIGPPKLDIRKEEKQIMIDIFHPSVFVNGDEQEVDYDPETTCYIRVYNVYVRMNGSEIQYKILTQKEDDCDEIQCQLAIPVSSLNSQYCVSAEGVLHVWGVTTEKSKEVCITIFNSSIKGSLWIPVVAALLLFLVLSLVFICFYIKKINPLKEKSIILPKSLISVVRSATLETKPESKYVSLITSYQPFSLEKEVVCEEPLSPATVPGMHTEDNPGKVEHTEELSSITEVVTTEENIPDVVPGSHLTPIERESSSPLSSNQSEPGSIALNSYHSRNCSESDHSRNGFDTDSSCLESHSSLSDSEFPPNNKGEIKTEGQELITVIKAPTSFGYDKPHVLVDLLVDDSGKESLIGYRPTEDSKEFS

SEQ ID NO: 2045 - protein, 337 aa, unidentified
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 2046 - protein, 520 aa, unidentified
MAGPERWGPLLLCLLQAAPGRPRLAPPQNVTLLSQNFSVYLTWLPGLGNPQDVTYFVAYQSSPTRRRWREVEECAGTKELLCSMMCLKKQDLYNKFKGRVRTVSPSSKSPWVESEYLDYLFEVEPAPPVLVLTQTEEILSANATYQLPPCMPPLDLKYEVAFWKEGAGNKTLFPVTPHGQPVQITLQPAASEHHCLSARTIYTFSVPKYSKFSKPTCFLLEVPEANWAFLVLPSLLILLLVIAAGGVIWKTLMGNPWFQRAKMPRALDFSGHTHPVATFQPSRPESVNDLFLCPQKELTRGVRPTPRVRAPATQQTRWKKDLAEDEEEEDEEDTEDGVSFQPYIEPPSFLGQEHQAPGHSEAGGVDSGRPRAPLVPSEGSSAWDSSDRSWASTVDSSWDRAGSSGYLAEKGPGQGPGGDGHQESLPPPEFSKDSGFLEELPEDNLSSWATWGTLPPEPNLVPGGPPVSLQTLTFCWESSPEEEEEARESEIEDSDAGSWGAESTQRTEDRGRTLGHYMAR

SEQ ID NO: 2047 - protein, 451 aa, unidentified
MPKNKKRNTPHRGSSAGGGGSGAAAATAATAGGQHRNVQPFSDEDASIETMSHCSGYSDPSSFAEDGPEVLDEEGTQEDLEYKLKGLIDLTLDKSAKTRQAALEGIKNALASKMLYEFILERRMTLTDSIERCLKKGKSDEQRAAAALASVLCIQLGPGIESEEILKTLGPILKKIICDGSASMQARQTCATCFGVCCFIATDDITELYSTLECLENIFTKSYLKEKDTTVICSTPNTVLHISSLLAWTLLLTICPINEVKKKLEMHFHKLPSLLSCDDVNMRIAAGESLALLFELARGIESDFFYEDMESLTQMLRALATDGNKHRAKVDKRKQRSVFRDVLRAVEERDFPTETIKFGPERMYIDCWVKKHTYDTFKEVLGSGMQYHLQSNEFLRNVFELGPPVMLDAATLKTMKISRFERHLYNSAAFKARTKARSKCRDKRADVGEFF

SEQ ID NO: 2048 - protein, 814 aa, unidentified
MAVQRAASPRRPPAPLWPRLLLPLLLLLLPAPSEGLGHSAELAFAVEPSDDVAVPGQPIVLDCRVEGTPPVRITWRKNGVELPESTHSTLLANGSLMIRHFRLEPGGSPSDEGDYECVAQNRFGLVVSRKARIQAATMSDFHVHPQATVGEEGGVARFQCQIHGLPKPLITWEKNRVPIDTDNERYTLLPKGVLQITGLRAEDGGIFHCVASNIASIRISHGARLTVSGSGSGAYKEPAILVGPENLTLTVHQTAVLECVATGNPRPIVSWSRLDGRPIGVEGIQVLGTGNLIISDVTVQHSGVYVCAANRPGTRVRRTAQGRLVVQAPAEFVQHPQSISRPAGTTAMFTCQAQGEPPPHVTWLKNGQVLGPGGHVRLKNNNSTLTISGIGPEDEAIYQCVAENSAGSSQASARLTVLWAEGLPGPPRNVRAVSVSSTEVRVSWSEPLANTKEIIGYVLHIRKAADPPELEYQEAVSKSTFQHLVSDLEPSTAYSFYIKAYTPRGASSASVPTLASTLGEAPAPPPLSVRVLGSSSLQLLWEPWPRLAQHEGGFKLFYRPASKTSFTGPILLPGTVSSYNLSQLDPTAVYEVKLLAYNQHGDGNATVRFVSLRGASERTALSPPCDCRKEEAANQTSTTGIVIGIHIGVTCIIFCVLFLLFGQRGRVLLCKDVENQLSPPQGPRSQRDPGILALNGARRGQRGQLGRDEKRVDMKELEQLFPPASAAGQPDPRPTQDPAAPAPCEETQLSVLPLQGCGLMEGKTTEAKTTEATAPCAGLAAAPPPPDGGPGLLSEGQASRPAAARVTQPAHSEQ

SEQ ID NO: 2049 - protein, 1250 aa, unidentified
MARGDAGRGRGLLALTFCLLAARGELLLPQETTVELSCGVGPLQVILGPEQAAVLNCSLGAAAAGPPTRVTWSKDGDTLLEHDHLHLLPNGSLWLSQPLAPNGSDESVPEAVGVIEGNYSCLAHGPLGVLASQTAVVKLATLADFSLHPESQTVEENGTARFECHIEGLPAPIITWEKDQVTLPEEPRLIVLPNGVLQILDVQESDAGPYRCVATNSARQHFSQEALLSVAHRGSLASTRGQDVVIVAAPENTTVVSGQSVVMECVASADPTPFVSWVRQDGKPISTDVIVLGRTNLLIANAQPWHSGVYVCRANKPRTRDFATAAAELRVLAAPAITQAPEALSRTRASTARFVCRASGEPRPALRWLHNGAPLRPNGRVKVQGGGGSLVITQIGLQDAGYYQCVAENSAGMACAAASLAVVVREGLPSAPTRVTATPLSSSAVLVAWERPEMHSEQIIGFSLHYQKARGMDNVEYQFAVNNDTTELQVRDLEPNTDYEFYVVAYSQLGASRTSTPALVHTLDDVPSAAPQLSLSSPNPSDIRVAWLPLPPSLSNGQVVKYKIEYGLGKEDQIFSTEVRGNETQLMLNSLQPNKVYRVRISAGTAAGFGAPSQWMHHRTPSMHNQSHVPFAPAELKVQAKMESLVVSWQPPPHPTQISGYKLYWREVGAEEEANGDRLPGGRGDQAWDVGPVRLKKKVKQYELTQLVPGRLYEVKLVAFNKHEDGYAAVWKGKTEKAPAPDMPIQRGPPLPPAHVHAESNSSTSIWLRWKKPDFTTVKIVNYTVRFSPWGLRNASLVTYYTSSGEDILIGGLKPFTKYEFAVQSHGVDMDGPFGSVVERSTLPDRPSTPPSDLRLSPLTPSTVRLHWCPPTEPNGEIVEYLILYSSNHTQPEHQWTLLTTQGNIFSAEVHGLESDTRYFFKMGARTEVGPGPFSRLQDVITLQEKLSDSLDMHSVTGIIVGVCLGLLCLLACMCAGLRRSPHRESLPGLSSTATPGNPALYSRARLGPPSPPAAHELESLVHPHPQDWSPPPSDVEDRAEVHSLMGGGVSEGRSHSKRKISWAQPSGLSWAGSWAGCELPQAGPRPALTRALLPPAGTGQTLLLQALVYDAIKGNGRKKSPPACRNQVEAEVIVHSDFSASNGNPDLHLQDLEPEDPLPPEAPDLISGVGDPGQGAAWLDRELGGCELAAPGPDRLTCLPEAASASCSYPDLQPGEVLEETPGDSCQLKSPCPLGASPGLPRSPVSSSA

SEQ ID NO: 2050 - protein, 1367 aa, unidentified
MKSGSGGGSPTSLWGLLFLSAALSLWPTSGEICGPGIDIRNDYQQLKRLENCTVIEGYLHILLISKAEDYRSYRFPKLTVITEYLLLFRVAGLESLGDLFPNLTVIRGWKLFYNYALVIFEMTNLKDIGLYNLRNITRGAIRIEKNADLCYLSTVDWSLILDAVSNNYIVGNKPPKECGDLCPGTMEEKPMCEKTTINNEYNYRCWTTNRCQKMCPSTCGKRACTENNECCHPECLGSCSAPDNDTACVACRHYYYAGVCVPACPPNTYRFEGWRCVDRDFCANILSAESSDSEGFVIHDGECMQECPSGFIRNGSQSMYCIPCEGPCPKVCEEEKKTKTIDSVTSAQMLQGCTIFKGNLLINIRRGNNIASELENFMGLIEVVTGYVKIRHSHALVSLSFLKNLRLILGEEQLEGNYSFYVLDNQNLQQLWDWDHRNLTIKAGKMYFAFNPKLCVSEIYRMEEVTGTKGRQSKGDINTRNNGERASCESDVLHFTSTTTSKNRIIITWHRYRPPDYRDLISFTVYYKEAPFKNVTEYDGQDACGSNSWNMVDVDLPPNKDVEPGILLHGLKPWTQYAVYVKAVTLTMVENDHIRGAKSEILYIRTNASVPSIPLDVLSASNSSSQLIVKWNPPSLPNGNLSYYIVRWQRQPQDGYLYRHNYCSKDKIPIRKYADGTIDIEEVTENPKTEVCGGEKGPCCACPKTEAEKQAEKEEAEYRKVFENFLHNSIFVPRPERKRRDVMQVANTTMSSRSRNTTAADTYNITDPEELETEYPFFESRVDNKERTVISNLRPFTLYRIDIHSCNHEAEKLGCSASNFVFARTMPAEGADDIPGPVTWEPRPENSIFLKWPEPENPNGLILMYEIKYGSQVEDQRECVSRQEYRKYGGAKLNRLNPGNYTARIQATSLSGNGSWTDPVFFYVQAKTGYENFIHLIIALPVAVLLIVGGLVIMLYVFHRKRNNSRLGNGVLYASVNPEYFSAADVYVPDEWEVAREKITMSRELGQGSFGMVYEGVAKGVVKDEPETRVAIKTVNEAASMRERIEFLNEASVMKEFNCHHVVRLLGVVSQGQPTLVIMELMTRGDLKSYLRSLRPEMENNPVLAPPSLSKMIQMAGEIADGMAYLNANKFVHRDLAARNCMVAEDFTVKIGDFGMTRDIYETDYYRKGGKGLLPVRWMSPESLKDGVFTTYSDVWSFGVVLWEIATLAEQPYQGLSNEQVLRFVMEGGLLDKPDNCPDMLFELMRMCWQYNPKMRPSFLEIISSIKEEMEPGFREVSFYYSEENKLPEPEELDLEPENMESVPLDPSASSSSLPLPDRHSGHKAENGPGPGVLVLRASFDERQPYAHMNGGRKNERALPLPQSSTC

SEQ ID NO: 2051 - protein, 180 aa, unidentified
MGIPMGKSMLVLLTFLAFASCCIAAYRPSETLCGGELVDTLQFVCGDRGFYFSRPASRVSRRSRGIVEECCFRSCDLALLETYCATPAKSERDVSTPPTVLPDNFPRYPVGKFFQYDTWKQSTQRLRRGLPALLRARRGHVLAKELEAFREAKRHRPLIALPTQDPAHGGAPPEMASNRK

SEQ ID NO: 2052 - protein, 2491 aa, unidentified
MGAAAGRSPHLGPAPARRPQRSLLLLQLLLLVAAPGSTQAQAAPFPELCSYTWEAVDTKNNVLYKINICGSVDIVQCGPSSAVCMHDLKTRTYHSVGDSVLRSATRSLLEFNTTVSCDQQGTNHRVQSSIAFLCGKTLGTPEFVTATECVHYFEWRTTAACKKDIFKANKEVPCYVFDEELRKHDLNPLIKLSGAYLVDDSDPDTSLFINVCRDIDTLRDPGSQLRACPPGTAACLVRGHQAFDVGQPRDGLKLVRKDRLVLSYVREEAGKLDFCDGHSPAVTITFVCPSERREGTIPKLTAKSNCRYEIEWITEYACHRDYLESKTCSLSGEQQDVSIDLTPLAQSGGSSYISDGKEYLFYLNVCGETEIQFCNKKQAAVCQVKKSDTSQVKAAGRYHNQTLRYSDGDLTLIYFGGDECSSGFQRMSVINFECNKTAGNDGKGTPVFTGEVDCTYFFTWDTEYACVKEKEDLLCGATDGKKRYDLSALVRHAEPEQNWEAVDGSQTETEKKHFFINICHRVLQEGKARGCPEDAAVCAVDKNGSKNLGKFISSPMKEKGNIQLSYSDGDDCGHGKKIKTNITLVCKPGDLESAPVLRTSGEGGCFYEFEWHTAAACVLSKTEGENCTVFDSQAGFSFDLSPLTKKNGAYKVETKKYDFYINVCGPVSVSPCQPDSGACQVAKSDEKTWNLGLSNAKLSYYDGMIQLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGSFTEVVSISNLGMAKTGPVVEDSGSLLLEYVNGSACTTSDGRQTTYTTRIHLVCSRGRLNSHPIFSLNWECVVSFLWNTEAACPIQTTTDTDQACSIRDPNSGFVFNLNPLNSSQGYNVSGIGKIFMFNVCGTMPVCGTILGKPASGCEAETQTEELKNWKPARPVGIEKSLQLSTEGFITLTYKGPLSAKGTADAFIVRFVCNDDVYSGPLKFLHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAGLLTQKLTYENGLLKMNFTGGDTCHKVYQRSTAIFFYCDRGTQRPVFLKETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVGACFGQTRISVGKANKRLRYVDQVLQLVYKDGSPCPSKSGLSYKSVISFVCRPEARPTNRPMLISLDKQTCTLFFSWHTPLACEQATECSVRNGSSIVDLSPLIHRTGGYEAYDESEDDASDTNPDFYINICQPLNPMHGVPCPAGAAVCKVPIDGPPIDIGRVAGPPILNPIANEIYLNFESSTPCLADKHFNYTSLIAFHCKRGVSMGTPKLLRTSECDFVFEWETPVVCPDEVRMDGCTLTDEQLLYSFNLSSLSTSTFKVTRDSRTYSVGVCTFAVGPEQGGCKDGGVCLLSGTKGASFGRLQSMKLDYRHQDEAVVLSYVNGDRCPPETDDGVPCVFPFIFNGKSYEECIIESRAKLWCSTTADYDRDHEWGFCRHSNSYRTSSIIFKCDEDEDIGRPQVFSEVRGCDVTFEWKTKVVCPPKKLECKFVQKHKTYDLRLLSSLTGSWSLVHNGVSYYINLCQKIYKGPLGCSERASICRRTTTGDVQVLGLVHTQKLGVIGDKVVVTYSKGYPCGGNKTASSVIELTCTKTVGRPAFKRFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGVGFDSENPGDDGQMHKGLSERSQAVGAVLSLLLVALTCCLLALLLYKKERRETVISKLTTCCRRSSNVSYKYSKVNKEEETDENETEWLMEEIQLPPPRQGKEGQENGHITTKSVKALSSLHGDDQDSEDEVLTIPEVKVHSGRGAGAESSHPVRNAQSNALQEREDDRVGLVRGEKARKGKSSSAQQKTVSSTKLVSFHDDSDEDLLHI

SEQ ID NO: 2053 - protein, 605 aa, unidentified
MALRKGGLALALLLLSWVALGPRSLEGADPGTPGEAEGPACPAACVCSYDDDADELSVFCSSRNLTRLPDGVPGGTQALWLDGNNLSSVPPAAFQNLSSLGFLNLQGGQLGSLEPQALLGLENLCHLHLERNQLRSLALGTFAHTPALASLGLSNNRLSRLEDGLFEGLGSLWDLNLGWNSLAVLPDAAFRGLGSLRELVLAGNRLAYLQPALFSGLAELRELDLSRNALRAIKANVFVQLPRLQKLYLDRNLIAAVAPGAFLGLKALRWLDLSHNRVAGLLEDTFPGLLGLRVLRLSHNAIASLRPRTFKDLHFLEELQLGHNRIRQLAERSFEGLGQLEVLTLDHNQLQEVKAGAFLGLTNVAVMNLSGNCLRNLPEQVFRGLGKLHSLHLEGSCLGRIRPHTFTGLSGLRRLFLKDNGLVGIEEQSLWGLAELLELDLTSNQLTHLPHRLFQGLGKLEYLLLSRNRLAELPADALGPLQRAFWLDVSHNRLEALPNSLLAPLGRLRYLSLRNNSLRTFTPQPPGLERLWLEGNPWDCGCPLKALRDFALQNPSAVPRFVQAICEGDDCQPPAYTYNNITCASPPEVVGLDLRDLSEAHFAPC

SEQ ID NO: 2054 - protein, 355 aa, unidentified
MGPGRCLLTALLLLALAPPPEASQYCGRLEYWNPDNKCCSSCLQRFGPPPCPDYEFRENCGLNDHGDFVTPPFRKCSSGQCNPDGAELCSPCGGGAVTPTPAAGGGRTPWRCRERPVPAKGHCPLTPGNPGAPSSQERSSPASSIAWRTPEPVPQQAWPNFLPLVVLVLLLTLAVIAILLFILLWHLCWPKEKADPYPYPGLVCGVPNTHTPSSSHLSSPGALETGDTWKEASLLPLLSRELSSLASQPLSRLLDELEVLEELIVLLDPEPGPGGGMAHGTTRHLAARYGLPAAWSTFAYSLRPSRSPLRALIEMVVAREPSASLGQLGTHLAQLGRADALRVLSKLGSSGVCWA

SEQ ID NO: 2055 - protein, 1336 aa, unidentified
MTLDRPGEGATMLKTFTVLLFCIRMSLGMTSIVMDPQPELWIESNYPQAPWENITLWCRSPSRISSKFLLLKDKTQMTWIRPSHKTFQVSFLIGALTESNAGLYRCCYWKETGWSKPSKVLELEAPGQLPKPIFWIQAETPALPGCNVNILCHGWLQDLVFMLFKEGYAEPVDYQVPTGTMAIFSIDNLTPEDEGVYICRTHIQMLPTLWSEPSNPLKLVVAGLYPKPTLTAHPGPIMAPGESLNLRCQGPIYGMTFALMRVEDLEKSFYHKKTIKNEANFFFQSLKIQDTGHYLCFYYDASYRGSLLSDVLKIWVTDTFPKTWLLARPSAVVQMGQNVSLRCRGPVDGVGLALYKKGEDKPLQFLDATSIDDNTSFFLNNVTYSDTGIYSCHYLLTWKTSIRMPSHNTVELMVVDKPPKPSLSAWPSTVFKLGKAITLQCRVSHPVLEFSLEWEERETFQKFSVNGDFIISNVDGKGTGTYSCSYRVETHPNIWSHRSEPLKLMGPAGYLTWNYVLNEAIRLSLIMQLVALLLVVLWIRWKCRRLRIREAWLLGTAQGVTMLFIVTALLCCGLCNGVLIEETEIVMPTPKPELWAETNFPLAPWKNLTLWCRSPSGSTKEFVLLKDGTGWIATRPASEQVRAAFPLGALTQSHTGSYHCHSWEEMAVSEPSEALELVGTDILPKPVISASPTIRGQELQLRCKGWLAGMGFALYKEGEQEPVQQLGAVGREAFFTIQRMEDKDEGNYSCRTHTEKRPFKWSEPSEPLELVIKEMYPKPFFKTWASPVVTPGARVTFNCSTPHQHMSFILYKDGSEIASSDRSWASPGASAAHFLIISVGIGDGGNYSCRYYDFSIWSEPSDPVELVVTEFYPKPTLLAQPGPVVFPGKSVILRCQGTFQGMRFALLQEGAHVPLQFRSVSGNSADFLLHTVGAEDSGNYSCIYYETTMSNRGSYLSMPLMIWVTDTFPKPWLFAEPSSVVPMGQNVTLWCRGPVHGVGYILHKEGEATSMQLWGSTSNDGAFPITNISGTSMGRYSCCYHPDWTSSIKIQPSNTLELLVTGLLPKPSLLAQPGPMVAPGENMTLQCQGELPDSTFVLLKEGAQEPLEQQRPSGYRADFWMPAVRGEDSGIYSCVYYLDSTPFAASNHSDSLEIWVTDKPPKPSLSAWPSTMFKLGKDITLQCRGPLPGVEFVLEHDGEEAPQQFSEDGDFVINNVEGKGIGNYSCSYRLQAYPDIWSEPSDPLELVGAAGPVAQECTVGNIVRSSLIVVVVVALGVVLAIEWKKWPRLRTRGSETDGRDQTIALEECNQEGEPGTPANSPSSTSQRISVELPVPI

SEQ ID NO: 2056 - protein, 431 aa, unidentified
MTSQRSPLAPLLLLSLHGVAASLEVSESPGSIQVARGQPAVLPCTFTTSAALINLNVIWMVTPLSNANQPEQVILYQGGQMFDGAPRFHGRVGFTGTMPATNVSIFINNTQLSDTGTYQCLVNNLPDIGGRNIGVTGLTVLVPPSAPHCQIQGSQDIGSDVILLCSSEEGIPRPTYLWEKLDNTLKLPPTATQDQVQGTVTIRNISALSSGLYQCVASNAIGTSTCLLDLQVISPQPRNIGLIAGAIGTGAVIIIFCIALILGAFFYWRSKNKEEEEEEIPNEIREDDLPPKCSSAKAFHTEISSSDNNTLTSSNAYNSRYWSNNPKVHRNTESVSHFSDLGQSFSFHSGNANIPSIYANGTHLVPGQHKTLVVTANRGSSPQVMSRSNGSVSRKPRPPHTHSYTISHATLERIGAVPVMVPAQSRAGSLV

SEQ ID NO: 2057 - protein, 192 aa, unidentified
MRAKPQSPLPRNPVPAWSPPTTTTDPMLEKDAAGGDFPANLVLQLMPLKTFPAAIRGVIQSELNYSVILQWVVTMDPEPVLSWTFSGVPCGMGEKLFIRRLSCEQLGTYMCIATNSKKQLVSEPVTISLPKPIMQPTEAEPMEPDPTLSLSGGSAIGLLAAGILGAGALIAGMCFIIIQSLRTDRQRIGICS

SEQ ID NO: 2058 - protein, 1194 aa, unidentified
MKCFFPVLSCLAVLGVVSAQRQVTVQEGPLYRTEGSHITIWCNVSGYQGPSEQNFQWSIYLPSSPEREVQIVSTMDSSFPYAIYTQRVRGGKIFIERVQGNSTLLHITDLQARDAGEYECHTPSTDKQYFGSYSAKMNLVVIPDSLQTTAMPQTLHRVEQDPLELTCEVASETIQHSHLSVAWLRQKVGEKPVEVISLSRDFMLHSSSEYAQRQSLGEVRLDKLGRTTFRLTIFHLQPSDQGEFYCEAAEWIQDPDGSWYAMTRKRSEGAVVNVQPTDKEFTVRLETEKRLHTVGEPVEFRCILEAQNVPDRYFAVSWAFNSSLIATMGPNAVPVLNSEFAHREARGQLKVAKESDSVFVLKIYHLRQEDSGKYNCRVTEREKTVTGEFIDKESKRPKNIPIIVLPLKSSISVEVASNASVILEGEDLRFSCSVRTAGRPQGRFSVIWQLVDRQNRRSNIMWLDRDGTVQPGSSYWERSSFGGVQMEQVQPNSFSLGIFNSRKEDEGQYECHVTEWVRAVDGEWQIVGERRASTPISITALEMGFAVTAISRTPGVTYSDSFDLQCIIKPHYPAWVPVSVTWRFQPVGTVEFHDLVTFTRDGGVQWGDRSSSFRTRTAIEKAESSNNVRLSISRASDTEAGKYQCVAELWRKNYNNTWTRLAERTSNLLEIRVLQPVTKLQVSKSKRTLTLVENKPIQLNCSVKSQTSQNSHFAVLWYVHKPSDADGKLILKTTHNSAFEYGTYAEEEGLRARLQFERHVSGGLFSLTVQRAEVSDSGSYYCHVEEWLLSPNYAWYKLAEEVSGRTEVTVKQPDSRLRLSQAQGNLSVLETRQVQLECVVLNRTSITSQLMVEWFVWKPNHPERETVARLSRDATFHYGEQAAKNNLKGRLHLESPSPGVYRLFIQNVAVQDSGTYSCHVEEWLPSPSGMWYKRAEDTAGQTALTVMRPDASLQVDTVVPNATVSEKAAFQLDCSIVSRSSQDSRFAVAWYSLRTKAGGKRSSPGLEEQEEEREEEEEEDDDDDDDPTERTALLSVGPDAVFGPEGSPWEGRLRFQRLSPVLYRLTVLQASPQDTGNYSCHVEEWLPSPQKEWYRLTEEESAPIGIRVLDTSPTLQSIICSNDALFYFVFFYPFPIFGILIITILLVRFKSRNSSKNSDGKNGVPLLWIKEPHLNYSPTCLEPPVLSIHPGAID

SEQ ID NO: 2059 - protein, 407 aa, unidentified
MGQKERSTADTLPDLEEWKSAAGLRWWQTAVVDGSGSGNEVIEGPQNARVLKGSQARFNCTVSQGWKLIMWALSDMVVLSVRPMEPIITNDRFTSQRYDQGGNFTSEMIIHNVEPSDSGNIRCSLQNSRLHGSAYLTVQVMGELFIPSVNLVVAENEPCEVTCLPSHWTRLPDISWELGLLVSHSSYYFVPEPSDLQSAVSILALTPQSNGTLTCVATWKSLKARKSATVNLTVIRCPQDTGGGINIPGVLSSLPSLGFSLPTWGKVGLGLAGTMLLTPTCTLTIRCCCCRRRCCGCNCCCRCCFCCRRKRGFRIQFQKKSEKEKTNKETETESGNENSGYNSDEQKTTDTASLPPKSCESSDPEQRNSSCGPPHQRADQRPPRPASHPQASFNLASPEKVSNTTVV

SEQ ID NO: 2060 - protein, 241 aa, unidentified
MGTASRSNIARHLQTNLILFCVGAVGACTLSVTQPWYLEVDYTHEAVTIKCTFSATGCPSEQPTCLWFRYGAHQPENLCLDGCKSEADKFTVREALKENQVSLTVNRVTSNDSAIYICGIAFPSVPEARAKQTGGGTTLVVREIKLLSKELRSFLTALVSLLSVYVTGVCVAFILLSKSKSNPLRNKEIKEDSQKKKSARRIFQEIAQELYHKRHVETNQQSEKDNNTYENRRVLSNYERP

SEQ ID NO: 2061 - protein, 613 aa, unidentified
MGALRPTLLPPSLPLLLLLMLGMGCWAREVLVPEGPLYRVAGTAVSISCNVTGYEGPAQQNFEWFLYRPEAPDTALGIVSTKDTQFSYAVFKSRVVAGEVQVQRLQGDAVVLKIARLQAQDAGIYECHTPSTDTRYLGSYSGKVELRVLPDVLQVSAAPPGPRGRQAPTSPPRMTVHEGQELALGCLARTSTQKHTHLAVSFGRSVPEAPVGRSTLQEVVGIRSDLAVEAGAPYAERLAAGELRLGKEGTDRYRMVVGGAQAGDAGTYHCTAAEWIQDPDGSWAQIAEKRAVLAHVDVQTLSSQLAVTVGPGERRIGPGEPLELLCNVSGALPPAGRHAAYSVGWEMAPAGAPGPGRLVAQLDTEGVGSLGPGYEGRHIAMEKVASRTYRLRLEAARPGDAGTYRCLAKAYVRGSGTRLREAASARSRPLPVHVREEGVVLEAVAWLAGGTVYRGETASLLCNISVRGGPPGLRLAASWWVERPEDGELSSVPAQLVGGVGQDGVAELGVRPGGGPVSVELVGPRSHRLRLHSLGPEDEGVYHCAPSAWVQHADYSWYQAGSARSGPVTVYPYMHALDTLFVPLLVGTGVALVTGATVLGTITCCFMKRLRKR

SEQ ID NO: 2062 - protein, 1179 aa, unidentified
MVWCLGLAVLSLVISQGADGRGKPEVVSVVGRAGESVVLGCDLLPPAGRPPLHVIEWLRFGFLLPIFIQFGLYSPRIDPDYVGRVRLQKGASLQIEGLRVEDQGWYECRVFFLDQHIPEDDFANGSWVHLTVNSPPQFQETPPAVLEVQELEPVTLRCVARGSPLPHVTWKLRGKDLGQGQGQVQVQNGTLRIRRVERGSSGVYTCQASSTEGSATHATQLLVLGPPVIVVPPKNSTVNASQDVSLACHAEAYPANLTYSWFQDNINVFHISRLQPRVRILVDGSLRLLATQPDDAGCYTCVPSNGLLHPPSASAYLTVLYPAQVTAMPPETPLPIGMPGVIRCPVRANPPLLFVSWTKDGKALQLDKFPGWSQGTEGSLIIALGNEDALGEYSCTPYNSLGTAGPSPVTRVLLKAPPAFIERPKEEYFQEVGRELLIPCSAQGDPPPVVSWTKVGRGLQGQAQVDSNSSLILRPLTKEAHGHWECSASNAVARVATSTNVYVLGTSPHVVTNVSVVALPKGANVSWEPGFDGGYLQRFSVWYTPLAKRPDRMHHDWVSLAVPVGAAHLLVPGLQPHTQYQFSVLAQNKLGSGPFSEIVLSAPEGLPTTPAAPGLPPTEIPPPLSPPRGLVAVRTPRGVLLHWDPPELVPKRLDGYVLEGRQGSQGWEVLDPAVAGTETELLVPGLIKDVLYEFRLVAFAGSFVSDPSNTANVSTSGLEVYPSRTQLPGLLPQPVLAGVVGGVCFLGVAVLVSILAGCLLNRRRAARRRRKRLRQDPPLIFSPTGKSAAPSALGSGSPDSVAKLKLQGSPVPSLRQSLLWGDPAGTPSPHPDPPSSRGPLPLEPICRGPDGRFVMGPTVAAPQERSGREQAEPRTPAQRLARSFDCSSSSPSGAPQPLCIEDISPVAPPPAAPPSPLPGPGPLLQYLSLPFFREMNVDGDWPPLEEPSPAAPPDYMDTRRCPTSSFLRSPETPPVSPRESLPGAVVGAGATAEPPYTALADWTLRERLLPGLLPAAPRGSLTSQSSGRGSASFLRPPSTAPSAGGSYLSPAPGDTSSWASGPERWPRREHVVTVSKRRNTSVDENYEWDSEFPGDMELLETLHLGLASSRLRPEAEPELGVKTPEEGCLLNTAHVTGPEARCAALREEFLAFRRRRDATRARLPAYRQPVPHPEQATLL

SEQ ID NO: 2063 - protein, 1349 aa, unidentified
MIWYVATFIASVIGTRGLAAEGAHGLREEPEFVTARAGESVVLRCDVIHPVTGQPPPYVVEWFKFGVPIPIFIKFGYYPPHVDPEYAGRASLHDKASLRLEQVRSEDQGWYECKVLMLDQQYDTFHNGSWVHLTINAPPTFTETPPQYIEAKEGGSITMTCTAFGNPKPIVTWLKEGTLLGASGKYQVSDGSLTVTSVSREDRGAYTCRAYSIQGEAVHTTHLLVQGPPFIVSPPENITVNISQDALLTCRAEAYPGNLTYTWYWQDENVYFQNDLKLRVRILIDGTLIIFRVKPEDSGKYTCVPSNSLGRSPSASAYLTVQYPARVLNMPPVIYVPVGIHGYIRCPVDAEPPATVVKWNKDGRPLQVEKNLGWTLMEDGSIRIEEATEEALGTYTCVPYNTLGTMGQSAPARLVLKDPPYFTVLPGWEYRQEAGRELLIPCAAAGDPFPVITWRKVGKPSRSKHSALPSGSLQFRALSKEDHGEWECVATNVVTSITASTHLTVIGTSPHAPGSVRVQVSMTTANVSWEPGYDGGYEQTFSVWMKRAQFGPHDWLSLPVPPGPSWLLVDTLEPETAYQFSVLAQNKLGTSAFSEVVTVNTLAFPITTPEPLVLVTPPRCLIANRTQQGVLLSWLPPANHSFPIDRYIMEFRVAERWELLDDGIPGTEGEFFAKDLSQDTWYEFRVLAVMQDLISEPSNIAGVSSTDIFPQPDLTEDGLARPVLAGIVATICFLAAAILFSTLAACFVNKQRKRKLKRKKDPPLSITHCRKSLESPLSSGKVSPESIRTLRAPSESSDDQGQPAAKRMLSPTREKELSLYKKTKRAISSKKYSVAKAEAEAEATTPIELISRGPDGRFVMDPAEMEPSLKSRRIEGFPFAEETDMYPEFRQSDEENEDPLVPTSVAALKSQLTPLSSSQESYLPPPAYSPRFQPRGLEGPGGLEGRLQATGQARPPAPRPFHHGQYYGYLSSSSPGEVEPPPFYVPEVGSPLSSVMSSPPLPTEGPFGHPTIPEENGENASNSTLPLTQTPTGGRSPEPWGRPEFPFGGLETPAMMFPHQLPPCDVPESLQPKAGLPRGLPPTSLQVPAAYPGILSLEAPKGWAGKSPGRGPVPAPPAAKWQDRPMQPLVSQGQLRHTSQGMGIPVLPYPEPAEPGAHGGPSTFGLDTRWYEPQPRPRPSPRQARRAEPSLHQVVLQPSRLSPLTQSPLSSRTGSPELAARARPRPGLLQQAEMSEITLQPPAAVSFSRKSTPSTGSPSQSSRSGSPSYRPAMGFTTLATGYPSPPPGPAPAGPGDSLDVFGQTPSPRRTGEELLRPETPPPTLPTSGKLQRDRPAPATSPPERALSKL

SEQ ID NO: 2064 - protein, 350 aa, unidentified
MSEVKSRKKSGPKGAPAAEPGKRSEGGKTPVARSSGGGGWADPRTCLSLLSLGTCLGLAWFVFQQSEKFAKVENQYQLLKLETNEFQQLQSKISLISEKWQKSEAIMEQLKSFQIIAHLKRLQEEINEVKTWSNRITEKQDILNNSLTTLSQDITKVDQSTTSMAKDVGLKITSVKTDIRRISGLVTDVISLTDSVQELENKIEKVEKNTVKNIGDLLSSSIDRTATLRKTASENSQRINSVKKTLTELKSDFDKHTDRFLSLEGDRAKVLKTVTFANDLKPKVYNLKKDFSRLEPLVNDLTLRIGRLVTDLLQREKEIAFLSEKISNLTIVQAEIKDIKDEIAHISDMN

SEQ ID NO: 2065 - protein, 519 aa, unidentified
MDADEGQDMSQVSGKESPPVSDTPDEGDEPMPIPEDLSTTSGGQQSSKSDRVVASNVKVETQSDEENGRACEMNGEECAEDLRMLDASGEKMNGSHRDQGSSALSGVGGIRLPNGKLKCDICGIICIGPNVLMVHKRSHTGERPFQCNQCGASFTQKGNLLRHIKLHSGEKPFKCHLCNYACRRRDALTGHLRTHSVGKPHKCGYCGRSYKQRSSLEEHKERCHNYLESMGLPGTLYPVIKEETNHSEMAEDLCKIGSERSLVLDRLASNVAKRKSSMPQKFLGDKGLSDTPYDSSASYEKENEMMKSHVMDQAINNAINYLGAESLRPLVQTPPGGSEVVPVISPMYQLHKPLAEGTPRSNHSAQDSAVENLLLLSKAKLVPSEREASPSNSCQDSTDTESNNEEQRSGLIYLTNHIAPHARNGLSLKEEHRAYDLLRAASENSQDALRVVSTSGEQMKVYKCEHCRVLFLDHVMYTIHMGCHGFRDPFECNMCGYHSQDRYEFSSHITRGEHRFHMS

SEQ ID NO: 2066 - protein, 578 aa, unidentified
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNREPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 2067 - protein, 325 aa, unidentified
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYAFSPRNSLPQHLKEFLGHPHHNTLLFFSFPLSDENDVFDKLSVIAEDSESGKQNPGDSCSLGTPPGQGPQS

SEQ ID NO: 2068 - protein, 422 aa, unidentified
MSSSCSGLSRVLVAVATALVSASSPCPQAWGPPGVQYGQPGRSVKLCCPGVTAGDPVSWFRDGEPKLLQGPDSGLGHELVLAQADSTDEGTYICQTLDGALGGTVTLQLGYPPARPVVSCQAADYENFSCTWSPSQISGLPTRYLTSYRKKTVLGADSQRRSPSTGPWPCPQDPLGAARCVVHGAEFWSQYRINVTEVNPLGASTRLLDVSLQSILRPDPPQGLRVESVPGYPRRLRASWTYPASWPCQPHFLLKFRLQYRPAQHPAWSTVEPAGLEEVITDAVAGLPHAVRVSARDFLDAGTWSTWSPEAWGTPSTGTIPKEIPAWGQLHTQPEVEPQVDSPAPPRPSLQPHPRLLDHRDSVEQVAVLASLGILSFLGLVAGALALGLWLRLRRGGKDGSPKPGFLASVIPVDRRPGAPNL

SEQ ID NO: 2069 - protein, 219 aa, unidentified
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 2070 - protein, 662 aa, unidentified
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 2071 - protein, 862 aa, unidentified
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 2072 - protein, 427 aa, unidentified
MEWPARLCGLWALLLCAGGGGGGGGAAPTETQPPVTNLSVSVENLCTVIWTWNPPEGASSNCSLWYFSHFGDKQDKKIAPETRRSIEVPLNERICLQVGSQCSTNESEKPSILVEKCISPPEGDPESAVTELQCIWHNLSYMKCSWLPGRNTSPDTNYTLYYWHRSLEKIHQCENIFREGQYFGCSFDLTKVKDSSFEQHSVQIMVKDNAGKIKPSFNIVPLTSRVKPDPPHIKNLSFHNDDLYVQWENPQNFISRCLFYEVEVNNSQTETHNVFYVQEAKCENPEFERNVENTSCFMVPGVLPDTLNTVRIRVKTNKLCYEDDKLWSNWSQEMSIGKKRNSTLYITMLLIVPVIVAGAIIVLLLYLKRLKIIIFPPIPDPGKIFKEMFGDQNDDTLHWKKYDIYEKQTKEETDSVVLIENLKKASQ

SEQ ID NO: 2073 - protein, 380 aa, unidentified
MAFVCLAIGCLYTFLISTTFGCTSSSDTEIKVNPPQDFEIVDPGYLGYLYLQWQPPLSLDHFKECTVEYELKYRNIGSETWKTIITKNLHYKDGFDLNKGIEAKIHTLLPWQCTNGSEVQSSWAETTYWISPQGIPETKVQDMDCVYYNWQYLLCSWKPGIGVLLDTNYNLFYWYEGLDHALQCVDYIKADGQNIGCRFPYLEASDYKDFYICVNGSSENKPIRSSYFTFQLQNIVKPLPPVYLTFTRESSCEIKLKWSIPLGPIPARCFDYEIEIREDDTTLVTATVENETYTLKTTNETRQLCFVVRSKVNIYCSDDGIWSEWSDKQCWEGEDLSKKTLLRFWLPFGFILILVIFVTGLLLRKPNTYPKMIPEFFCDT

SEQ ID NO: 2074 - protein, 267 aa, unidentified
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 2075 - protein, 866 aa, unidentified
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAPRPEEFHQRSNVTLTLRNLKGCCRHQVQIQPFFSSCLNDCLRHSATVSCPEMPDTPEPIPDYMPLWVYWFITGISILLVGSVILLIVCMTWRLAGPGSEKYSDDTKYTDGLPAADLIPPPLKPRKVWIIYSADHPLYVDVVLKFAQFLLTACGTEVALDLLEEQAISEAGVMTWVGRQKQEMVESNSKIIVLCSRGTRAKWQALLGRGAPVRLRCDHGKPVGDLFTAAMNMILPDFKRPACFGTYVVCYFSEVSCDGDVPDLFGAAPRYPLMDRFEEVYFRIQDLEMFQPGRMHRVGELSGDNYLRSPGGRQLRAALDRFRDWQVRCPDWFECENLYSADDQDAPSLDEEVFEEPLLPPGTGIVKRAPLVREPGSQACLAIDPLVGEEGGAAVAKLEPHLQPRGQPAPQPLHTLVLAAEEGALVAAVEPGPLADGAAVRLALAGEGEACPLLGSPGAGRNSVLFLPVDPEDSPLGSSTPMASPDLLPEDVREHLEGLMLSLFEQSLSCQAQGGCSRPAMVLTDPHTPYEEEQRQSVQSDQGYISRSSPQPPEGLTEMEEEEEEEQDPGKPALPLSPEDLESLRSLQRQLLFRQLQKNSGWDTMGSESEGPSA

SEQ ID NO: 2076 - protein, 502 aa, unidentified
MSLVLLSLAALCRSAVPREPTVQCGSETGPSPEWMLQHDLIPGDLRDLRVEPVTTSVATGDYSILMNVSWVLRADASIRLLKATKICVTGKSNFQSYSCVRCNYTEAFQTQTRPSGGKWTFSYIGFPVELNTVYFIGAHNIPNANMNEDGPSMSVNFTSPGCLDHIMKYKKKCVKAGSLWDPNITACKKNEETVEVNFTTTPLGNRYMALIQHSTIIGFSQVFEPHQKKQTRASVVIPVTGDSEGATVQLTPYFPTCGSDCIRHKGTVVLCPQTGVPFPLDNNKSKPGGWLPLLLLSLLVATWVLVAGIYLMWRHERIKKTSFSTTTLLPPIKVLVVYPSEICFHHTICYFTEFLQNHCRSEVILEKWQKKKIAEMGPVQWLATQKKAADKVVFLLSNDVNSVCDGTCGKSEGSPSENSQDLFPLAFNLFCSDLRSQIHLHKYVVVYFREIDTKDDYNALSVCPKYHLMKDATAFCAELLHVKQQVSAGKRSQACHDGCCSL

SEQ ID NO: 2077 - protein, 791 aa, unidentified
MPVPWFLLSLALGRSPVVLSLERLVGPQDATHCSPVSLEPWGDEERLRVQFLAQQSLSLAPVTAATARTALSGLSGADGRREERGRGKSWVCLSLGGSGNTEPQKKGLSCRLWDSDILCLPGDIVPAPGPVLAPTHLQTELVLRCQKETDCDLCLRVAVHLAVHGHWEEPEDEEKFGGAADSGVEEPRNASLQAQVVLSFQAYPTARCVLLEVQVPAALVQFGQSVGSVVYDCFEAALGSEVRIWSYTQPRYEKELNHTQQLPDCRGLEVWNSIPSCWALPWLNVSADGDNVHLVLNVSEEQHFGLSLYWNQVQGPPKPRWHKNLTGPQIITLNHTDLVPCLCIQVWPLEPDSVRTNICPFREDPRAHQNLWQAARLQLLTLQSWLLDAPCSLPAEAALCWRAPGGDPCQPLVPPLSWENVTVDKVLEFPLLKGHPNLCVQVNSSEKLQLQECLWADSLGPLKDDVLLLETRGPQDNRSLCALEPSGCTSLPSKASTRAARLGEYLLQDLQSGQCLQLWDDDLGALWACPMDKYIHKRWALVWLACLLFAAALSLILLLKKDHAKGWLRLLKQDVRSGAAARGRAALLLYSADDSGFERLVGALASALCQLPLRVAVDLWSRRELSAQGPVAWFHAQRRQTLQEGGVVVLLFSPGAVALCSEWLQDGVSGPGAHGPHDAFRASLSCVLPDFLQGRAPGSYVGACFDRLLHPDAVPALFRTVPVFTLPSQLPDFLGALQQPRAPRSGRLQERAEQVSRALQPALDSYFHPPGTPAPGRGVGPGAGPGAGDGT

SEQ ID NO: 2078 - protein, 739 aa, unidentified
MAPWLQLCSVFFTVNACLNGSQLAVAAGGSGRARGADTCGWRGVGPASRNSGLYNITFKYDNCTTYLNPVGKHVIADAQNITISQYACHDQVAVTILWSPGALGIEFLKGFRVILEELKSEGRQCQQLILKDPKQLNSSFKRTGMESQPFLNMKFETDYFVKVVPFPSIKNESNYHPFFFRTRACDLLLQPDNLACKPFWKPRNLNISQHGSDMQVSFDHAPHNFGFRFFYLHYKLKHEGPFKRKTCKQEQTTETTSCLLQNVSPGDYIIELVDDTNTTRKVMHYALKPVHSPWAGPIRAVAITVPLVVISAFATLFTVMCRKKQQENIYSHLDEESSESSTYTAALPRERLRPRPKVFLCYSSKDGQNHMNVVQCFAYFLQDFCGCEVALDLWEDFSLCREGQREWVIQKIHESQFIIVVCSKGMKYFVDKKNYKHKGGGRGSGKGELFLVAVSAIAEKLRQAKQSSSAALSKFIAVYFDYSCEGDVPGILDLSTKYRLMDNLPQLCSHLHSRDHGLQEPGQHTRQGSRRNYFRSKSGRSLYVAICNMHQFIDEEPDWFEKQFVPFHPPPLRYREPVLEKFDSGLVLNDVMCKPGPESDFCLKVEAAVLGATGPADSQHESQHGGLDQDGEARPALDGSAALQPLLHTVKAGSPSDMPRDSGIYDSSVPSSELSLPLMEGLSTDQTETSSLTESVSSSSGLGEEEPPALPSKLLSSGSCKADLGCRSYTDELHAVAPL

SEQ ID NO: 2079 - protein, 667 aa, unidentified
MGSSRLAALLLPLLLIVIDLSDSAGIGFRHLPHWNTRCPLASHTDDSFTGSSAYIPCRTWWALFSTKPWCVRVWHCSRCLCQHLLSGGSGLQRGLFHLLVQKSKKSSTFKFYRRHKMPAPAQRKLLPRRHLSEKSHHISIPSPDISHKGLRSKRTQPSDPETWESLPRLDSQRHGGPEFSFDLLPEARAIRVTISSGPEVSVRLCHQWALECEELSSPYDVQKIVSGGHTVELPYEFLLPCLCIEASYLQEDTVRRKKCPFQSWPEAYGSDFWKSVHFTDYSQHTQMVMALTLRCPLKLEAALCQRHDWHTLCKDLPNATARESDGWYVLEKVDLHPQLCFKFSFGNSSHVECPHQTGSLTSWNVSMDTQAQQLILHFSSRMHATFSAAWSLPGLGQDTLVPPVYTVSQARGSSPVSLDLIIPFLRPGCCVLVWRSDVQFAWKHLLCPDVSYRHLGLLILALLALLTLLGVVLALTCRRPQSGPGPARPVLLLHAADSEAQRRLVGALAELLRAALGGGRDVIVDLWEGRHVARVGPLPWLWAARTRVAREQGTVLLLWSGADLRPVSGPDPRAAPLLALLHAAPRPLLLLAYFSRLCAKGDIPPPLRALPRYRLLRDLPRLLRALDARPFAEATSWGRLGARQRRQSRLELCSRLEREAARLADLG

SEQ ID NO: 2080 - protein, 541 aa, unidentified
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEENGSDPNIHEEKEMRIMTPEGKWHASKVLRIENIGESNLNVLYNCTVASTGGTDTKSFILVRKADMADIPGHVFTRGMIIAVLILVAVVCLVTVCVIYRVDLVLFYRHLTRRDETLTDGKTYDAFVSYLKECRPENGEEHTFAVEILPRVLEKHFGYKLCIFERDVVPGGAVVDEIHSLIEKSRRLIIVLSKSYMSNEVRYELESGLHEALVERKIKIILIEFTPVTDFTFLPQSLKLLKSHRVLKWKADKSLSYNSRFWKNLLYLMPAKTVKPGRDEPEVLPVLSES

SEQ ID NO: 2081 - protein, 599 aa, unidentified
MLCLGWIFLWLVAGERIKGFNISGCSTKKLLWTYSTRSEEEFVLFCDLPEPQKSHFCHRNRLSPKQVPEHLPFMGSNDLSDVQWYQQPSNGDPLEDIRKSYPHIIQDKCTLHFLTPGVNNSGSYICRPKMIKSPYDVACCVKMILEVKPQTNASCEYSASHKQDLLLGSTGSISCPSLSCQSDAQSPAVTWYKNGKLLSVERSNRIVVDEVYDYHQGTYVCDYTQSDTVSSWTVRAVVQVRTIVGDTKLKPDILDPVEDTLEVELGKPLTISCKARFGFERVFNPVIKWYIKDSDLEWEVSVPEAKSIKSTLKDEIIERNIILEKVTQRDLRRKFVCFVQNSIGNTTQSVQLKEKRGVVLLYILLGTIGTLVAVLAASALLYRHWIEIVLLYRTYQSKDQTLGDKKDFDAFVSYAKWSSFPSEATSSLSEEHLALSLFPDVLENKYGYSLCLLERDVAPGGVYAEDIVSIIKRSRRGIFILSPNYVNGPSIFELQAAVNLALDDQTLKLILIKFCYFQEPESLPHLVKKALRVLPTVTWRGLKSVPPNSRFWAKMRYHMPVKNSQGFTWNQLRITSRIFQWKGLSRTETTGRSSQPKEW

SEQ ID NO: 2082 - protein, 177 aa, unidentified
MKLQCVSLWLLGTILILCSVDNHGLRRCLISTDMHHIEESFQEIKRAIQAKDTFPNVTILSTLETLQIIKPLDVCCVTKNLLAFYVDRVFKDHQEPNPKILRKISSIANSFLYMQKTLRQCQEQRQCHCRQEATNATRVIHDNYDQLEVHAAAIKSLGELDVFLAWINKNHEVMFSA

SEQ ID NO: 2083 - protein, 569 aa, unidentified
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLSDIAYWKWNGSVIDEDDPVLGEDYYSVENPANKRRSTLITVLNISEIESRFYKHPFTCFAKNTHGIDAAYIQLIYPVTNFQKHMIGICVTLTVIIVCSVFIYKIFKIDIVLWYRDSCYDFLPIKASDGKTYDAYILYPKTVGEGSTSDCDIFVFKVLPEVLEKQCGYKLFIYGRDDYVGEDIVEVINENVKKSRRLIIILVRETSGFSWLGGSSEEQIAMYNALVQDGIKVVLLELEKIQDYEKMPESIKFIKQKHGAIRWSGDFTQGPQSAKTRFWKNVRYHMPVQRRSPSSKHQLLSPATKEKLQREAHVPLG

SEQ ID NO: 2084 - protein, 398 aa, unidentified
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLTIPCKVFLGTGTPLTTMLWWTANDTHIESAYPGGRVTEGPRQEYSENNENYIEVPLIFDPVTREDLHMDFKCVVHNTLSFQTLRTTVKEASSTFSWGIVLAPLSLAFLVLGGIWMHRRCKHRTGKADGLTVLWPHHQDFQSYPK

SEQ ID NO: 2085 - protein, 570 aa, unidentified
MTLLWCVVSLYFYGILQSDASERCDDWGLDTMRQIQVFEDEPARIKCPLFEHFLKFNYSTAHSAGLTLIWYWTRQDRDLEEPINFRLPENRISKEKDVLWFRPTLLNDTGNYTCMLRNTTYCSKVAFPLEVVQKDSCFNSPMKLPVHKLYIEYGIQRITCPNVDGYFPSSVKPTITWYMGCYKIQNFNNVIPEGMNLSFLIALISNNGNYTCVVTYPENGRTFHLTRTLTVKVVGSPKNAVPPVIHSPNDHVVYEKEPGEELLIPCTVYFSFLMDSRNEVWWTIDGKKPDDITIDVTINESISHSRTEDETRTQILSIKKVTSEDLKRSYVCHARSAKGEVAKAAKVKQKVPAPRYTVELACGFGATVLLVVILIVVYHVYWLEMVLFYRAHFGTDETILDGKEYDIYVSYARNAEEEEFVLLTLRGVLENEFGYKLCIFDRDSLPGGIVTDETLSFIQKSRRLLVVLSPNYVLQGTQALLELKAGLENMASRGNINVILVQYKAVKETKVKELKRAKTVLTVIKWKGEKSKYPQGRFWKQLQVAMPVKKSPRRSSSDEQGLSYSSLKNV

SEQ ID NO: 2086 - protein, 696 aa, unidentified
MKAPIPHLILLYATFTQSLKVVTKRGSADGCTDWSIDIKKYQVLVGEPVRIKCALFYGYIRTNYSLAQSAGLSLMWYKSSGPGDFEEPIAFDGSRMSKEEDSIWFRPTLLQDSGLYACVIRNSTYCMKVSISLTVGENDTGLCYNSKMKYFEKAELSKSKEISCRDIEDFLLPTREPEILWYKECRTKTWRPSIVFKRDTLLIREVREDDIGNYTCELKYGGFVVRRTTELTVTAPLTDKPPKLLYPMESKLTIQETQLGDSANLTCRAFFGYSGDVSPLIYWMKGEKFIEDLDENRVWESDIRILKEHLGEQEVSISLIVDSVEEGDLGNYSCYVENGNGRRHASVLLHKRELMYTVELAGGLGAILLLLVCLVTIYKCYKIEIMLFYRNHFGAEELDGDNKDYDAYLSYTKVDPDQWNQETGEEERFALEILPDMLEKHYGYKLFIPDRDLIPTGTYIEDVARCVDQSKRLIIVMTPNYVVRRGWSIFELETRLRNMLVTGEIKVILIECSELRGIMNYQEVEALKHTIKLLTVIKWHGPKCNKLNSKFWKRLQYEMPFKRIEPITHEQALDVSEQGPFGELQTVSAISMAAATSTALATAHPDLRSTFHNTYHSQMRQKHYYRSYEYDVPPTGTLPLTSIGNQHTYCNIPMTLINGQRPQTKSSREQNPDEAHTNSAILPLLPRETSISSVIW

SEQ ID NO: 2087 - protein, 686 aa, unidentified
MKPPFLLALVVCSVVSTNLKMVSKRNSVDGCIDWSVDLKTYMALAGEPVRVKCALFYSYIRTNYSTAQSTGLRLMWYKNKGDLEEPIIFSEVRMSKEEDSIWFHSAEAQDSGFYTCVLRNSTYCMKVSMSLTVAENESGLCYNSRIRYLEKSEVTKRKEISCPDMDDFKKSDQEPDVVWYKECKPKMWRSIIIQKGNALLIQEVQEEDGGNYTCELKYEGKLVRRTTELKVTALLTDKPPKPLFPMENQPSVIDVQLGKPLNIPCKAFFGFSGESGPMIYWMKGEKFIEELAGHIREGEIRLLKEHLGEKEVELALIFDSVVEADLANYTCHVENRNGRKHASVLLRKKDLIYKIELAGGLGAIFLLLVLLVVIYKCYNIELMLFYRQHFGADETNDDNKEYDAYLSYTKVDQDTLDCDNPEEEQFALEVLPDVLEKHYGYKLFIPERDLIPSGTYMEDLTRYVEQSRRLIIVLTPDYILRRGWSIFELESRLHNMLVSGEIKVILIECTELKGKVNCQEVESLKRSIKLLSLIKWKGSKSSKLNSKFWKHLVYEMPIKKKEMLPRCHVLDSAEQGLFGELQPIPSIAMTSTSATLVSSQADLPEFHPSDSMQIRHCCRGYKHEIPATTLPVPSLGNHHTYCNLPLTLLNGQLPLNNTLKDTQEFHRNSSLLPLSSKELSFTSDIW

SEQ ID NO: 2088 - protein, 556 aa, unidentified
MGFWILAILTILMYSTAAKFSKQSWGLENEALIVRCPRQGKPSYTVDWYYSQTNKSIPTQERNRVFASGQLLKFLPAAVADSGIYTCIVRSPTFNRTGYANVTIYKKQSDCNVPDYLMYSTVSGSEKNSKIYCPTIDLYNWTAPLEWFKNCQALQGSRYRAHKSFLVIDNVMTEDAGDYTCKFIHNENGANYSVTATRSFTVKDEQGFSLFPVIGAPAQNEIKEVEIGKNANLTCSACFGKGTQFLAAVLWQLNGTKITDFGEPRIQQEEGQNQSFSNGLACLDMVLRIADVKEEDLLLQYDCLALNLHGLRRHTVRLSRKNPIDHHSIYCIIAVCSVFLMLINVLVIILKMFWIEATLLWRDIAKPYKTRNDGKLYDAYVVYPRNYKSSTDGASRVEHFVHQILPDVLENKCGYTLCIYGRDMLPGEDVVTAVETNIRKSRRHIFILTPQITHNKEFAYEQEVALHCALIQNDAKVILIEMEALSELDMLQAEALQDSLQHLMKVQGTIKWREDHIANKRSLNSKFWKHVRYQMPVPSKIPRKASSLTPLAAQKQ

SEQ ID NO: 2089 - protein, 575 aa, unidentified
MWSLLLCGLSIALPLSVTADGCKDIFMKNEILSASQPFAFNCTFPPITSGEVSVTWYKNSSKIPVSKIIQSRIHQDETWILFLPMEWGDSGVYQCVIKGRDSCHRIHVNLTVFEKHWCDTSIGGLPNLSDEYKQILHLGKDDSLTCHLHFPKSCVLGPIKWYKDCNEIKGERFTVLETRLLVSNVSAEDRGNYACQAILTHSGKQYEVLNGITVSITERAGYGGSVPKIIYPKNHSIEVQLGTTLIVDCNVTDTKDNTNLRCWRVNNTLVDDYYDESKRIREGVETHVSFREHNLYTVNITFLEVKMEDYGLPFMCHAGVSTAYIILQLPAPDFRAYLIGGLIALVAVAVSVVYIYNIFKIDIVLWYRSAFHSTETIVDGKLYDAYVLYPKPHKESQRHAVDALVLNILPEVLERQCGYKLFIFGRDEFPGQAVANVIDENVKLCRRLIVIVVPESLGFGLLKNLSEEQIAVYSALIQDGMKVILIELEKIEDYTVMPESIQYIKQKHGAIRWHGDFTEQSQCMKTKFWKTVRYHMPPRRCRPFPPVQLLQHTPCYRTAGPELGSRRKKCTLTTG

SEQ ID NO: 2090 - protein, 553 aa, unidentified
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWYVLPVSITVFLFSVMGYSIYRYIHVGKEKHPANLILIYGNEFDKRFFVPAEKIVINFITLNISDDSKISHQDMSLLGKSSDVSSLNDPQPSGNLRPPQEEEEVKHLGYASHLMEIFCDSEENTEGTSLTQQESLSRTIPPDKTVIEYEYDVRTTDICAGPEEQELSLQEEVSTQGTLLESQAALAVLGPQTLQYSYTPQLQDLDPLAQEHTDSEEGPEEEPSTTLVDWDPQTGRLCIPSLSSFDQDSEGCEPSEGDGLGEEGLLSRLYEEPAPDRPPGENETYLMQFMEEWGLYVQMEN

SEQ ID NO: 2091 - protein, 311 aa, unidentified
MQTFTMVLEEIWTSLFMWFFYALIPCLLTDEVAILPAPQNLSVLSTNMKHLLMWSPVIAPGETVYYSVEYQGEYESLYTSHIWIPSSWCSLTEGPECDVTDDITATVPYNLRVRATLGSQTSAWSILKHPFNRNSTILTRPGMEITKDGFHLVIELEDLGPQFEFLVAYWRREPGAEEHVKMVRSGGIPVHLETMEPGAAYCVKAQTFVKAIGRYSAFSQTECVEVQGEAIPLVLALFAFVGFMLILVVVPLFVWKMGRLLQYSCCPVVVLPDTLKITNSPQKLISCRREEVDACATAVMSPEELLRAWIS

SEQ ID NO: 2092 - protein, 538 aa, unidentified
MPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEGWNPHLLLLLLLVIVFIPAFWSLKTHPLWRLWKKIWAVPSPERFFMPLYKGCSGDFKKWVGAPFTGSSLELGPWSPEVPSTLEVYSCHPPRSPAKRLQLTELQEPAELVESDGVPKPSFWPTAQNSGGSAYSEERDRPYGLVSIDTVTVLDAEGPCTWPCSCEDDGYPALDLDAGLEPSPGLEDPLLDAGTTVLSCGCVSAGSPGLGGPLGSLLDRLKPPLADGEDWAGGLPWGGRSPGGVSESEAGSPLAGLDMDTFDSGFVGSDCSSPVECDFTSPGDEGPPRSYLRQWVVIPPPLSSPGPQAS

SEQ ID NO: 2093 - protein, 574 aa, unidentified
MRTLLTILTVGSLAAHAPEDPSDLLQHVKFQSSNFENILTWDSGPEGTPDTVYSIEYKTYGERDWVAKKGCQRITRKSCNLTVETGNLTELYYARVTAVSAGGRSATKMTDRFSSLQHTTLKPPDVTCISKVRSIQMIVHPTPTPIRAGDGHRLTLEDIFHDLFYHLELQVNRTYQMHLGGKQREYEFFGLTPDTEFLGTIMICVPTWAKESAPYMCRVKTLPDRTWTYSFSGAFLFSMGFLVAVLCYLSYRYVTKPPAPPNSLNVQRVLTFQPLRFIQEHVLIPVFDLSGPSSLAQPVQYSQIRVSGPREPAGAPQRHSLSEITYLGQPDISILQPSNVPPPQILSPLSYAPNAAPEVGPPSYAPQVTPEAQFPFYAPQAISKVQPSSYAPQATPDSWPPSYGVCMEGSGKDSPTGTLSSPKHLRPKGQLQKEPPAGSCMLGGLSLQEVTSLAMEESQEAKSLHQPLGICTDRTSDPNVLHSGEEGTPQYLKGQLPLLSSVQIEGHPMSLPLQPPSRPCSPSDQGPSPWGLLESLVCPKDEAKSPAPETSDLEQPTELDSLFRGLALTVQWES

SEQ ID NO: 2094 - protein, 629 aa, unidentified
MNQVTIQWDAVIALYILFSWCHGGITNINCSGHIWVEPATIFKMGMNISIYCQAAIKNCQPRKLHFYKNGIKERFQITRINKTTARLWYKNFLEPHASMYCTAECPKHFQETLICGKDISSGYPPDIPDEVTCVIYEYSGNMTCTWNAGKLTYIDTKYVVHVKSLETEEEQQYLTSSYINISTDSLQGGKKYLVWVQAANALGMEESKQLQIHLDDIVIPSAAVISRAETINATVPKTIIYWDSQTTIEKVSCEMRYKATTNQTWNVKEFDTNFTYVQQSEFYLEPNIKYVFQVRCQETGKRYWQPWSSLFFHKTPETVPQVTSKAFQHDTWNSGLTVASISTGHLTSDNRGDIGLLLGMIVFAVMLSILSLIGIFNRSFRTGIKRRILLLIPKWLYEDIPNMKNSNVVKMLQENSELMNNNSSEQVLYVDPMITEIKEIFIPEHKPTDYKKENTGPLETRDYPQNSLFDNTTVVYIPDLNTGYKPQISNFLPEGSHLSNNNEITSLTLKPPVDSLDSGNNPRLQKHPNFAFSVSSVNSLSNTIFLGELSLILNQGECSSPDIQNSVEEETTMLLENDSPSETIPEQTLLPDEFVSCLGIVNEELPSINTYFPQNILESHFNRISLLEK

SEQ ID NO: 2095 - protein, 636 aa, unidentified
MRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLWKAPGPCVQVSYKVWFWVGGRELSPEGITCCCSLIPSGAEWARVSAVNATSWEPLTNLSLVCLDSASAPRSVAVSSIAGSTELLVTWQPGPGEPLEHVVDWARDGDPLEKLNWVRLPPGNLSALLPGNFTVGVPYRITVTAVSASGLASASSVWGFREELAPLVGPTLWRLQDAPPGTPAIAWGEVPRHQLRGHLTHYTLCAQSGTSPSVCMNVSGNTQSVTLPDLPWGPCELWVTASTIAGQGPPGPILRLHLPDNTLRWKVLPGILFLWGLFLLGCGLSLATSGRCYHLRHKVLPRWVWEKVPDPANSSSGQPHMEQVPEAQPLGDLPILEVEEMEPPPVMESSQPAQATAPLDSGYEKHFLPTPEELGLLGPPRPQVLA

SEQ ID NO: 2096 - protein, 200 aa, unidentified
MDSYLLMWGLLTFIMVPGCQAELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGEEKPQASPEGRPESETSCLVTTTDFQIQTEMAATMETSIFTTEYQVAVAGCVFLLISVLLLSGLTWQRRQRKSRRTI

SEQ ID NO: 2097 - protein, 551 aa, unidentified
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 2098 - protein, 369 aa, unidentified
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 2099 - protein, 732 aa, unidentified
MMWTWALWMLPSLCKFSLAALPAKPENISCVYYYRKNLTCTWSPGKETSYTQYTVKRTYAFGEKHDNCTTNSSTSENRASCSFFLPRITIPDNYTIEVEAENGDGVIKSHMTYWRLENIAKTEPPKIFRVKPVLGIKRMIQIEWIKPELAPVSSDLKYTLRFRTVNSTSWMEVNFAKNRKDKNQTYNLTGLQPFTEYVIALRCAVKESKFWSDWSQEKMGMTEEEAPCGLELWRVLKPAEADGRRPVRLLWKKARGAPVLEKTLGYNIWYYPESNTNLTETMNTTNQQLELHLGGESFWVSMISYNSLGKSPVATLRIPAIQEKSFQCIEVMQACVAEDQLVVKWQSSALDVNTWMIEWFPDVDSEPTTLSWESVSQATNWTIQQDKLKPFWCYNISVYPMLHDKVGEPYSIQAYAKEGVPSEGPETKVENIGVKTVTITWKEIPKSERKGIICNYTIFYQAEGGKGFSKTVNSSILQYGLESLKRKTSYIVQVMASTSAGGTNGTSINFKTLSFSVFEIILITSLIGGGLLILIILTVAYGLKKPNKLTHLCWPTVPNPAESSIATWHGDDFKDKLNLKESDDSVNTEDRILKPCSTPSDKLVIDKLVVNFGNVLQEIFTDEARTGQENNLGGEKNGYVTCPFRPDCPLGKSFEELPVSPEIPPRKSQYLRSRMPEGTRPEAKEQLLFSGQSLVPDHLCEEGAPNPYLKNSVTAREFLVSEKLPEHTKGEV

SEQ ID NO: 2100 - protein, 378 aa, unidentified
MVLLWLTLLLIALPCLLQTKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWRTSLLIALGTLLALVCVFVICRRYLVMQRLFPRIPHMKDPIGDSFQNDKLVVWEAGKAGLEECLVTEVQVVQKT

SEQ ID NO: 2101 - protein, 825 aa, unidentified
MGWLCSGLLFPVSCLVLLQVASSGNMKVLQEPTCVSDYMSISTCEWKMNGPTNCSTELRLLYQLVFLLSEAHTCIPENNGGAGCVCHLLMDDVVSADNYTLDLWAGQQLLWKGSFKPSEHVKPRAPGNLTVHTNVSDTLLLTWSNPYPPDNYLYNHLTYAVNIWSENDPADFRIYNVTYLEPSLRIAASTLKSGISYRARVRAWAQCYNTTWSEWSPSTKWHNSYREPFEQHLLLGVSVSCIVILAVCLLCYVSITKIKKEWWDQIPNPARSRLVAIIIQDAQGSQWEKRSRGQEPAKCPHWKNCLTKLLPCFLEHNMKRDEDPHKAAKEMPFQGSGKSAWCPVEISKTVLWPESISVVRCVELFEAPVECEEEEEVEEEKGSFCASPESSRDDFQEGREGIVARLTESLFLDLLGEENGGFCQQDMGESCLLPPSGSTSAHMPWDEFPSAGPKEAPPWGKEQPLHLEPSPPASPTQSPDNLTCTETPLVIAGNPAYRSFSNSLSQSPCPRELGPDPLLARHLEEVEPEMPCVPQLSEPTTVPQPEPETWEQILRRNVLQHGAAAAPVSAPTSGYQEFVHAVEQGGTQASAVVGLGPPGEAGYKAFSSLLASSAVSPEKCGFGASSGEEGYKPFQDLIPGCPGDPAPVPVPLFTFGLDREPPRSPQSSHLPSSSPEHLGLEPGEKVEDMPKPPLPQEQATDPLVDSLGSGIVYSALTCHLCGHLKQCHGQEDGGQTPVMASPCCGCCCGDRSSPPTTPLRAPDPSPGGVPLEASLCPASLAPSGISEKSKSSSSFHPAPGNAQSSSQTPKIVNFVSVGPTYMRVS

SEQ ID NO: 2102 - protein, 420 aa, unidentified
MIIVAHVLLILLGATEILQADLLPDEKISLLPPVNFTIKVTGLAQVLLQWKPNPDQEQRNVNLEYQVKINAPKEDDYETRITESKCVTILHKGFSASVRTILQNDHSLLASSWASAELHAPPGSPGTSIVNLTCTTNTTEDNYSRLRSYQVSLHCTWLVGTDAPEDTQYFLYYRYGSWTEECQEYSKDTLGRNIACWFPRTFILSKGRDWLAVLVNGSSKHSAIRPFDQLFALHAIDQINPPLNVTAEIEGTRLSIQWEKPVSAFPIHCFDYEVKIHNTRNGYLQIEKLMTNAFISIIDDLSKYDVQVRAAVSSMCREAGLWSEWSQPIYVGNDEHKPLREWFVIVIMATICFILLILSLICKICHLWIKLFPPIPAPKSNIKDLFVTTNYEKAGSSETEIEVICYIEKPGVETLEDSVF

SEQ ID NO: 2103 - protein, 468 aa, unidentified
MLAVGCALLAALLAAPGAALAPRRCPAQEVARGVLTSLPGDSVTLTCPGVEPEDNATVHWVLRKPAAGSHPSRWAGMGRRLLLRSVQLHDSGNYSCYRAGRPAGTVHLLVDVPPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAENEVSTPMQALTTNKDDDNILFRDSANATSLPVQDSSSVPLPTFLVAGGSLAFGTLLCIAIVLRFKKTWKLRALKEGKTSMHPPYSLGQLVPERPRPTPVLVPLISPPVSPSSLGSDNTSSHNRPDARDPRSPYDISNTDYFFPR

SEQ ID NO: 2104 - protein, 918 aa, unidentified
MLTLQTWLVQALFIFLTTESTGELLDPCGYISPESPVVQLHSNFTAVCVLKEKCMDYFHVNANYIVWKTNHFTIPKEQYTIINRTASSVTFTDIASLNIQLTCNILTFGQLEQNVYGITIISGLPPEKPKNLSCIVNEGKKMRCEWDGGRETHLETNFTLKSEWATHKFADCKAKRDTPTSCTVDYSTVYFVNIEVWVEAENALGKVTSDHINFDPVYKVKPNPPHNLSVINSEELSSILKLTWTNPSIKSVIILKYNIQYRTKDASTWSQIPPEDTASTRSSFTVQDLKPFTEYVFRIRCMKEDGKGYWSDWSEEASGITYEDRPSKAPSFWYKIDPSHTQGYRTVQLVWKTLPPFEANGKILDYEVTLTRWKSHLQNYTVNATKLTVNLTNDRYLATLTVRNLVGKSDAAVLTIPACDFQATHPVMDLKAFPKDNMLWVEWTTPRESVKKYILEWCVLSDKAPCITDWQQEDGTVHRTYLRGNLAESKCYLITVTPVYADGPGSPESIKAYLKQAPPSKGPTVRTKKVGKNEAVLEWDQLPVDVQNGFIRNYTIFYRTIIGNETAVNVDSSHTEYTLSSLTSDTLYMVRMAAYTDEGGKDGPEFTFTTPKFAQGEIEAIVVPVCLAFLLTTLLGVLFCFNKRDLIKKHIWPNVPDPSKSHIAQWSPHTPPRHNFNSKDQMYSDGNFTDVSVVEIEANDKKPFPEDLKSLDLFKKEKINTEGHSSGIGGSSCMSSSRPSISSSDENESSQNTSSTVQYSTVVHSGYRHQVPSVQVFSRSESTQPLLDSEERPEDLQLVDHVDGGDGILPRQQYFKQNCSQHESSPDISHFERSKQVSSVNEEDFVRLKQQISDHISQSCGSGQMKMFQEVSAADAFGPGTEGQVERFETVGMEAATDEGMPKSYLPQTVRQGGYMPQ

SEQ ID NO: 2105 - protein, 459 aa, unidentified
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 2106 - protein, 521 aa, unidentified
MGLGRCIWEGWTLESEALRRDMGTWLLACICICTCVCLGVSVTGEGQGPRSRTFTCLTNNILRIDCHWSAPELGQGSSPWLLFTSNQAPGGTHKCILRGSECTVVLPPEAVLVPSDNFTITFHHCMSGREQVSLVDPEYLPRRHVKLDPPSDLQSNISSGHCILTWSISPALEPMTTLLSYELAFKKQEEAWEQAQHRDHIVGVTWLILEAFELDPGFIHEARLRVQMATLEDDVVEEERYTGQWSEWSQPVCFQAPQRQGPLIPPWGWPGNTLVAVSIFLLLTGPTYLLFKLSPRVKRIFYQNVPSPAMFFQPLYSVHNGNFQTWMGAHGAGVLLSQDCAGTPQGALEPCVQEATALLTCGPARPWKSVALEEEQEGPGTRLPGNLSSEDVLPAGCTEWRVQTLAYLPQEDWAPTSLTRPAPPDSEGSRSSSSSSSSNNNNYCALGCYGGWHLSALPGNTQSSGPIPALACGLSCDHQGLETQQGVAWVLAGHCQRPGLHEDLQGMLLPSVLSKARSWTF

SEQ ID NO: 2107 - protein, 546 aa, unidentified
MAWPKLPAPWLLLCTWLPAGCLSLLVTVQHTERYVTLFASIILKCDYTTSAQLQDVVVTWRFKSFCKDPIFDYYSASYQAALSLGQDPSNDCNDNQREVRIVAQRRGQNEPVLGVDYRQRKITIQNRADLVINEVMWWDHGVYYCTIEAPGDTSGDPDKEVKLIVLHWLTVIFIILGALLLLLLIGVCWCQCCPQYCCCYIRCPCCPAHCCCPEEALARHRYMKQAQALGPQMMGKPLYWGADRSSQVSSYPMHPLLQRDLSLPSSLPQMPMTQTTNQPPIANGVLEYLEKELRNLNLAQPLPPDLKGRFGHPCSMLSSLGSEVVERRIIHLPPLIRDLSSSRRTSDSLHQQWLTPIPSRPWDLREGRSHHHYPDFHQELQDRGPKSWALERRELDPSWSGRHRSSRLNGSPIHWSDRDSLSDVPSSSEARWRPSHPPFRSRCQERPRRPSPRESTQRHGRRRRHRSYSPPLPSGLSSWSSEEDKERQPQSWRAHRRGSHSPHWPEEKPPSYRSLDITPGKNSRKKGSVERRSEKDSSHSGRSVVI

SEQ ID NO: 2108 - protein, 639 aa, unidentified
MDRVLLRWISLFWLTAMVEGLQVTVPDKKKVAMLFQPTVLRCHFSTSSHQPAVVQWKFKSYCQDRMGESLGMSSTRAQSLSKRNLEWDPYLDCLDSRRTVRVVASKQGSTVTLGDFYRGREITIVHDADLQIGKLMWGDSGLYYCIITTPDDLEGKNEDSVELLVLGRTGLLADLLPSFAVEIMPEWVFVGLVLLGVFLFFVLVGICWCQCCPHSCCCYVRCPCCPDSCCCPQALYEAGKAAKAGYPPSVSGVPGPYSIPSVPLGGAPSSGMLMDKPHPPPLAPSDSTGGSHSVRKGYRIQADKERDSMKVLYYVEKELAQFDPARRMRGRYNNTISELSSLHEEDSNFRQSFHQMRSKQFPVSGDLESNPDYWSGVMGGSSGASRGPSAMEYNKEDRESFRHSQPRSKSEMLSRKNFATGVPAVSMDELAAFADSYGQRPRRADGNSHEARGGSRFERSESRAHSGFYQDDSLEEYYGQRSRSREPLTDADRGWAFSPARRRPAEDAHLPRLVSRTPGTAPKYDHSYLGSARERQARPEGASRGGSLETPSKRSAQLGPRSASYYAWSPPGTYKAGSSQDDQEDASDDALPPYSELELTRGPSYRGRDLPYHSNSEKKRKKEPAKKTNDFPTRMSLVV

SEQ ID NO: 2109 - protein, 632 aa, unidentified
METPAAAAPAGSLFPSFLLLACGTLVAALLGAAHRLGLFYQLLHKVDKASVRHGGENVAAVLRAHGVRFIFTLVGGHISPLLVACEKLGIRVVDTRHEVTAVFAADAMARLSGTVGVAAVTAGPGLTNTVTAVKNAQMAQSPILLLGGAASTLLQNRGALQAVDQLSLFRPLCKFCVSVRRVRDIVPTLRAAMAAAQSGTPGPVFVELPVDVLYPYFMVQKEMVPAKPPKGLVGRVVSWYLENYLANLFAGAWEPQPEGPLPLDIPQASPQQVQRCVEILSRAKRPLMVLGSQALLTPTSADKLRAAVETLGVPCFLGGMARGLLGRNHPLHIRENRSAALKKADVIVLAGTVCDFRLSYGRVLSHSSKIIIVNRNREEMLLNSDIFWKPQEAVQGDVGSFVLKLVEGLQGQTWAPDWVEELREADRQKEQTFREKAAMPVAQHLNPVQVLQLVEETLPDNSILVVDGGDFVGTAAHLVQPRGPLRWLDPGAFGTLGVGAGFALGAKLCRPDAEVWCLFGDGAFGYSLIEFDTFVRHKIPVMALVGNDAGWTQISREQVPSLGSNVACGLAYTDYHKAAMGLGARGLLLSRENEDQVVKVLHDAQQQCRDGHPVVVNILIGRTDFRDGSIAV

SEQ ID NO: 2110 - protein, 175 aa, unidentified
MAQSQGWVKRYIKAFCKGFFVAVPVAVTFLDRVACVARVEGASMQPSLNPGGSQSSDVVLLNHWKVRNFEVHRGDIVSLVSPKNPEQKIIKRVIALEGDIVRTIGHKNRYVKVPRGHIWVEGDHHGHSFDSNSFGPVSLGLLHAHATHILWPPERWQKLESVLPPERLPVQREEE

SEQ ID NO: 2111 - protein, 359 aa, unidentified
MAPMGIRLSPLGVAVFCLLGLGVLYHLYSGFLAGRFSLFGLGGEPGGGAAGPAAAADGGTVDLREMLAVSVLAAVRGGDEVRRVRESNVLHEKSKGKTREGAEDKMTSGDVLSNRKMFYLLKTAFPSVQINTEEHVDAADQEVILWDHKIPEDILKEVTTPKEVPAESVTVWIDPLDATQEYTEDLRKYVTTMVCVAVNGKPMLGVIHKPFSEYTAWAMVDGGSNVKARSSYNEKTPRIVVSRSHSGMVKQVALQTFGNQTTIIPAGGAGYKVLALLDVPDKSQEKADLYIHVTYIKKWDICAGNAILKALGGHMTTLSGEEISYTGSDGIEGGLLASIRMNHQALVRKLPDLEKTGHK

SEQ ID NO: 2112 - protein, 1241 aa, unidentified
MIMFPLFGKISLGILIFVLIEGDFPSLTAQTYLSIEEIQEPKSAVSFLLPEESTDLSLATKKKQPLDRRETERQWLIRRRRSILFPNGVKICPDESVAEAVANHVKYFKVRVCQEAVWEAFRTFWDRLPGREEYHYWMNLCEDGVTSIFEMGTNFSESVEHRSLIMKKLTYAKETVSSSELSSPVPVGDTSTLGDTTLSVPHPEVDAYEGASESSLERPEESISNEIENVIEEATKPAGEQIAEFSIHLLGKQYREELQDSSSFHHQHLEEEFISEVENAFTGLPGYKEIRVLEFRSPKENDSGVDVYYAVTFNGEAISNTTWDLISLHSNKVENHGLVELDDKPTVVYTISNFRDYIAETLQQNFLLGNSSLNPDPDSLQLINVRGVLRHQTEDLVWNTQSSSLQATPSSILDNTFQAAWPSADESITSSIPPLDFSSGPPSATGRELWSESPLGDLVSTHKLAFPSKMGLSSSPEVLEVSSLTLHSVTPAVLQTGLPVASEERTSGSHLVEDGLANVEESEDFLSIDSLPSSSFTQPVPKETIPSMEDSDVSLTSSPYLTSSIPFGLDSLTSKVKDQLKVSPFLPDASMEKELIFDGGLGSGSGQKVDLITWPWSETSSEKSAEPLSKPWLEDDDSLLPAEIEDKKLVLVDKMDSTDQISKHSKYEHDDRSTHFPEEEPLSGPAVPIFADTAAESASLTLPKHISEVPGVDDYSVTKAPLILTSVAISASTDKSDQADAILREDMEQITESSNYEWFDSEVSMVKPDMQTLWTILPESERVWTRTSSLEKLSRDILASTPQSADRLWLSVTQSTKLPPTTISTLLEDEVIMGVQDISLELDRIGTDYYQPEQVQEQNGKVGSYVEMSTSVHSTEMVSVAWPTEGGDDLSYTQTSGALVVFFSLRVTNMMFSEDLFNKNSLEYKALEQRFLELLVPYLQSNLTGFQNLEILNFRNGSIVVNSRMKFANSVPPNVNNAVYMILEDFCTTAYNTMNLAIDKYSLDVESGDEANPCKFQACNEFSECLVNPWSGEAKCRCFPGYLSVEERPCQSLCDLQPDFCLNDGKCDIMPGHGAICRCRVGENWWYRGKHCEEFVSEPVIIGITIASVVGLLVIFSAIIYFFIRTLQAHHDRSERESPFSGSSRQPDSLSSIENAVKYNPVYESHRAGCEKYEGPYPQHPFYSSASGDVIGGLSREEIRQMYESSELSREEIQERMRVLELYANDPEFAAFVREQQVEEV

SEQ ID NO: 2113 - protein, 192 aa, unidentified
MAAQIPIVATTSTPGIVRNSKKRPASPSHNGSSGGGYGASKKKKASASSFAQGISMEAMSENKMVPSEFSTGPVEKAAKPLPFKDPNFVHSGHGGAVAGKKNRTWKNLKQILASERALPWQLNDPNYFSIDAPPSFKPAKKYSDVSGLLANYTDPQSKLRFSTIEEFSYIRRLPSDVVTGYLALRKATSIVP

SEQ ID NO: 2114 - protein, 977 aa, unidentified
MTAREHSPRHGARARAMQRASTIDVAADMLGLSLAGNIQDPDEPILEFSLACSELHTPSLDRKPNSFVAVSVTTPPQAFWTKHAQTEIIEGTNNPIFLSSIAFFQDSLINQMTQVKLSVYDVKDRSQGTMYLLGSGTFIVKDLLQDRHHRLHLTLRSAESDRVGNITVIGWQMEEKSDQRPPVTRSVDTVNGRMVLPVDESLTEALGIRSKYASLRKDTLLKSVFGGAICRMYRFPTTDGNHLRILEQMAESVLSLHVPRQFVKLLLEEDAARVCELEELGELSPCWESLRRQIVTQYQTIILTYQENLTDLHQYRGPSFKASSLKADKKLEFVPTNLHIQRMRVQDDGGSDQNYDIVTIGAPAAHCQGFKSGGLRKKLHKFEETKKHFEECCTSSGCQSIIYIPQDVVRAKEIIAQINTLKTQVSYYAERLSRAAKDRSATGLERTLAILADKTRQLVTVCDCKLLANSIHGLNAARPDYIASKASPTSTEEEQVMLRNDQDTLMARWTGRNSRSSLQVDWHEEEWEKVWLNVDKSLECIIQRVDKLLQKERLHGEGCEDVFPCAGSCTSKKGNPDSHAYWIRPEDPFCDVPSSPCPSTMPSTACHPHLTTHCSPPPEESSPGEWSEALYPLLTTLTDCVAMMSDKAKKAMVFLLMQDSAPTIATYLSLQYRRDVVFCQTLTALICGFIIKLRNCLHDDGFLRQLYTIGLLAQFESLLSTYGEELAMLEDMSLGIMDLRNVTFKVTQATSSASADMLPVITGNRDGFNVRVPLPGPLFDALPREIQSGMLLRVQPVLFNVGINEQQTLAERFGDTSLQEVINVESLVRLNSYFEQFKEVLPEDCLPRSRSQTCLPELLRFLGQNVHARKNKNVDILWQAAEICRRLNGVRFTSCKSAKDRTAMSVTLEQCLILQHEHGMAPQVFTQALECMRSEGCRRENTMKNVGSRKYAFNSLQLKAFPKHYRPPEGTYGKVET

SEQ ID NO: 2115 - protein, 924 aa, unidentified
MEIKEEGASEEGQHFLPTAQANDPGDCQFTSIQKTPNEPQLEFILACKDLVAPVRDRKLNTLVQISVIHPVEQSLTRYSSTEIVEGTRDPLFLTGVTFPSEYPIYEETKIKLTVYDVKDKSHDTVRTSVLPEHKDPPPEVGRSFLGYASFKVGELLKSKEQLLVLSLRTSDGGKVVGTIEVSVVKMGEIEDGEADHITTDVQGQKCALVCECTAPESVSGKDNLPFLNSVLKNPVCKLYRFPTSDNKWMRIREQMSESILSFHIPKELISLHIKEDLCRNQEIKELGELSPHWDNLRKNVLTHCDQMVNMYQDILTELSKETGSSFKSSSSKGEKTLEFVPINLHLQRMQVHSPHLKDALYDVITVGAPAAHFQGFKNGGLRKLLHRFETERRNTGYQFIYYSPENTAKAKEVLSNINQLQPLIATHADLLLNSASQHSPDSLKNSLKMLSEKTELFVHAFKDQLVRSALLALYTARPGGILKKPPSPKSSTEESSPQDQPPVMRGQDSIPHHSDYDEEEWDRVWANVGKSLNCIIAMVDKLIERDGGSEGSGGNNDGEKEPSLTDAIPSHPREDWYEQLYPLILTLKDCMGEVVNRAKQSLTFVLLQELAYSLPQCLMLTLRRDIVFSQALAGLVCGFIIKLQTSLYDPGFLQQLHTVGLIVQYEGLLSTYSDEIGMLEDMAVGISDLKKVAFKIIEAKSNDVLPVITGRREHYVVEVKLPARMFESLPLQIKEGQLLHVYPVLFNVGINEQQTLAERFGDVSLQESINQENFELLQEYYKIFMEKMPPDYISHFQEQNDLKALLENLLQNIQSKKRKNVEIMWLAATICRKLNGIRFTCCKSAKDRTSMSVTLEQCSILRDEHQLHKDFFIRALDCMRREGCRIENVLKNIKCRKYAFNMLQLMAFPKYYRPPEGTYGKADT

SEQ ID NO: 2116 - protein, 1132 aa, unidentified
MELFQAKDHYILQQGERALWCSRRDGGLQLRPATDLLLAWNPICLGLVEGVIGKIQLHSDLPWWLILIRQKALVGKLPGDHEVCKVTKIAVLSLSEMEPQDLELELCKKHHFGINKPEKIIPSPDDSKFLLKTFTHIKSNVSAPNKKKVKESKEKEKLERRLLEELLKMFMDSESFYYSLTYDLTNSVQRQSTGERDGRPLWQKVDDRFFWNKYMIQDLTEIGTPDVDFWIIPMIQGFVQIEELVVNYTESSDDEKSSPETPPQESTCVDDIHPRFLVALISRRSRHRAGMRYKRRGVDKNGNVANYVETEQLIHVHNHTLSFVQTRGSVPVFWSQVGYRYNPRPRLDRSEKETVAYFCAHFEEQLNIYKKQVIINLVDQAGREKIIGDAYLKQVLLFNNSHLTYVSFDFHEHCRGMKFENVQTLTDAIYDIILDMKWCWVDEAGVICKQEGIFRVNCMDCLDRTNVVQAAIARVVMEQQLKKLGVMPPEQPLPVKCNRIYQIMWANNGDSISRQYAGTAALKGDFTRTGERKLAGVMKDGVNSANRYYLNRFKDAYRQAVIDLMQGIPVTEDLYSIFTKEKEHEALHKENQRSHQELISQLLQSYMKLLLPDDEKFHGGWALIDCDPSLIDATHRDVDVLLLLSNSAYYVAYYDDEVDKVNQYQRLSLENLEKIEIGPEPTLFGKPKFSCMRLHYRYKEASGYFHTLRAVMRNPEEDGKDTLQCIAEMLQITKQAMGSDLPIIEKKLERKSSKPHEDIIGIRSQNQGSLAQGKNFLMSKFSSLNQKVKQTKSNVNIGNLRKLGNFTKPEMKVNFLKPNLKVNLWKSDSSLETMENTGVMDKVQAESDGDMSSDNDSYHSDEFLTNSKSDEDRQLANSLESVGPIDYVLPSCGIIASAPRLGSRSQSLSSTDSSVHAPSEITVAHGSGLGKGQESPLKKSPSAGDVHILTGFAKPMDIYCHRFVQDAQNKVTHLSETRSVSQQASQERNQMTNQVSNETQSESTEQTPSRPSQLDVSLSATGPQFLSVEPAHSVASQKTPTSASSMLELETGLHVTPSPSESSSSRAVSPFAKIRSSMVQVASITQAGLTHGINFAVSKVQKSPPEPEIINQVQQNELKKMFIQCQTRIIQI

SEQ ID NO: 2117 - protein, 1006 aa, unidentified
MEGQSSRGSRRPGTRAGLGSLPMPQGVAQTGAPSKVDSSFQLPAKKNAALGPSEPRLALAPVGPRAAMSASSEGPRLALASPRPILAPLCTPEGQKTATAHRSSSLAPTSVGQLVMSASAGPKPPPATTGSVLAPTSLGLVMPASAGPRSPPVTLGPNLAPTSRDQKQEPPASVGPKPTLAASGLSLALASEEQPPELPSTPSPVPSPVLSPTQEQALAPASTASGAASVGQTSARKRDAPAPRPLPASEGHLQPPAQTSGPTGSPPCIQTSPDPRLSPSFRARPEALHSSPEDPVLPRPPQTLPLDVGQGPSEPGTHSPGLLSPTFRPGAPSGQTVPPPLPKPPRSPSRSPSHSPNRSPCVPPAPDMALPRLGTQSTGPGRCLSPNLQAQEAPAPVTTSSSTSTLSSSPWSAQPTWKSDPGFRITVVTWNVGTAMPPDDVTSLLHLGGGDDSDGADMIAIGLQEVNSMLNKRLKDALFTDQWSELFMDALGPFNFVLVSSVRMQGVILLLFAKYYHLPFLRDVQTDCTRTGLGGYWGNKGGVSVRLAAFGHMLCFLNCHLPAHMDKAEQRKDNFQTILSLQQFQGPGAQGILDHDLVFWFGDLNFRIESYDLHFVKFAIDSDQLHQLWEKDQLNMAKNTWPILKGFQEGPLNFAPTFKFDVGTNKYDTSAKKRKPAWTDRILWKVKAPGGGPSPSGRKSHRLQVTQHSYRSHMEYTVSDHKPVAAQFLLQFAFRDDMPLVRLEVADEWVRPEQAVVRYRMETVFARSSWDWIGLYRVGFRHCKDYVAYVWAKHEDVDGNTYQVTFSEESLPKGHGDFILGYYSHNHSILIGITEPFQISLPSSELASSSTDSSGTSSEGEDDSTLELLAPKSRSPSPGKSKRHRSRSPGLARFPGLALRPSSRERRGASRSPSPQSRRLSRVAPDRSSNGSSRGSSEEGPSGLPGPWAFPPAVPRSLGLLPALRLETVDPGGGGSWGPDREALAPNSLSPSPQGHRGLEEGGLGP

SEQ ID NO: 2118 - protein, 277 aa, unidentified
MPRLHDHFWSCSCAHSARRRGPPRASAAGLAAKVGEMINVSVSGPSLLAAHGAPDADPAPRGRSAAMSGPEPGSPYPNTWHHRLLQRSLVLFSVGVVLALVLNLLQIQRNVTLFPEEVIATIFSSAWWVPPCCGTAAAVVGLLYPCIDSHLGEPHKFKREWASVMRCIAVFVGINHASAKLDFANNVQLSLTLAALSLGLWWTFDRSRSGLGLGITIAFLATLITQFLVYNGVYQYTSPDFLYIRSWLPCIFFSGGVTVGNIGRQLAMGVPEKPHSD

SEQ ID NO: 2119 - protein, 225 aa, unidentified
MAEGETESPGPKKCGPYISSVTSQSVNLMIRGVVLFFIGVFLALVLNLLQIQRNVTLFPPDVIASIFSSAWWVPPCCGTASAVIGLLYPCIDRHLGEPHKFKREWSSVMRCVAVFVGINHASAKVDFDNNIQLSLTLAALSIGLWWTFDRSRSGFGLGVGIAFLATVVTQLLVYNGVYQYTSPDFLYVRSWLPCIFFAGGITMGNIGRQLAMYECKVIAEKSHQE

SEQ ID NO: 2120 - protein, 1382 aa, unidentified
MATGGRRGAAAAPLLVAVAALLLGAAGHLYPGEVCPGMDIRNNLTRLHELENCSVIEGHLQILLMFKTRPEDFRDLSFPKLIMITDYLLLFRVYGLESLKDLFPNLTVIRGSRLFFNYALVIFEMVHLKELGLYNLMNITRGSVRIEKNNELCYLATIDWSRILDSVEDNYIVLNKDDNEECGDICPGTAKGKTNCPATVINGQFVERCWTHSHCQKVCPTICKSHGCTAEGLCCHSECLGNCSQPDDPTKCVACRNFYLDGRCVETCPPPYYHFQDWRCVNFSFCQDLHHKCKNSRRQGCHQYVIHNNKCIPECPSGYTMNSSNLLCTPCLGPCPKVCHLLEGEKTIDSVTSAQELRGCTVINGSLIINIRGGNNLAAELEANLGLIEEISGYLKIRRSYALVSLSFFRKLRLIRGETLEIGNYSFYALDNQNLRQLWDWSKHNLTITQGKLFFHYNPKLCLSEIHKMEEVSGTKGRQERNDIALKTNGDQASCENELLKFSYIRTSFDKILLRWEPYWPPDFRDLLGFMLFYKEAPYQNVTEFDGQDACGSNSWTVVDIDPPLRSNDPKSQNHPGWLMRGLKPWTQYAIFVKTLVTFSDERRTYGAKSDIIYVQTDATNPSVPLDPISVSNSSSQIILKWKPPSDPNGNITHYLVFWERQAEDSELFELDYCLKGLKLPSRTWSPPFESEDSQKHNQSEYEDSAGECCSCPKTDSQILKELEESSFRKTFEDYLHNVVFVPRKTSSGTGAEDPRPSRKRRSLGDVGNVTVAVPTVAAFPNTSSTSVPTSPEEHRPFEKVVNKESLVISGLRHFTGYRIELQACNQDTPEERCSVAAYVSARTMPEAKADDIVGPVTHEIFENNVVHLMWQEPKEPNGLIVLYEVSYRRYGDEELHLCVSRKHFALERGCRLRGLSPGNYSVRIRATSLAGNGSWTEPTYFYVTDYLDVPSNIAKIIIGPLIFVFLFSVVIGSIYLFLRKRQPDGPLGPLYASSNPEYLSASDVFPCSVYVPDEWEVSREKITLLRELGQGSFGMVYEGNARDIIKGEAETRVAVKTVNESASLRERIEFLNEASVMKGFTCHHVVRLLGVVSKGQPTLVVMELMAHGDLKSYLRSLRPEAENNPGRPPPTLQEMIQMAAEIADGMAYLNAKKFVHRDLAARNCMVAHDFTVKIGDFGMTRDIYETDYYRKGGKGLLPVRWMAPESLKDGVFTTSSDMWSFGVVLWEITSLAEQPYQGLSNEQVLKFVMDGGYLDQPDNCPERVTDLMRMCWQFNPKMRPTFLEIVNLLKDDLHPSFPEVSFFHSEENKAPESEELEMEFEDMENVPLDRSSHCQREEAGGRDGGSSLGFKRSYEEHIPYTHMNGGKKNGRILTLPRSNPS

SEQ ID NO: 2121 - protein, 1297 aa, unidentified
MAVPSLWPWGACLPVIFLSLGFGLDTVEVCPSLDIRSEVAELRQLENCSVVEGHLQILLMFTATGEDFRGLSFPRLTQVTDYLLLFRVYGLESLRDLFPNLAVIRGTRLFLGYALVIFEMPHLRDVALPALGAVLRGAVRVEKNQELCHLSTIDWGLLQPAPGANHIVGNKLGEECADVCPGVLGAAGEPCAKTTFSGHTDYRCWTSSHCQRVCPCPHGMACTARGECCHTECLGGCSQPEDPRACVACRHLYFQGACLWACPPGTYQYESWRCVTAERCASLHSVPGRASTFGIHQGSCLAQCPSGFTRNSSSIFCHKCEGLCPKECKVGTKTIDSIQAAQDLVGCTHVEGSLILNLRQGYNLEPQLQHSLGLVETITGFLKIKHSFALVSLGFFKNLKLIRGDAMVDGNYTLYVLDNQNLQQLGSWVAAGLTIPVGKIYFAFNPRLCLEHIYRLEEVTGTRGRQNKAEINPRTNGDRAACQTRTLRFVSNVTEADRILLRWERYEPLEARDLLSFIVYYKESPFQNATEHVGPDACGTQSWNLLDVELPLSRTQEPGVTLASLKPWTQYAVFVRAITLTTEEDSPHQGAQSPIVYLRTLPAAPTVPQDVISTSNSSSHLLVRWKPPTQRNGNLTYYLVLWQRLAEDGDLYLNDYCHRGLRLPTSNNDPRFDGEDGDPEAEMESDCCPCQHPPPGQVLPPLEAQEASFQKKFENFLHNAITIPISPWKVTSINKSPQRDSGRHRRAAGPLRLGGNSSDFEIQEDKVPRERAVLSGLRHFTEYRIDIHACNHAAHTVGCSAATFVFARTMPHREADGIPGKVAWEASSKNSVLLRWLEPPDPNGLILKYEIKYRRLGEEATVLCVSRLRYAKFGGVHLALLPPGNYSARVRATSLAGNGSWTDSVAFYILGPEEEDAGGLHVLLTATPVGLTLLIVLAALGFFYGKKRNRTLYASVNPEYFSASDMYVPDEWEVPREQISIIRELGQGSFGMVYEGLARGLEAGEESTPVALKTVNELASPRECIEFLKEASVMKAFKCHHVVRLLGVVSQGQPTLVIMELMTRGDLKSHLRSLRPEAENNPGLPQPALGEMIQMAGEIADGMAYLAANKFVHRDLAARNCMVSQDFTVKIGDFGMTRDVYETDYYRKGGKGLLPVRWMAPESLKDGIFTTHSDVWSFGVVLWEIVTLAEQPYQGLSNEQVLKFVMDGGVLEELEGCPLQLQELMSRCWQPNPRLRPSFTHILDSIQEELRPSFRLLSFYYSPECRGARGSLPTTDAEPDSSPTPRDCSPQNGGPGH

SEQ ID NO: 2122 - protein, 2190 aa, unidentified
MNRAKPTTVRRPSAAAKPSGHPPPGDFIALGSKGQANESKTASTLLKPAPSGLPSERKRDAAAALSSASALTGLTKRPKLSSTPPLSALGRLAEAAVAEKRAISPSIKEPSVVPIEVLPTVLLDEIEAAELEGNDDRIEGVLCGAVKQLKVTRAKPDSTLYLSLMYLAKIKPNIFATEGVIEALCSLLRRDASINFKAKGNSLVSVLACNLLMAAYEEDENWPEIFVKVYIEDSLGERIWVDSPHCKTFVDNIQTAFNTRMPPRSVLLQGEAGRVAGDLGAGSSPHPSLTEEEDSQTELLIAEEKLSPEQEGQLMPRYEELAESVEEYVLDMLRDQLNRRQPIDNVSRNLLRLLTSTCGYKEVRLLAVQKLEMWLQNPKLTRPAQDLLMSVCMNCNTHGSEDMDVISHLIKIRLKPKVLLNHFMLCIRELLSAHKDNLGTTIKLVIFNELSSARNPNNMQVLYTALQHSSELAPKFLAMVFQDLLTNKDDYLRASRALLREIIKQTKHEINFQAFCLGLMQERKEPQYLEMEFKERFVVHITDVLAVSMMLGITAQVKEAGIAWDKGEKRNLEVLRSFQNQIAAIQRDAVWWLHTVVPSISKLAPKDYVHCLHKVLFTEQPETYYKWDNWPPESDRNFFLRLCSEVPILEDTLMRILVIGLSRELPLGPADAMELADHLVKRAAAVQADDVEVLKVGRTQLIDAVLNLCTYHHPENIQLPPGYQPPNLAISTLYWKAWPLLLVVAAFNPENIGLAAWEEYPTLKMLMEMVMTNNYSYPPCTLTDEETRTEMLNRELQTAQREKQEILAFEGHLAAASTKQTITESSSLLLSQLTSLDPQGPPRRPPPHILDQVKSLNQSLRLGHLLCRSRNPDFLLHIIQRQASSQSMPWLADLVQSSEGSLDVLPVQCLCEFLLHDAVDDAASGEEDDEGESKEQKAKKRQRQQKQRQLLGRLQDLLLGPKADEQTTCEVLDYFLRRLGSSQVASRVLAMKGLSLVLSEGSLRDGEEKEPPMEEDVGDTDVLQGYQWLLRDLPRLPLFDSVRSTTALALQQAIHMETDPQTISAYLIYLSQHTPVEEQAQHSDLALDVARLVVERSTIMSHLFSKLSPSAASDAVLSALLSIFSRYVRRMRQSKEGEEVYSWSESQDQVFLRWSSGETATMHILVVHAMVILLTLGPPRADDSEFQALLDIWFPEEKPLPTAFLVDTSEEALLLPDWLKLRMIRSEVLRLVDAALQDLEPQQLLLFVQSFGIPVSSMSKLLQFLDQAVAHDPQTLEQNIMDKNYMAHLVEVQHERGASGGQTFHSLLTASLPPRRDSTEAPKPKSSPEQPIGQGRIRVGTQLRVLGPEDDLAGMFLQIFPLSPDPRWQSSSPRPVALALQQALGQELARVVQGSPEVPGITVRVLQALATLLSSPHGGALVMSMHRSHFLACPLLRQLCQYQRCVPQDTGFSSLFLKVLLQMLQWLDSPGVEGGPLRAQLRMLASQASAGRRLSDVRGGLLRLAEALAFRQDLEVVSSTVRAVIATLRSGEQCSVEPDLISKVLQGLIEVRSPHLEELLTAFFSATADAASPFPACKPVVVVSSLLLQEEEPLAGGKPGADGGSLEAVRLGPSSGLLVDWLEMLDPEVVSSCPDLQLRLLFSRRKGKGQAQVPSFRPYLLTLFTHQSSWPTLHQCIRVLLGKSREQRFDPSASLDFLWACIHVPRIWQGRDQRTPQKRREELVLRVQGPELISLVELILAEAETRSQDGDTAACSLIQARLPLLLSCCCGDDESVRKVTEHLSGCIQQWGDSVLGRRCRDLLLQLYLQRPELRVPVPEVLLHSEGAASSSVCKLDGLIHRFITLLADTSDSRALENRGADASMACRKLAVAHPLLLLRHLPMIAALLHGRTHLNFQEFRQQNHLSCFLHVLGLLELLQPHVFRSEHQGALWDCLLSFIRLLLNYRKSSRHLAAFINKFVQFIHKYITYNAPAAISFLQKHADPLHDLSFDNSDLVMLKSLLAGLSLPSRDDRTDRGLDEEGEEESSAGSLPLVSVSLFTPLTAAEMAPYMKRLSRGQTVEDLLEVLSDIDEMSRRRPEILSFFSTNLQRLMSSAEECCRNLAFSLALRSMQNSPSIAAAFLPTFMYCLGSQDFEVVQTALRNLPEYALLCQEHAAVLLHRAFLVGMYGQMDPSAQISEALRILHMEAVM

SEQ ID NO: 2123 - protein, 518 aa, unidentified
MPTVVVMDVSLSMTRPVSIEGSEEYQRKHLAAHGLTMLFEHMATNYKLEFTALVVFSSLWELMVPFTRDYNTLQEALSNMDDYDKTCLESALVGVCNIVQQEWGGAIPCQVVLVTDGCLGIGRGSLRHSLATQNQRSESNRFPLPFPFPSKLYIMCMANLEELQSTDSLECLERLIDLNNGEGQIFTIDGPLCLKNVQSMFGKLIDLAYTPFHAVLKCGHLTADVQVFPRPEPFVVDEEIDPIPKVINTDLEIVGFIDIADISSPPVLSRHLVLPIALNKEGDEVGTGITDDNEDENSANQIAGKIPNFCVLLHGSLKVEGMVAIVQLGPEWHGMLYSQADSKKKSNLMMSLFEPGPEPLPWLGKMAQLGPISDAKENPYGEDDNKSPFPLQPKNKRSYAQNVTVWIKPSGLQTDVQKILRNARKLPEKTQTFYKELNRLRKAALAFGFLDLLKGVADMLERECTLLPETAHPDAAFQLTHAAQQLKLASTGTSEYAAYDQNITPLHTDFSGSSTERI

SEQ ID NO: 2124 - protein, 1204 aa, unidentified
MKDQQTVIMTECTSLQFVSPFAFEAMQKVDVVCLASLSDPELRLLLPCLVRMALCAPADQSQSWAQDKKLILRLLSGVEAVNSIVALLSVDFHALEQDASKEQQLRHKLGGGSGESILVSQLQHGLTLEFEHSDSPRRLRLVLSELLAIMNKVSESNGEFFFKSSELFESPVYLEEAADVLCILQAELPSLLPIVDVAEALLHVRNGAWFLCLLVANVPDSFNEVCRGLIKNGERQDEESLGGRRRTDALRFLCKMNPSQALKVRGMVVEECHLPGLGVALTLDHTKNEACEDGVSDLVCFVSGLLLGTNAKVRTWFGTFIRNGQQRKRETSSSVLWQMRRQLLLELMGILPTVRSTRIVEEADVDMEPNVSVYSGLKEEHVVKASALLRLYCALMGIAGLKPTEEEAEQLLQLMTSRPPATPAGVRFVSLSFCMLLAFSTLVSTPEQEQLMVVWLSWMIKEEAYFESTSGVSASFGEMLLLVAMYFHSNQLSAIIDLVCSTLGMKIVIKPSSLSRMKTIFTQEIFTEQVVTAHAVRVPVTSNLSANITGFLPIHCIYQLLRSRSFTKHKVSIKDWIYRQLCETSTPLHPQLLPLIDVYINSILTPASKSNPEATNQPVTEQEILNIFQGVIGGDNIRLNQRFSITAQLLVLYYILSYEEALLANTKTLAAMQRKPKSYSSSLMDQIPIKFLIRQAQGLQQELGGLHSALLRLLATNYPHLCIVDDWICEEEITGTDALLRRMLLTNNAKNHSPKQLQEAFSAVPVNNTQVMQIIEHLTLLSASELIPYAEVLTSNMSQLLNSGVPRRILQTVNKLWMVLNTVMPRRLWVMTVNALQPSIKFVRQQKYTQNDLMIDPLIVLRCDQRVHRCPPLMDITLHMLNGYLLASKAYLSAHLKETEQDRPSQNNTIGLVGQTDAPEVTREELKNALLAAQDSAAVQILLEICLPTEEEKANGVNPDSLLRNVQSVITTSAPNKGMEEGEDNLLCNLREVQCLICCLLHQMYIADPNIAKLVHFQGYPCELLPLTVAGIPSMHICLDFIPELIAQPELEKQIFAIQLLSHLCIQYALPKSLSVARLAVNVMGTLLTVLTQAKRYAFFMPTLPSLVSFCRAFPPLYEDIMSLLIQIGQVCASDVATQTRDIDPIITRLQQIKEKPSGWSQICKDSSYKNGSRDTGSMDPDVQLCHCIERTVIEIINMSVSGI

SEQ ID NO: 2125 - protein, 205 aa, unidentified
MEEKQPQKTKEPSKEDEPQQKEMPTHLSLGAESKAEAKTPVLVETQTVDNANEKSEKPPENQKKLSDKDTVATKIQAWWRGTLVRRALLHAALSACIIQCWWRLILSKILKKRRQAALEAFSRKEWAAVTLQSQARMWRIRRRYCQVLNAVRIIQAYWRCRSCASRGFIKGQYRVTANQLHLQLEILLDSGPCIVTECIPFSIKE

SEQ ID NO: 2126 - protein, 154 aa, unidentified
MGSKCCKGGPDEDAVERQRRQKLLLAQLHHRKRVKAAGQIQAWWRGVLVRRTLLVAALRAWMIQCWWRTLVQRRIRQRRQALLRVYVIQEQATVKLQSCIRMWQCRQCYRQMCNALCLFQVPESSLAFQTDGFLQVQYAIPSKQPEFHIEILSI

SEQ ID NO: 2127 - protein, 148 aa, unidentified
MGPEEKTIMTERSAAVFIQAWWRGMLVRRTLLHAALRAWIIQCWWRQVLEKLLAKRRRMVLEFYVQQEWAAVRLQSWVRMWCVRQRYCRLLNAVRIIQVYWRWHSCHSRVFIEGHYELKENQLNIQLEISLGLQACKVQQCIPLPLKE

SEQ ID NO: 2128 - protein, 745 aa, unidentified
MFPLRALWLVWALLGVAGSCPEPCACVDKYAHQFADCAYKELREVPEGLPANVTTLSLSANKITVLRRGAFADVTQVTSLWLAHNEVRTVEPGALAVLSQLKNLDLSHNFISSFPWSDLRNLSALQLLKMNHNRLGSLPRDALGALPDLRSLRINNNRLRTLAPGTFDALSALSHLQLYHNPFHCGCGLVWLQAWAASTRVSLPEPDSIACASPPALQGVPVYRLPALPCAPPSVHLSAEPPLEAPGTPLRAGLAFVLHCIADGHPTPRLQWQLQIPGGTVVLEPPVLSGEDDGVGAEEGEGEGDGDLLTQTQAQTPTPAPAWPAPPATPRFLALANGSLLVPLLSAKEAGVYTCRAHNELGANSTSIRVAVAATGPPKHAPGAGGEPDGQAPTSERKSTAKGRGNSVLPSKPEGKIKGQGLAKVSILGETETEPEEDTSEGEEAEDQILADPAEEQRCGNGDPSRYVSNHAFNQSAELKPHVFELGVIALDVAEREARVQLTPLAARWGPGPGGAGGAPRPGRRPLRLLYLCPAGGGAAVQWSRVEEGVNAYWFRGLRPGTNYSVCLALAGEACHVQVVFSTKKELPSLLVIVAVSVFLLVLATVPLLGAACCHLLAKHPGKPYRLILRPQAPDPMEKRIAADFDPRASYLESEKSYPAGGEAGGEEPEDVQGEGLDEDAEQGDPSGDLQREESLAACSLVESQSKANQEEFEAGSEYSDRLPLGAEAVNIAQEINGNYRQTAG

SEQ ID NO: 2129 - protein, 612 aa, unidentified
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQNMMVVGQSAFADFDGDGHMDHLLPGCEDKNCQKSTIYLVRSGMKQWVPVLQDFSNKGTLWGFVPFVDEQQPTEIPIPITLHIGDYNMDGYPDALVILKNTSGSNQQAFLLENVPCNNASCEEARRMFKVYWELTDLNQIKDAMVATFFDIYEDGILDIVVLSKGYTKNDFAIHTLKNNFEADAYFVKVIVLSGLCSNDCPRKITPFGVNQPGPYIMYTTVDANGYLKNGSAGQLSQSAHLALQLPYNVLGLGRSANFLDHLYVGIPRPSGEKSIRKQEWTAIIPNSQLIVIPYPHNVPRSWSAKLYLTPSNIVLLTAIALIGVCVFILAIIGILHWQEKKADDREKRQEAHRFHFDAM

SEQ ID NO: 2130 - protein, 1179 aa, unidentified
MAPRPRARPGVAVACCWLLTVVLRCCVSFNVDVKNSMTFSGPVEDMFGYTVQQYENEEGKWVLIGSPLVGQPKNRTGDVYKCPVGRGESLPCVKLDLPVNTSIPNVTEVKENMTFGSTLVTNPNGGFLACGPLYAYRCGHLHYTTGICSDVSPTFQVVNSIAPVQECSTQLDIVIVLDGSNSIYPWDSVTAFLNDLLERMDIGPKQTQVGIVQYGENVTHEFNLNKYSSTEEVLVAAKKIVQRGGRQTMTALGIDTARKEAFTEARGARRGVKKVMVIVTDGESHDNHRLKKVIQDCEDENIQRFSIAILGSYNRGNLSTEKFVEEIKSIASEPTEKHFFNVSDELALVTIVKTLGERIFALEATADQSAASFEMEMSQTGFSAHYSQDWVMLGAVGAYDWNGTVVMQKASQIIIPRNTTFNVESTKKNEPLASYLGYTVNSATASSGDVLYIAGQPRYNHTGQVIIYRMEDGNIKILQTLSGEQIGSYFGSILTTTDIDKDSNTDILLVGAPMYMGTEKEEQGKVYVYALNQTRFEYQMSLEPIKQTCCSSRQHNSCTTENKNEPCGARFGTAIAAVKDLNLDGFNDIVIGAPLEDDHGGAVYIYHGSGKTIRKEYAQRIPSGGDGKTLKFFGQSIHGEMDLNGDGLTDVTIGGLGGAALFWSRDVAVVKVTMNFEPNKVNIQKKNCHMEGKETVCINATVCFDVKLKSKEDTIYEADLQYRVTLDSLRQISRSFFSGTQERKVQRNITVRKSECTKHSFYMLDKHDFQDSVRITLDFNLTDPENGPVLDDSLPNSVHEYIPFAKDCGNKEKCISDLSLHVATTEKDLLIVRSQNDKFNVSLTVKNTKDSAYNTRTIVHYSPNLVFSGIEAIQKDSCESNHNITCKVGYPFLRRGEMVTFKILFQFNTSYLMENVTIYLSATSDSEEPPETLSDNVVNISIPVKYEVGLQFYSSASEYHISIAANETVPEVINSTEDIGNEINIFYLIRKSGSFPMPELKLSISFPNMTSNGYPVLYPTGLSSSENANCRPHIFEDPFSINSGKKMTTSTDHLKRGTILDCNTCKFATITCNLTSSDISQVNVSLILWKPTFIKSYFSSLNLTIRGELRSENASLVLSSSNQKRELAIQISKDGLPGRVPLWVILLSAFAGLLLLMLLILALWKIGFFKRPLKKKMEK

SEQ ID NO: 2131 - protein, 1167 aa, unidentified
MELPFVTHLFLPLVFLTGLCSPFNLDEHHPRLFPGPPEAEFGYSVLQHVGGGQRWMLVGAPWDGPSGDRRGDVYRCPVGGAHNAPCAKGHLGDYQLGNSSHPAVNMHLGMSLLETDGDGGFMACAPLWSRACGSSVFSSGICARVDASFQPQGSLAPTAQRCPTYMDVVIVLDGSNSIYPWSEVQTFLRRLVGKLFIDPEQIQVGLVQYGESPVHEWSLGDFRTKEEVVRAAKNLSRREGRETKTAQAIMVACTEGFSQSHGGRPEAARLLVVVTDGESHDGEELPAALKACEAGRVTRYGIAVLGHYLRRQRDPSSFLREIRTIASDPDERFFFNVTDEAALTDIVDALGDRIFGLEGSHAENESSFGLEMSQIGFSTHRLKDGILFGMVGAYDWGGSVLWLEGGHRLFPPRMALEDEFPPALQNHAAYLGYSVSSMLLRGGRRLFLSGAPRFRHRGKVIAFQLKKDGAVRVAQSLQGEQIGSYFGSELCPLDTDRDGTTDVLLVAAPMFLGPQNKETGRVYVYLVGQQSLLTLQGTLQPEPPQDARFGFAMGALPDLNQDGFADVAVGAPLEDGHQGALYLYHGTQSGVRPHPAQRIAAASMPHALSYFGRSVDGRLDLDGDDLVDVAVGAQGAAILLSSRPIVHLTPSLEVTPQAISVVQRDCRRRGQEAVCLTAALCFQVTSRTPGRWDHQFYMRFTASLDEWTAGARAAFDGSGQRLSPRRLRLSVGNVTCEQLHFHVLDTSDYLRPVALTVTFALDNTTKPGPVLNEGSPTSIQKLVPFSKDCGPDNECVTDLVLQVNMDIRGSRKAPFVVRGGRRKVLVSTTLENRKENAYNTSLSLIFSRNLHLASLTPQRESPIKVECAAPSAHARLCSVGHPVFQTGAKVTFLLEFEFSCSSLLSQVFVKLTASSDSLERNGTLQDNTAQTSAYIQYEPHLLFSSESTLHRYEVHPYGTLPVGPGPEFKTTLRVQNLGCYVVSGLIISALLPAVAHGGNYFLSLSQVITNNASCIVQNLTEPPGPPVHPEELQHTNRLNGSNTQCQVVRCHLGQLAKGTEVSVGLLRLVHNEFFRRAKFKSLTVVSTFELGTEEGSVLQLTEASRWSESLLEVVQTRPILISLWILIGSVLGGLLLLALLVFCLWKLGFFAHKKIPEEEKREEKLEQ

SEQ ID NO: 2132 - protein, 1188 aa, unidentified
MDLPRGLVVAWALSLWPGFTDTFNMDTRKPRVIPGSRTAFFGYTVQQHDISGNKWLVVGAPLETNGYQKTGDVYKCPVIHGNCTKLNLGRVTLSNVSERKDNMRLGLSLATNPKDNSFLACSPLWSHECGSSYYTTGMCSRVNSNFRFSKTVAPALQRCQTYMDIVIVLDGSNSIYPWVEVQHFLINILKKFYIGPGQIQVGVVQYGEDVVHEFHLNDYRSVKDVVEAASHIEQRGGTETRTAFGIEFARSEAFQKGGRKGAKKVMIVITDGESHDSPDLEKVIQQSERDNVTRYAVAVLGYYNRRGINPETFLNEIKYIASDPDDKHFFNVTDEAALKDIVDALGDRIFSLEGTNKNETSFGLEMSQTGFSSHVVEDGVLLGAVGAYDWNGAVLKETSAGKVIPLRESYLKEFPEELKNHGAYLGYTVTSVVSSRQGRVYVAGAPRFNHTGKVILFTMHNNRSLTIHQAMRGQQIGSYFGSEITSVDIDGDGVTDVLLVGAPMYFNEGRERGKVYVYELRQNLFVYNGTLKDSHSYQNARFGSSIASVRDLNQDSYNDVVVGAPLEDNHAGAIYIFHGFRGSILKTPKQRITASELATGLQYFGCSIHGQLDLNEDGLIDLAVGALGNAVILWSRPVVQINASLHFEPSKINIFHRDCKRSGRDATCLAAFLCFTPIFLAPHFQTTTVGIRYNATMDERRYTPRAHLDEGGDRFTNRAVLLSSGQELCERINFHVLDTADYVKPVTFSVEYSLEDPDHGPMLDDGWPTTLRVSVPFWNGCNEDEHCVPDLVLDARSDLPTAMEYCQRVLRKPAQDCSAYTLSFDTTVFIIESTRQRVAVEATLENRGENAYSTVLNISQSANLQFASLIQKEDSDGSIECVNEERRLQKQVCNVSYPFFRAKAKVAFRLDFEFSKSIFLHHLEIELAAGSDSNERDSTKEDNVAPLRFHLKYEADVLFTRSSSLSHYEVKPNSSLERYDGIGPPFSCIFRIQNLGLFPIHGMMMKITIPIATRSGNRLLKLRDFLTDEANTSCNIWGNSTEYRPTPVEEDLRRAPQLNHSNSDVVSINCNIRLVPNQEINFHLLGNLWLRSLKALKYKSMKIMVNAALQRQFHSPFIFREEDPSRQIVFEISKQEDWQVPIWIIVGSTLGGLLLLALLVLALWKLGFFRSARRRREPGLDPTPKVLE

SEQ ID NO: 2133 - protein, 1181 aa, unidentified
MGPERTGAAPLPLLLVLALSQGILNCCLAYNVGLPEAKIFSGPSSEQFGYAVQQFINPKGNWLLVGSPWSGFPENRMGDVYKCPVDLSTATCEKLNLQTSTSIPNVTEMKTNMSLGLILTRNMGTGGFLTCGPLWAQQCGNQYYTTGVCSDISPDFQLSASFSPATQPCPSLIDVVVVCDESNSIYPWDAVKNFLEKFVQGLDIGPTKTQVGLIQYANNPRVVFNLNTYKTKEEMIVATSQTSQYGGDLTNTFGAIQYARKYAYSAASGGRRSATKVMVVVTDGESHDGSMLKAVIDQCNHDNILRFGIAVLGYLNRNALDTKNLIKEIKAIASIPTERYFFNVSDEAALLEKAGTLGEQIFSIEGTVQGGDNFQMEMSQVGFSADYSSQNDILMLGAVGAFGWSGTIVQKTSHGHLIFPKQAFDQILQDRNHSSYLGYSVAAISTGESTHFVAGAPRANYTGQIVLYSVNENGNITVIQAHRGDQIGSYFGSVLCSVDVDKDTITDVLLVGAPMYMSDLKKEEGRVYLFTIKKGILGQHQFLEGPEGIENTRFGSAIAALSDINMDGFNDVIVGSPLENQNSGAVYIYNGHQGTIRTKYSQKILGSDGAFRSHLQYFGRSLDGYGDLNGDSITDVSIGAFGQVVQLWSQSIADVAIEASFTPEKITLVNKNAQIILKLCFSAKFRPTKQNNQVAIVYNITLDADGFSSRVTSRGLFKENNERCLQKNMVVNQAQSCPEHIIYIQEPSDVVNSLDLRVDISLENPGTSPALEAYSETAKVFSIPFHKDCGEDGLCISDLVLDVRQIPAAQEQPFIVSNQNKRLTFSVTLKNKRESAYNTGIVVDFSENLFFASFSLPVDGTEVTCQVAASQKSVACDVGYPALKREQQVTFTINFDFNLQNLQNQASLSFQALSESQEENKADNLVNLKIPLLYDAEIHLTRSTNINFYEISSDGNVPSIVHSFEDVGPKFIFSLKVTTGSVPVSMATVIIHIPQYTKEKNPLMYLTGVQTDKAGDISCNADINPLKIGQTSSSVSFKSENFRHTKELNCRTASCSNVTCWLKDVHMKGEYFVNVTTRIWNGTFASSTFQTVQLTAAAEINTYNPEIYVIEDNTVTIPLMIMKPDEKAEVPTGVIIGSIIAGILLLLALVAILWKLGFFKRKYEKMTKNPDEIDETTELSS

SEQ ID NO: 2134 - protein, 1039 aa, unidentified
MARALCPLQALWLLEWVLLLLGPCAAPPAWALNLDPVQLTFYAGPNGSQFGFSLDFHKDSHGRVAIVVGAPRTLGPSQEETGGVFLCPWRAEGGQCPSLLFDLRDETRNVGSQTLQTFKARQGLGASVVSWSDVIVACAPWQHWNVLEKTEEAEKTPVGSCFLAQPESGRRAEYSPCRGNTLSRIYVENDFSWDKRYCEAGFSSVVTQAGELVLGAPGGYYFLGLLAQAPVADIFSSYRPGILLWHVSSQSLSFDSSNPEYFDGYWGYSVAVGEFDGDLNTTEYVVGAPTWSWTLGAVEILDSYYQRLHRLRGEQMASYFGHSVAVTDVNGDGRHDLLVGAPLYMESRADRKLAEVGRVYLFLQPRGPHALGAPSLLLTGTQLYGRFGSAIAPLGDLDRDGYNDIAVAAPYGGPSGRGQVLVFLGQSEGLRSRPSQVLDSPFPTGSAFGFSLRGAVDIDDNGYPDLIVGAYGANQVAVYRAQPVVKASVQLLVQDSLNPAVKSCVLPQTKTPVSCFNIQMCVGATGHNIPQKLSLNAELQLDRQKPRQGRRVLLLGSQQAGTTLNLDLGGKHSPICHTTMAFLRDEADFRDKLSPIVLSLNVSLPPTEAGMAPAVVLHGDTHVQEQTRIVLDCGEDDVCVPQLQLTASVTGSPLLVGADNVLELQMDAANEGEGAYEAELAVHLPQGAHYMRALSNVEGFERLICNQKKENETRVVLCELGNPMKKNAQIGIAMLVSVGNLEEAGESVSFQLQIRSKNSQNPNSKIVLLDVPVRAEAQVELRGNSFPASLVVAAEEGEREQNSLDSWGPKVEHTYELHNNGPGTVNGLHLSIHLPGQSQPSDLLYILDIQPQGGLQCFPQPPVNPLKVDWGLPIPSPSPIHPAHHKRDRRQIFLPEPEQPSRLQDPVLVSCDSAPCTVVQCDLQEMARGQRAMVTVLAFLWLPSLYQRPLDQFVLQSHAWFNVSSLPYAVPPLSLPRGEAQVWTQLLRALEERAIPIWWVLVGVLGGLLLLTILVLAMWKVGFFKRNRPPLEEDDEEGE

SEQ ID NO: 2135 - protein, 1051 aa, unidentified
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 2136 - protein, 1032 aa, unidentified [sequence omitted]

SEQ ID NO: 2137 - protein, 1049 aa, unidentified
MGSRTPESPLHAVQLRWGPRRRPPLLPLLLLLLPPPPRVGGFNLDAEAPAVLSGPPGSFFGFSVEFYRPGTDGVSVLVGAPKANTSQPGVLQGGAVYLCPWGASPTQCTPIEFDSKGSRLLESSLSSSEGEEPVEYKSLQWFGATVRAHGSSILACAPLYSWRTEKEPLSDPVGTCYLSTDNFTRILEYAPCRSDFSWAAGQGYCQGGFSAEFTKTGRVVLGGPGSYFWQGQILSATQEQIAESYYPEYLINLVQGQLQTRQASSIYDDSYLGYSVAVGEFSGDDTEDFVAGVPKGNLTYGYVTILNGSDIRSLYNFSGEQMASYFGYAVAATDVNGDGLDDLLVGAPLLMDRTPDGRPQEVGRVYVYLQHPAGIEPTPTLTLTGHDEFGRFGSSLTPLGDLDQDGYNDVAIGAPFGGETQQGVVFVFPGGPGGLGSKPSQVLQPLWAASHTPDFFGSALRGGRDLDGNGYPDLIVGSFGVDKAVVYRGRPIVSASASLTIFPAMFNPEERSCSLEGNPVACINLSFCLNASGKHVADSIGFTVELQLDWQKQKGGVRRALFLASRQATLTQTLLIQNGAREDCREMKIYLRNESEFRDKLSPIHIALNFSLDPQAPVDSHGLRPALHYQSKSRIEDKAQILLDCGEDNICVPDLQLEVFGEQNHVYLGDKNALNLTFHAQNVGEGGAYEAELRVTAPPEAEYSGLVRHPGNFSSLSCDYFAVNQSRLLVCDLGNPMKAGASLWGGLRFTVPHLRDTKKTIQFDFQILSKNLNNSQSDVVSFRLSVEAQAQVTLNGVSKPEAVLFPVSDWHPRDQPQKEEDLGPAVHHVYELINQGPSSISQGVLELSCPQALEGQQLLYVTRVTGLNCTTNHPINPKGLELDPEGSLHHQQKREAPSRSSASSGPQILKCPEAECFRLRCELGPLHQQESQSLQLHFRVWAKTFLQREHQPFSLQCEAVYKALKMPYRILPRQLPQKERQVATAVQWTKAEGSYGVPLWIIILAILFGLLLLGLLIYILYKLGFFKRSLPYGTAMEKAQLKPPATSDA

SEQ ID NO: 2138 - protein, 1130 aa, unidentified
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 2139 - protein, 1181 aa, unidentified
MAGARSRDPWGASGICYLFGSLLVELLFSRAVAFNLDVMGALRKEGEPGSLFGFSVALHRQLQPRPQSWLLVGAPQALALPGQQANRTGGLFACPLSLEETDCYRVDIDQGADMQKESKENQWLGVSVRSQGPGGKIVTCAHRYEARQRVDQILETRDMIGRCFVLSQDLAIRDELDGGEWKFCEGRPQGHEQFGFCQQGTAAAFSPDSHYLLFGAPGTYNWKGTARVELCAQGSADLAHLDDGPYEAGGEKEQDPRLIPVPANSYFGLLFVTNIDSSDPDQLVYKTLDPADRLPGPAGDLALNSYLGFSIDSGKGLVRAEELSFVAGAPRANHKGAVVILRKDSASRLVPEVMLSGERLTSGFGYSLAVADLNSDGWPDLIVGAPYFFERQEELGGAVYVYLNQGGHWAGISPLRLCGSPDSMFGISLAVLGDLNQDGFPDIAVGAPFDGDGKVFIYHGSSLGVVAKPSQVLEGEAVGIKSFGYSLSGSLDMDGNQYPDLLVGSLADTAVLFRARPILHVSHEVSIAPRSIDLEQPNCAGGHSVCVDLRVCFSYIAVPSSYSPTVALDYVLDADTDRRLRGQVPRVTFLSRNLEEPKHQASGTVWLKHQHDRVCGDAMFQLQENVKDKLRAIVVTLSYSLQTPRLRRQAPGQGLPPVAPILNAHQPSTQRAEIHFLKQGCGEDKICQSNLQLVRARFCTRVSDTEFQPLPMDVDGTTALFALSGQPVIGLELMVTNLPSDPAQPQADGDDAHEAQLLVMLPDSLHYSGVRALDPAEKPLCLSNENASHVECELGNPMKRGAQVTFYLILSTSGISIETTELEVELLLATISEQELHPVSARARVFIELPLSIAGMAIPQQLFFSGVVRGERAMQSERDVGSKVKYEVTVSNQGQSLRTLGSAFLNIMWPHEIANGKWLLYPMQVELEGGQGPGQKGLCSPRPNILHLDVDSRDRRRRELEPPEQQEPGERQEPSMSWWPVSSAEKKKNITLDCARGTANCVVFSCPLYSFDRAAVLHVWGRLWNSTFLEEYSAVKSLEVIVRANITVKSSIKNLMLRDASTVIPVMVYLDPMAVVAEGVPWWVILLAVLAGLLVLALLVLLLWKMGFFKRAKHPEATVPQYHAVKIPREDRQQFKEEKTGTILRNNWGSPRREGPDAHPILAADGHPELGPDGHPGPGTA

SEQ ID NO: 2140 - protein, 1063 aa, unidentified
MSPGASRGPRGSQAPLIAPLCCAAAALGMLLWSPACQAFNLDVEKLTVYSGPKGSYFGYAVDFHIPDARTASVLVGAPKANTSQPDIVEGGAVYYCPWPAEGSAQCRQIPFDTTNNRKIRVNGTKEPIEFKSNQWFGATVKAHKGKVVACAPLYHWRTLKPTPEKDPVGTCYVAIQNFSAYAEFSPCRNSNADPEGQGYCQAGFSLDFYKNGDLIVGGPGSFYWQGQVITASVADIIANYSFKDILRKLAGEKQTEVAPASYDDSYLGYSVAAGEFTGDSQQELVAGIPRGAQNFGYVSIINSTDMTFIQNFTGEQMASYFGYTVVVSDVNSDGLDDVLVGAPLFMEREFESNPREVGQIYLYLQVSSLLFRDPQILTGTETFGRFGSAMAHLGDLNQDGYNDIAIGVPFAGKDQRGKVLIYNGNKDGLNTKPSQVLQGVWASHAVPSGFGFTLRGDSDIDKNDYPDLIVGAFGTGKVAVYRARPVVTVDAQLLLHPMIINLENKTCQVPDSMTSAACFSLRVCASVTGQSIANTIVLMAEVQLDSLKQKGAIKRTLFLDNHQAHRVFPLVIKRQKSHQCQDFIVYLRDETEFRDKLSPINISLNYSLDESTFKEGLEVKPILNYYRENIVSEQAHILVDCGEDNLCVPDLKLSARPDKHQVIIGDENHLMLIINARNEGEGAYEAELFVMIPEEADYVGIERNNKGFRPLSCEYKMENVTRMVVCDLGNPMVSGTNYSLGLRFAVPRLEKTNMSINFDLQIRSSNKDNPDSNFVSLQINITAVAQVEIRGVSHPPQIVLPIHNWEPEEEPHKEEEVGPLVEHIYELHNIGPSTISDTILEVGWPFSARDEFLLYIFHIQTLGPLQCQPNPNINPQDIKPAASPEDTPELSAFLRNSTIPHLVRKRDVHVVEFHRQSPAKILNCTNIECLQISCAVGRLEGGESAVLKVRSRLWAHTFLQRKNDPYALASLVSFEVKKMPYTDQPAKLPEGSIVIKTSVIWATPNVSFSIPLWVIILAILLGLLVLAILTLALWKCGFFDRARPPQEDMTDREQLTNDKTPEA

SEQ ID NO: 2141 - protein, 1035 aa, unidentified
MGGPAAPRGAGRLRALLLALVVAGIPAGAYNLDPQRPVHFQGPADSFFGYAVLEHFHDNTRWVLVGAPKADSKYSPSVKSPGAVFKCRVHTNPDRRCTELDMARGKNRGTSCGKTCREDRDDEWMGVSLARQPKADGRVLACAHRWKNIYYEADHILPHGFCYIIPSNLQAKGRTLIPCYEEYKKKYGEEHGSCQAGIAGFFTEELVVMGAPGSFYWAGTIKVLNLTDNTYLKLNDEVIMNRRYTYLGYAVTAGHFSHPSTIDVVGGAPQDKGIGKVYIFRADRRSGTLIKIFQASGKKMGSYFGSSLCAVDLNGDGLSDLLVGAPMFSEIRDEGQVTVYINRGNGALEEQLALTGDGAYNAHFGESIASLDDLDNDGFPDVAIGAPKEDDFAGAVYIYHGDAGGIVPQYSMKLSGQKINPVLRMFGQSISGGIDMDGNGYPDVTVGAFMSDSVVLLRARPVITVDVSIFLPGSINITAPQCHDGQQPVNCLNVTTCFSFHGKHVPGEIGLNYVLMADVAKKEKGQMPRVYFVLLGETMGQVTEKLQLTYMEETCRHYVAHVKRRVQDVISPIVFEAAYSLSEHVTGEEERELPPLTPVLRWKKGQKIAQKNQTVFERNCRSEDCAADLQLQGKLLLSSMDEKTLYLALGAVKNISLNISISNLGDDAYDANVSFNVSRELFFINMWQKEEMGISCELLESDFLKCSVGFPFMRSKSKYEFSVIFDTSHLSGEEEVLSFIVTAQSGNTERSESLHDNTLVLMVPLMHEVDTSITGIMSPTSFVYGESVDAANFIQLDDLECHFQPINITLQVYNTGPSTLPGSSVSISFPNRLSSGGAEMFHVQEMVVGQEKGNCSFQKNPTPCIIPQEQENIFHTIFAFFTKSGRKVLDCEKPGISCLTAHCNFSALAKEESRTIDIYMLLNTEILKKDSSSVIQFMSRAKVKVDPALRVVEIAHGNPEEVTVVFEALHNLEPRGYVVGWIIAISLLVGILIFLLLAVLLWKMGFFRRRYKEIIEAEKNRKENEDSWDWVQKNQ

SEQ ID NO: 2142 - protein, 1161 aa, unidentified
MTFGTVLLLSVLASYHGFNLDVEEPTIFQEDAGGFGQSVVQFGGSRLVVGAPLEVVAANQTGRLYDCAAATGMCQPIPLHIRPEAVNMSLGLTLAASTNGSRLLACGPTLHRVCGENSYSKGSCLLLGSRWEIIQTVPDATPECPHQEMDIVFLIDGSGSIDQNDFNQMKGFVQAVMGQFEGTDTLFALMQYSNLLKIHFTFTQFRTSPSQQSLVDPIVQLKGLTFTATGILTVVTQLFHHKNGARKSAKKILIVITDGQKYKDPLEYSDVIPQAEKAGIIRYAIGVGHAFQGPTARQELNTISSAPPQDHVFKVDNFAALGSIQKQLQEKIYAVEGTQSRASSSFQHEMSQEGFSTALTMDGLFLGAVGSFSWSGGAFLYPPNMSPTFINMSQENVDMRDSYLGYSTELALWKGVQNLVLGAPRYQHTGKAVIFTQVSRQWRKKAEVTGTQIGSYFGASLCSVDVDSDGSTDLILIGAPHYYEQTRGGQVSVCPLPRGRVQWQCDAVLRGEQGHPWGRFGAALTVLGDVNEDKLIDVAIGAPGEQENRGAVYLFHGASESGISPSHSQRIASSQLSPRLQYFGQALSGGQDLTQDGLMDLAVGARGQVLLLRSLPVLKVGVAMRFSPVEVAKAVYRCWEEKPSALEAGDATVCLTIQKSSLDQLGDIQSSVRFDLALDPGRLTSRAIFNETKNPTLTRRKTLGLGIHCETLKLLLPDCVEDVVSPIILHLNFSLVREPIPSPQNLRPVLAVGSQDLFTASLPFEKNCGQDGLCEGDLGVTLSFSGLQTLTVGSSLELNVIVTVWNAGEDSYGTVVSLYYPAGLSHRRVSGAQKQPHQSALRLACETVPTEDEGLRSSRCSVNHPIFHEGSNGTFIVTFDVSYKATLGDRMLMRASASSENNKASSSKATFQLELPVKYAVYTMISRQEESTKYFNFATSDEKKMKEAEHRYRVNNLSQRDLAISINFWVPVLLNGVAVWDVVMEAPSQSLPCVSERKPPQHSDFLTQISRSPMLDCSIADCLQFRCDVPSFSVQEELDFTLKGNLSFGWVRETLQKKVLVVSVAEITFDTSVYSQLPGQEAFMRAQMEMVLEEDEVYNAIPIIMGSSVGALLLLALITATLYKLGFFKRHYKEMLEDKPEDTATFSGDDFSCVAPNVPLS

SEQ ID NO: 2143 - protein, 1179 aa, unidentified
MWLFHTLLCIASLALLAAFNVDVARPWLTPKGGAPFVLSSLLHQDPSTNQTWLLVTSPRTKRTPGPLHRCSLVQDEILCHPVEHVPIPKGRHRGVTVVRSHHGVLICIQVLVRRPHSLSSELTGTCSLLGPDLRPQAQANFFDLENLLDPDARVDTGDCYSNKEGGGEDDVNTARQRRALEKEEEEDKEEEEDEEEEEAGTEIAIILDGSGSIDPPDFQRAKDFISNMMRNFYEKCFECNFALVQYGGVIQTEFDLRDSQDVMASLARVQNITQVGSVTKTASAMQHVLDSIFTSSHGSRRKASKVMVVLTDGGIFEDPLNLTTVINSPKMQGVERFAIGVGEEFKSARTARELNLIASDPDETHAFKVTNYMALDGLLSKLRYNIISMEGTVGDALHYQLAQIGFSAQILDERQVLLGAVGAFDWSGGALLYDTRSRRGRFLNQTAAAAADAEAAQYSYLGYAVAVLHKTCSLSYIAGAPRYKHHGAVFELQKEGREASFLPVLEGEQMGSYFGSELCPVDIDMDGSTDFLLVAAPFYHVHGEEGRVYVYRLSEQDGSFSLARILSGHPGFTNARFGFAMAAMGDLSQDKLTDVAIGAPLEGFGADDGASFGSVYIYNGHWDGLSASPSQRIRASTVAPGLQYFGMSMAGGFDISGDGLADITVGTLGQAVVFRSRPVVRLKVSMAFTPSALPIGFNGVVNVRLCFEISSVTTASESGLREALLNFTLDVDVGKQRRRLQCSDVRSCLGCLREWSSGSQLCEDLLLMPTEGELCEEDCFSNASVKVSYQLQTPEGQTDHPQPILDRYTEPFAIFQLPYEKACKNKLFCVAELQLATTVSQQELVVGLTKELTLNINLTNSGEDSYMTSMALNYPRNLQLKRMQKPPSPNIQCDDPQPVASVLIMNCRIGHPVLKRSSAHVSVVWQLEENAFPNRTADITVTVTNSNERRSLANETHTLQFRHGFVAVLSKPSIMYVNTGQGLSHHKEFLFHVHGENLFGAEYQLQICVPTKLRGLQVVAVKKLTRTQASTVCTWSQERACAYSSVQHVEEWHSVSCVIASDKENVTVAAEISWDHSEELLKDVTELQILGEISFNKSLYEGLNAENHRTKITVVFLKDEKYHSLPIIIKGSVGGLLVLIVILVILFKCGFFKRKYQQLNLESIRKAQLKSENLLEEEN

SEQ ID NO: 2144 - protein, 1170 aa, unidentified
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDATKVLIIITDGEATDSGNIDAAKDIIRYIIGIGKHFQTKESQETLHKFASKPASEFVKILDTFEKLKDLFTELQKKIYVIEGTSKQDLTSFNMELSSSGISADLSRGHAVVGAVGAKDWAGGFLDLKADLQDDTFIGNEPLTPEVRAGYLGYTVTWLPSRQKTSLLASGAPRYQHMGRVLLFQEPQGGGHWSQVQTIHGTQIGSYFGGELCGVDVDQDGETELLLIGAPLFYGEQRGGRVFIYQRRQLGFEEVSELQGDPGYPLGRFGEAITALTDINGDGLVDVAVGAPLEEQGAVYIFNGRHGGLSPQPSQRIEGTQVLSGIQWFGRSIHGVKDLEGDGLADVAVGAESQMIVLSSRPVVDMVTLMSFSPAEIPVHEVECSYSTSNKMKEGVNITICFQIKSLIPQFQGRLVANLTYTLQLDGHRTRRRGLFPGGRHELRRNIAVTTSMSCTDFSFHFPVCVQDLISPINVSLNFSLWEEEGTPRDQRAQGKDIPPILRPSLHSETWEIPFEKNCGEDKKCEANLRVSFSPARSRALRLTAFASLSVELSLSNLEEDAYWVQLDLHFPPGLSFRKVEMLKPHSQIPVSCEELPEESRLLSRALSCNVSSPIFKAGHSVALQMMFNTLVNSSWGDSVELHANVTCNNEDSDLLEDNSATTIIPILYPINILIQDQEDSTLYVSFTPKGPKIHQVKHMYQVRIQPSIHDHNIPTLEAVVGVPQPPSEGPITHQWSVQMEPPVPCHYEDLERLPDAAEPCLPGALFRCPVVFRQEILVQVIGTLELVGEIEASSMFSLCSSLSISFNSSKHFHLYGSNASLAQVVMKVDVVYEKQMLYLYVLSGIGGLLLLLLIFIVLYKVGFFKRNLKEKMEAGRGVPNGIPAEDSEQLASGQEAGDPGCLKPLHEKDSESGGGKD

SEQ ID NO: 2145 - protein, 1152 aa, unidentified
MALRVLLLTALTLCHGFNLDTENAMTFQENARGFGQSVVQLQGSRVVVGAPQEIVAANQRGSLYQCDYSTGSCEPIRLQVPVEAVNMSLGLSLAATTSPPQLLACGPTVHQTCSENTYVKGLCFLFGSNLRQQPQKFPEALRGCPQEDSDIAFLIDGSGSIIPHDFRRMKEFVSTVMEQLKKSKTLFSLMQYSEEFRIHFTFKEFQNNPNPRSLVKPITQLLGRTHTATGIRKVVRELFNITNGARKNAFKILVVITDGEKFGDPLGYEDVIPEADREGVIRYVIGVGDAFRSEKSRQELNTIASKPPRDHVFQVNNFEALKTIQNQLREKIFAIEGTQTGSSSSFEHEMSQEGFSAAITSNGPLLSTVGSYDWAGGVFLYTSKEKSTFINMTRVDSDMNDAYLGYAAAIILRNRVQSLVLGAPRYQHIGLVAMFRQNTGMWESNANVKGTQIGAYFGASLCSVDVDSNGSTDLVLIGAPHYYEQTRGGQVSVCPLPRGRARWQCDAVLYGEQGQPWGRFGAALTVLGDVNGDKLTDVAIGAPGEEDNRGAVYLFHGTSGSGISPSHSQRIAGSKLSPRLQYFGQSLSGGQDLTMDGLVDLTVGAQGHVLLLRSQPVLRVKAIMEFNPREVARNVFECNDQVVKGKEAGEVRVCLHVQKSTRDRLREGQIQSVVTYDLALDSGRPHSRAVFNETKNSTRRQTQVLGLTQTCETLKLQLPNCIEDPVSPIVLRLNFSLVGTPLSAFGNLRPVLAEDAQRLFTALFPFEKNCGNDNICQDDLSITFSFMSLDCLVVGGPREFNVTVTVRNDGEDSYRTQVTFFFPLDLSYRKVSTLQNQRSQRSWRLACESASSTEVSGALKSTSCSINHPIFPENSEVTFNITFDVDSKASLGNKLLLKANVTSENNMPRTNKTEFQLELPVKYAVYMVVTSHGVSTKYLNFTASENTSRVMQHQYQVSNLGQRSLPISLVFLVPVRLNQTVIWDRPQVTFSENLSSTCHTKERLPSHSDFLAELRKAPVVNCSIAVCQRIQCDIPFFGIQEEFNATLKGNLSFDWYIKTSHNHLLIVSTAEILFNDSVFTLLPGQGAFVRSQTETKVEPFEVPNPLPLIVGSSVGGLLLLALITAALYKLGFFKRQYKDMMSEGGPPGAEPQ

SEQ ID NO: 2146 - protein, 1048 aa, unidentified
MAFPPRRRLRLGPRGLPLLLSGLLLPLCRAFNLDVDSPAEYSGPEGSYFGFAVDFFVPSASSRMFLLVGAPKANTTQPGIVEGGQVLKCDWSSTRRCQPIEFDATGNRDYAKDDPLEFKSHQWFGASVRSKQDKILACAPLYHWRTEMKQEREPVGTCFLQDGTKTVEYAPCRSQDIDADGQGFCQGGFSIDFTKADRVLLGGPGSFYWQGQLISDQVAEIVSKYDPNVYSIKYNNQLATRTAQAIFDDSYLGYSVAVGDFNGDGIDDFVSGVPRAARTLGMVYIYDGKNMSSLYNFTGEQMAAYFGFSVAATDINGDDYADVFIGAPLFMDRGSDGKLQEVGQVSVSLQRASGDFQTTKLNGFEVFARFGSAIAPLGDLDQDGFNDIAIAAPYGGEDKKGIVYIFNGRSTGLNAVPSQILEGQWAARSMPPSFGYSMKGATDIDKNGYPDLIVGAFGVDRAILYRARPVITVNAGLEVYPSILNQDNKTCSLPGTALKVSCFNVRFCLKADGKGVLPRKLNFQVELLLDKLKQKGAIRRALFLYSRSPSHSKNMTISRGGLMQCEELIAYLRDESEFRDKLTPITIFMEYRLDYRTAADTTGLQPILNQFTPANISRQAHILLDCGEDNVCKPKLEVSVDSDQKKIYIGDDNPLTLIVKAQNQGEGAYEAELIVSIPLQADFIGVVRNNEALARLSCAFKTENQTRQVVCDLGNPMKAGTQLLAGLRFSVHQQSEMDTSVKFDLQIQSSNLFDKVSPVVSHKVDLAVLAAVEIRGVSSPDHVFLPIPNWEHKENPETEEDVGPVVQHIYELRNNGPSSFSKAMLHLQWPYKYNNNTLLYILHYDIDGPMNCTSDMEINPLRIKISSLQTTEKNDTVAGQGERDHLITKRDLALSEGDIHTLGCGVAQCLKIVCQVGRLDRGKSAILYVKSLLWTETFMNKENQNHSYSLKSSASFNVIEFPYKNLPIEDITNSTLVTTNVTWGIQPAPMPVPVWVIILAVLAGLLLLAVLVFVMYRMGFFKRVRPPQEEQEREQLQPHENGEGNSET

SEQ ID NO: 2147 - protein, 1163 aa, unidentified
MTRTRAALLLFTALATSLGFNLDTEELTAFRVDSAGFGDSVVQYANSWVVVGAPQKITAANQTGGLYQCGYSTGACEPIGLQVPPEAVNMSLGLSLASTTSPSQLLACGPTVHHECGRNMYLTGLCFLLGPTQLTQRLPVSRQECPRQEQDIVFLIDGSGSISSRNFATMMNFVRAVISQFQRPSTQFSLMQFSNKFQTHFTFEEFRRSSNPLSLLASVHQLQGFTYTATAIQNVVHRLFHASYGARRDAAKILIVITDGKKEGDSLDYKDVIPMADAAGIIRYAIGVGLAFQNRNSWKELNDIASKPSQEHIFKVEDFDALKDIQNQLKEKIFAIEGTETTSSSSFELEMAQEGFSAVFTPDGPVLGAVGSFTWSGGAFLYPPNMSPTFINMSQENVDMRDSYLGYSTELALWKGVQSLVLGAPRYQHTGKAVIFTQVSRQWRMKAEVTGTQIGSYFGASLCSVDVDSDGSTDLVLIGAPHYYEQTRGGQVSVCPLPRGWRRWWCDAVLYGEQGHPWGRFGAALTVLGDVNGDKLTDVVIGAPGEEENRGAVYLFHGVLGPSISPSHSQRIAGSQLSSRLQYFGQALSGGQDLTQDGLVDLAVGARGQVLLLRTRPVLWVGVSMQFIPAEIPRSAFECREQVVSEQTLVQSNICLYIDKRSKNLLGSRDLQSSVTLDLALDPGRLSPRATFQETKNRSLSRVRVLGLKAHCENFNLLLPSCVEDSVTPITLRLNFTLVGKPLLAFRNLRPMLAADAQRYFTASLPFEKNCGADHICQDNLGISFSFPGLKSLLVGSNLELNAEVMVWNDGEDSYGTTITFSHPAGLSYRYVAEGQKQGQLRSLHLTCDSAPVGSQGTWSTSCRINHLIFRGGAQITFLATFDVSPKAVLGDRLLLTANVSSENNTPRTSKTTFQLELPVKYAVYTVVSSHEQFTKYLNFSESEEKESHVAMHRYQVNNLGQRDLPVSINFWVPVELNQEAVWMDVEVSHPQNPSLRCSSEKIAPPASDFLAHIQKNPVLDCSIAGCLRFRCDVPSFSVQEELDFTLKGNLSFGWVRQILQKKVSVVSVAEITFDTSVYSQLPGQEAFMRAQTTTVLEKYKVHNPTPLIVGSSIGGLLLLALITAVLYKVGFFKRQYKEMMEEANGQIAPENGTQTPSPPSEK

SEQ ID NO: 2148 - protein, 798 aa, unidentified
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 2149 - protein, 769 aa, unidentified
MLGLRPPLLALVGLLSLGCVLSQECTKFKVSSCRECIESGPGCTWCQKLNFTGPGDPDSIRCDTRPQLLMRGCAADDIMDPTSLAETQEDHNGGQKQLSPQKVTLYLRPGQAAAFNVTFRRAKGYPIDLYYLMDLSYSMLDDLRNVKKLGGDLLRALNEITESGRIGFGSFVDKTVLPFVNTHPDKLRNPCPNKEKECQPPFAFRHVLKLTNNSNQFQTEVGKQLISGNLDAPEGGLDAMMQVAACPEEIGWRNVTRLLVFATDDGFHFAGDGKLGAILTPNDGRCHLEDNLYKRSNEFDYPSVGQLAHKLAENNIQPIFAVTSRMVKTYEKLTEIIPKSAVGELSEDSSNVVQLIKNAYNKLSSRVFLDHNALPDTLKVTYDSFCSNGVTHRNQPRGDCDGVQINVPITFQVKVTATECIQEQSFVIRALGFTDIVTVQVLPQCECRCRDQSRDRSLCHGKGFLECGICRCDTGYIGKNCECQTQGRSSQELEGSCRKDNNSIICSGLGDCVCGQCLCHTSDVPGKLIYGQYCECDTINCERYNGQVCGGPGRGLCFCGKCRCHPGFEGSACQCERTTEGCLNPRRVECSGRGRCRCNVCECHSGYQLPLCQECPGCPSPCGKYISCAECLKFEKGPFGKNCSAACPGLQLSNNPVKGRTCKERDSEGCWVAYTLEQQDGMDRYLIYVDESRECVAGPNIAAIVGGTVAGIVLIGILLLVIWKALIHLSDLREYRRFEKEKLKSQWNNDNPLFKSATTTVMNPKFAES

SEQ ID NO: 2150 - protein, 788 aa, unidentified
MRARPRPRPLWATVLALGALAGVGVGGPNICTTRGVSSCQQCLAVSPMCAWCSDEALPLGSPRCDLKENLLKDNCAPESIEFPVSEARVLEDRPLSDKGSGDSSQVTQVSPQRIALRLRPDDSKNFSIQVRQVEDYPVDIYYLMDLSYSMKDDLWSIQNLGTKLATQMRKLTSNLRIGFGAFVDKPVSPYMYISPPEALENPCYDMKTTCLPMFGYKHVLTLTDQVTRFNEEVKKQSVSRNRDAPEGGFDAIMQATVCDEKIGWRNDASHLLVFTTDAKTHIALDGRLAGIVQPNDGQCHVGSDNHYSASTTMDYPSLGLMTEKLSQKNINLIFAVTENVVNLYQNYSELIPGTTVGVLSMDSSNVLQLIVDAYGKIRSKVELEVRDLPEELSLSFNATCLNNEVIPGLKSCMGLKIGDTVSFSIEAKVRGCPQEKEKSFTIKPVGFKDSLIVQVTFDCDCACQAQAEPNSHRCNNGNGTFECGVCRCGPGWLGSQCECSEEDYRPSQQDECSPREGQPVCSQRGECLCGQCVCHSSDFGKITGKYCECDDFSCVRYKGEMCSGHGQCSCGDCLCDSDWTGYYCNCTTRTDTCMSSNGLLCSGRGKCECGSCVCIQPGSYGDTCEKCPTCPDACTFKKECVECKKFDRGALHDENTCNRYCRDEIESVKELKDTGKDAVNCTYKNEDDCVVRFQYYEDSSGKSILYVVEEPECPKGPDILVVLLSVMGAILLIGLAALLIWKLLITIHDRKEFAKFEEERARAKWDTANNPLYKEATSTFTNITYRGT

SEQ ID NO: 2151 - protein, 1822 aa, unidentified
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 2152 - protein, 799 aa, unidentified
MPRAPAPLYACLLGLCALLPRLAGLNICTSGSATSCEECLLIHPKCAWCSKEDFGSPRSITSRCDLRANLVKNGCGGEIESPASSFHVLRSLPLSSKGSGSAGWDVIQMTPQEIAVNLRPGDKTTFQLQVRQVEDYPVDLYYLMDLSLSMKDDLDNIRSLGTKLAEEMRKLTSNFRLGFGSFVDKDISPFSYTAPRYQTNPCIGYKLFPNCVPSFGFRHLLPLTDRVDSFNEEVRKQRVSRNRDAPEGGFDAVLQAAVCKEKIGWRKDALHLLVFTTDDVPHIALDGKLGGLVQPHDGQCHLNEANEYTASNQMDYPSLALLGEKLAENNINLIFAVTKNHYMLYKNFTALIPGTTVEILDGDSKNIIQLIINAYNSIRSKVELSVWDQPEDLNLFFTATCQDGVSYPGQRKCEGLKIGDTASFEVSLEARSCPSRHTEHVFALRPVGFRDSLEVGVTYNCTCGCSVGLEPNSARCNGSGTYVCGLCECSPGYLGTRCECQDGENQSVYQNLCREAEGKPLCSGRGDCSCNQCSCFESEFGKIYGPFCECDNFSCARNKGVLCSGHGECHCGECKCHAGYIGDNCNCSTDISTCRGRDGQICSERGHCLCGQCQCTEPGAFGEMCEKCPTCPDACSTKRDCVECLLLHSGKPDNQTCHSLCRDEVITWVDTIVKDDQEAVLCFYKTAKDCVMMFTYVELPSGKSNLTVLREPECGNTPNAMTILLAVVGSILLVGLALLAIWKLLVTIHDRREFAKFQSERSRARYEMASNPLYRKPISTHTVDFTFNKFNKSYNGTVD

SEQ ID NO: 2153 - protein, 788 aa, unidentified
MGIELLCLFFLFLGRNDHVQGGCALGGAETCEDCLLIGPQCAWCAQENFTHPSGVGERCDTPANLLAKGCQLNFIENPVSQVEILKNKPLSVGRQKNSSDIVQIAPQSLILKLRPGGAQTLQVHVRQTEDYPVDLYYLMDLSASMDDDLNTIKELGSRLSKEMSKLTSNFRLGFGSFVEKPVSPFVKTTPEEIANPCSSIPYFCLPTFGFKHILPLTNDAERFNEIVKNQKISANIDTPEGGFDAIMQAAVCKEKIGWRNDSLHLLVFVSDADSHFGMDSKLAGIVIPNDGLCHLDSKNEYSMSTVLEYPTIGQLIDKLVQNNVLLIFAVTQEQVHLYENYAKLIPGATVGLLQKDSGNILQLIISAYEELRSEVELEVLGDTEGLNLSFTAICNNGTLFQHQKKCSHMKVGDTASFSVTVNIPHCERRSRHIIIKPVGLGDALELLVSPECNCDCQKEVEVNSSKCHHGNGSFQCGVCACHPGHMGPRCECGEDMLSTDSCKEAPDHPSCSGRGDCYCGQCICHLSPYGNIYGPYCQCDNFSCVRHKGLLCGGNGDCDCGECVCRSGWTGEYCNCTTSTDSCVSEDGVLCSGRGDCVCGKCVCTNPGASGPTCERCPTCGDPCNSKRSCIECHLSAAGQAREECVDKCKLAGATISEEEDFSKDGSVSCSLQGENECLITFLITTDNEGKTIIHSINEKDCPKPPNIPMIMLGVSLAILLIGVVLLCIWKLLVSFHDRKEVAKFEAERSKAKWQTGTNPLYRGSTSTFKNVTYKHREKQKVDLSTDC

SEQ ID NO: 2154 - protein, 798 aa, unidentified
MVALPMVLVLLLVLSRGESELDAKIPSTGDATEWRNPHLSMLGSCQPAPSCQKCILSHPSCAWCKQLNFTASGEAEARRCARREELLARGCPLEELEEPRGQQEVLQDQPLSQGARGEGATQLAPQRVRVTLRPGEPQQLQVRFLRAEGYPVDLYYLMDLSYSMKDDLERVRQLGHALLVRLQEVTHSVRIGFGSFVDKTVLPFVSTVPSKLRHPCPTRLERCQSPFSFHHVLSLTGDAQAFEREVGRQSVSGNLDSPEGGFDAILQAALCQEQIGWRNVSRLLVFTSDDTFHTAGDGKLGGIFMPSDGHCHLDSNGLYSRSTEFDYPSVGQVAQALSAANIQPIFAVTSAALPVYQELSKLIPKSAVGELSEDSSNVVQLIMDAYNSLSSTVTLEHSSLPPGVHISYESQCEGPEKREGKAEDRGQCNHVRINQTVTFWVSLQATHCLPEPHLLRLRALGFSEELIVELHTLCDCNCSDTQPQAPHCSDGQGHLQCGVCSCAPGRLGRLCECSVAELSSPDLESGCRAPNGTGPLCSGKGHCQCGRCSCSGQSSGHLCECDDASCERHEGILCGGFGRCQCGVCHCHANRTGRACECSGDMDSCISPEGGLCSGHGRCKCNRCQCLDGYYGALCDQCPGCKTPCERHRDCAECGAFRTGPLATNCSTACAHTNVTLALAPILDDGWCKERTLDNQLFFFLVEDDARGTVVLRVRPQEKGADHTQAIVLGCVGGIVAVGLGLVLAYRLSVEIYDRREYSRFEKEQQQLNWKQDSNPLYKSAITTTINPRFQEADSPTL

SEQ ID NO: 2155 - protein, 769 aa, unidentified
MCGSALAFFTAAFVCLQNDRRGPASFLWAAWVFSLVLGLGQGEDNRCASSNAASCARCLALGPECGWCVQEDFISGGSRSERCDIVSNLISKGCSVDSIEYPSVHVIIPTENEINTQVTPGEVSIQLRPGAEANFMLKVHPLKKYPVDLYYLVDVSASMHNNIEKLNSVGNDLSRKMAFFSRDFRLGFGSYVDKTVSPYISIHPERIHNQCSDYNLDCMPPHGYIHVLSLTENITEFEKAVHRQKISGNIDTPEGGFDAMLQAAVCESHIGWRKEAKRLLLVMTDQTSHLALDSKLAGIVVPNDGNCHLKNNVYVKSTTMEHPSLGQLSEKLIDNNINVIFAVQGKQFHWYKDLLPLLPGTIAGEIESKAANLNNLVVEAYQKLISEVKVQVENQVQGIYFNITAICPDGSRKPGMEGCRNVTSNDEVLFNVTVTMKKCDVTGGKNYAIIKPIGFNETAKIHIHRNCSCQCEDNRGPKGKCVDETFLDSKCFQCDENKCHFDEDQFSSESCKSHKDQPVCSGRGVCVCGKCSCHKIKLGKVYGKYCEKDDFSCPYHHGNLCAGHGECEAGRCQCFSGWEGDRCQCPSAAAQHCVNSKGQVCSGRGTCVCGRCECTDPRSIGRFCEHCPTCYTACKENWNCMQCLHPHNLSQAILDQCKTSCALMEQQHYVDQTSECFSSPSYLRIFFIIFIVTFLIGLLKVLIIRQVILQWNSNKIKSSSDYRVSASKKDKLILQSVCTRAVTYRREKPEEIKMDISKLNAHETFRCNF

SEQ ID NO: 2156 - protein, 263 aa, unidentified
MVKIAFNTPTAVQKEEARQDVEALLSRTVRTQILTGKELRVATQEKEGSSGRCMLTLLGLSFILAGLIVGGACIYKYFMPKSTIYRGEMCFFDSEDPANSLRGGEPNFLPVTEEADIREDDNIAIIDVPVPSFSDSDPAAIIHDFEKGMTAYLDLLLGNCYLMPLNTSIVMPPKNLVELFGKLASGRYLPQTYVVREDLVAVEEIRDVSNLGIFIYQLCNNRKSFRLRRRDLLLGFNKRAIDKCWKIRHFPNEFIVETKICQE

SEQ ID NO: 2157 - protein, 266 aa, unidentified
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLNTSIVMPPRNLLELLINIKAGTYLPQSYLIHEHMVITDRIENIDHLGFFIYRLCHDKETYKLQRRETIKGIQKREASNCFAIRHFENKFAVETLICS

SEQ ID NO: 2158 - protein, 267 aa, unidentified
MVKISFQPAVAGIKGDKADKASASAPAPASATEILLTPAREEQPPQHRSKRGGSVGGVCYLSMGMVVLLMGLVFASVYIYRYFFLAQLARDNFFRCGVLYEDSLSSQVRTQMELEEDVKIYLDENYERINVPVPQFGGGDPADIIHDFQRGLTAYHDISLDKCYVIELNTTIVLPPRNFWELLMNVKRGTYLPQTYIIQEEMVVTEHVSDKEALGSFIYHLCNGKDTYRLRRRATRRRINKRGAKNCNAIRHFENTFVVETLICGVV

SEQ ID NO: 2159 - protein, 2758 aa, unidentified
MSDKMSSFLHIGDICSLYAEGSTNGFISTLGLVDDRCVVQPETGDLNNPPKKFRDCLFKLCPMNRYSAQKQFWKAAKPGANSTTDAVLLNKLHHAADLEKKQNETENRKLLGTVIQYGNVIQLLHLKSNKYLTVNKRLPALLEKNAMRVTLDEAGNEGSWFYIQPFYKLRSIGDSVVIGDKVVLNPVNAGQPLHASSHQLVDNPGCNEVNSVNCNTSWKIVLFMKWSDNKDDILKGGDVVRLFHAEQEKFLTCDEHRKKQHVFLRTTGRQSATSATSSKALWEVEVVQHDPCRGGAGYWNSLFRFKHLATGHYLAAEVDPDFEEECLEFQPSVDPDQDASRSRLRNAQEKMVYSLVSVPEGNDISSIFELDPTTLRGGDSLVPRNSYVRLRHLCTNTWVHSTNIPIDKEEEKPVMLKIGTSPVKEDKEAFAIVPVSPAEVRDLDFANDASKVLGSIAGKLEKGTITQNERRSVTKLLEDLVYFVTGGTNSGQDVLEVVFSKPNRERQKLMREQNILKQIFKLLQAPFTDCGDGPMLRLEELGDQRHAPFRHICRLCYRVLRHSQQDYRKNQEYIAKQFGFMQKQIGYDVLAEDTITALLHNNRKLLEKHITAAEIDTFVSLVRKNREPRFLDYLSDLCVSMNKSIPVTQELICKAVLNPTNADILIETKLVLSRFEFEGVSSTGENALEAGEDEEEVWLFWRDSNKEIRSKSVRELAQDAKEGQKEDRDVLSYYRYQLNLFARMCLDRQYLAINEISGQLDVDLILRCMSDENLPYDLRASFCRLMLHMHVDRDPQEQVTPVKYARLWSEIPSEIAIDDYDSSGASKDEIKERFAQTMEFVEEYLRDVVCQRFPFSDKEKNKLTFEVVNLARNLIYFGFYNFSDLLRLTKILLAILDCVHVTTIFPISKMAKGEENKGNNDVEKLKSSNVMRSIHGVGELMTQVVLRGGGFLPMTPMAAAPEGNVKQAEPEKEDIMVMDTKLKIIEILQFILNVRLDYRISCLLCIFKREFDESNSQTSETSSGNSSQEGPSNVPGALDFEHIEEQAEGIFGGSEENTPLDLDDHGGRTFLRVLLHLTMHDYPPLVSGALQLLFRHFSQRQEVLQAFKQVQLLVTSQDVDNYKQIKQDLDQLRSIVEKSELWVYKGQGPDETMDGASGENEHKKTEEGNNKPQKHESTSSYNYRVVKEILIRLSKLCVQESASVRKSRKQQQRLLRNMGAHAVVLELLQIPYEKAEDTKMQEIMRLAHEFLQNFCAGNQQNQALLHKHINLFLNPGILEAVTMQHIFMNNFQLCSEINERVVQHFVHCIETHGRNVQYIKFLQTIVKAEGKFIKKCQDMVMAELVNSGEDVLVFYNDRASFQTLIQMMRSERDRMDENSPLMYHIHLVELLAVCTEGKNVYTEIKCNSLLPLDDIVRVVTHEDCIPEVKIAYINFLNHCYVDTEVEMKEIYTSNHMWKLFENFLVDICRACNNTSDRKHADSILEKYVTEIVMSIVTTFFSSPFSDQSTTLQTRQPVFVQLLQGVFRVYHCNWLMPSQKASVESCIRVLSDVAKSRAIAIPVDLDSQVNNLFLKSHSIVQKTAMNWRLSARNAARRDSVLAASRDYRNIIERLQDIVSALEDRLRPLVQAELSVLVDVLHRPELLFPENTDARRKCESGGFICKLIKHTKQLLEENEEKLCIKVLQTLREMMTKDRGYGEKLISIDELDNAELPPAPDSENATEELEPSPPLRQLEDHKRGEALRQVLVNRYYGNVRPSGRRESLTSFGNGPLSAGGPGKPGGGGGGSGSSSMSRGEMSLAEVQCHLDKEGASNLVIDLIMNASSDRVFHESILLAIALLEGGNTTIQHSFFCRLTEDKKSEKFFKVFYDRMKVAQQEIKATVTVNTSDLGNKKKDDEVDRDAPSRKKAKEPTTQITEEVRDQLLEASAATRKAFTTFRREADPDDHYQPGEGTQATADKAKDDLEMSAVITIMQPILRFLQLLCENHNRDLQNFLRCQNNKTNYNLVCETLQFLDCICGSTTGGLGLLGLYINEKNVALINQTLESLTEYCQGPCHENQNCIATHESNGIDIITALILNDINPLGKKRMDLVLELKNNASKLLLAIMESRHDSENAERILYNMRPKELVEVIKKAYMQGEVEFEDGENGEDGAASPRNVGHNIYILAHQLARHNKELQSMLKPGGQVDGDEALEFYAKHTAQIEIVRLDRTMEQIVFPVPSICEFLTKESKLRIYYTTERDEQGSKINDFFLRSEDLFNEMNWQKKLRAQPVLYWCARNMSFWSSISFNLAVLMNLLVAFFYPFKGVRGGTLEPHWSGLLWTAMLISLAIVIALPKPHGIRALIASTILRLIFSVGLQPTLFLLGAFNVCNKIIFLMSFVGNCGTFTRGYRAMVLDVEFLYHLLYLVICAMGLFVHEFFYSLLLFDLVYREETLLNVIKSVTRNGRSIILTAVLALILVYLFSIVGYLFFKDDFILEVDRLPNETAVPETGESLASEFLFSDVCRVESGENCSSPAPREELVPAEETEQDKEHTCETLLMCIVTVLSHGLRSGGGVGDVLRKPSKEEPLFAARVIYDLLFFFMVIIIVLNLIFGVIIDTFADLRSEKQKKEEILKTTCFICGLERDKFDNKTVTFEEHIKEEHNMWHYLCFIVLVKVKDSTEYTGPESYVAEMIKERNLDWFPRMRAMSLVSSDSEGEQNELRNLQEKLESTMKLVTNLSGQLSELKDQMTEQRKQKQRIGLLGHPPHMNVNPQQPA

SEQ ID NO: 2160 - protein, 2701 aa, unidentified
MTEKMSSFLYIGDIVSLYAEGSVNGFISTLGLVDDRCVVHPEAGDLANPPKKFRDCLFKVCPMNRYSAQKQYWKAKQAKQGNHTEAALLKKLQHAAELEQKQNESENKKLLGEIVKYSNVIQLLHIKSNKYLTVNKRLPALLEKNAMRVSLDAAGNEGSWFYIHPFWKLRSEGDNIVVGDKVVLMPVNAGQPLHASNIELLDNPGCKEVNAVNCNTSWKITLFMKYSSYREDVLKGGDVVRLFHAEQEKFLTCDEYEKKQHIFLRTTLRQSATSATSSKALWEIEVVHHDPCRGGAGQWNSLFRFKHLATGNYLAAELNPDYRDAQNEGKNVRDGVPPTSKKKRQAGEKIMYTLVSVPHGNDIASLFELDATTLQRADCLVPRNSYVRLRHLCTNTWVTSTSIPIDTDEERPVMLKIGTCQTKEDKEAFAIVSVPLSEVRDLDFANDANKVLATTVKKLENGTITQNERRFVTKLLEDLIFFVADVPNNGQEVLDVVITKPNRERQKLMREQNILAQVFGILKAPFKEKAGEGSMLRLEDLGDQRYAPYKYMLRLCYRVLRHSQQDYRKNQEYIAKNFCVMQSQIGYDILAEDTITALLHNNRKLLEKHITAKEIETFVSLLRRNREPRFLDYLSDLCVSNTTAIPVTQELICKFMLSPGNADILIQTKVVSMQADNPMESSILSDDIDDEEVWLYWIDSNKEPHGKAIRHLAQEAKEGTKADLEVLTYYRYQLNLFARMCLDRQYLAINQISTQLSVDLILRCVSDESLPFDLRASFCRLMLHMHVDRDPQESVVPVRYARLWTEIPTKITIHEYDSITDSSRNDMKRKFALTMEFVEEYLKEVVNQPFPFGDKEKNKLTFEVVHLARNLIYFGFYSFSELLRLTRTLLAILDIVQAPMSSYFERLSKFQDGGNNVMRTIHGVGEMMTQMVLSRGSIFPMSVPDVPPSIHPSKQGSPTEHEDVTVMDTKLKIIEILQFILSVRLDYRISYMLSIYKKEFGEDNDNAETSASGSPDTLLPSAIVPDIDEIAAQAETMFAGRKEKNPVQLDDEGGRTFLRVLIHLIMHDYPPLLSGALQLLFKHFSQRAEVLQAFKQVQLLVSNQDVDNYKQIKADLDQLRLTVEKSELWVEKSSNYENGEIGESQVKGGEEPIEESNILSPVQDGTKKPQIDSNKSNNYRIVKEILIRLSKLCVQNKKCRNQHQRLLKNMGAHSVVLDLLQIPYEKNDEKMNEVMNLAHTFLQNFCRGNPQNQVLLHKHLNLFLTPGLLEAETMRHIFMNNYHLCNEISERVVQHFVHCIETHGRHVEYLRFLQTIVKADGKYVKKCQDMVMTELINGGEDVLIFYNDRASFPILLHMMCSERDRGDESGPLAYHITLVELLAACTEGKNVYTEIKCNSLLPLDDIVRVVTHDDCIPEVKIAYVNFVNHCYVDTEVEMKEIYTSNHIWKLFENFLVDMARVCNTTTDRKHADIFLEKCVTESIMNIVSGFFNSPFSDNSTSLQTHQPVFIQLLQSAFRIYNCTWPNPAQKASVESCIRTLAEVAKNRGIAIPVDLDSQVNTLFMKSHSNMVQRAAMGWRLSARSGPRFKEALGGPAWDYRNIIEKLQDVVASLEHQFSPMMQAEFSVLVDVLYSPELLFPEGSDARIRCGAFMSKLINHTKKLMEKEEKLCIKILQTLREMLEKKDSFVEEGNTLRKILLNRYFKGDYSIGVNGHLSGAYSKTAQVGGSFSGQDSDKMGISMSDIQCLLDKEGASELVIDVIVNTKNDRIFSEGIFLGIALLEGGNTQTQYSFYQQLHEQKKSEKFFKVLYDRMKAAQKEIRSTVTVNTIDLGNKKRDDDNELMTSGPRMRVRDSTLHLKEGMKGQLTEASSATSKAYCVYRREMDPEIDIMCTGPEAGNTEEKSAEEVTMSPAIAIMQPILRFLQLLCENHNRELQNFLRNQNNKTNYNLVCETLQFLDCICGSTTGGLGLLGLYINEKNVALVNQNLESLTEYCQGPCHENQTCIATHESNGIDIIIALILNDINPLGKYRMDLVLQLKNNASKLLLAIMESRHDSENAERILFNMRPRELVDVMKNAYNQGLECDHGDDEGGDDGVSPKDVGHNIYILAHQLARHNKLLQQMLKPGSDPDEGDEALKYYANHTAQIEIVRHDRTMEQIVFPVPNICEYLTRESKCRVFNTTERDEQGSKVNDFFQQTEDLYNEMKWQKKIRNNPALFWFSRHISLWGSISFNLAVFINLAVALFYPFGDDGDEGTLSPLFSVLLWIAVAICTSMLFFFSKPVGIRPFLVSIMLRSIYTIGLGPTLILLGAANLCNKIVFLVSFVGNRGTFTRGYRAVILDMAFLYHVAYVLVCMLGLFVHEFFYSFLLFDLVYREETLLNVIKSVTRNGRSIILTAVLALILVYLFSIIGFLFLKDDFTMEVDRLKNRTPVTGSHQVPTMTLTTMMEACAKENCSPTIPASNTADEEYEDGIERTCDTLLMCIVTVLNQGLRNGGGVGDVLRRPSKDEPLFAARVVYDLLFYFIVIIIVLNLIFGVIIDTFADLRSEKQKKEEILKTTCFICGLERDKFDNKTVSFEEHIKSEHNMWHYLYFIVLVKVKDPTEYTGPESYVAQMIVEKNLDWFPRMRAMSLVSNEGDSEQNEIRSLQEKLESTMSLVKQLSGQLAELKEQMTEQRKNKQRLGFLGSNTPHVNHHMPPH

SEQ ID NO: 2161 - protein, 2671 aa, unidentified
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCDEYKGKLQVFLRTTLRQSATSATSSNALWEVEVVHHDPCRGGAGHWNGLYRFKHLATGNYLAAEENPSYKGDASDPKAAGMGAQGRTGRRNAGEKIKYCLVAVPHGNDIASLFELDPTTLQKTDSFVPRNSYVRLRHLCTNTWIQSTNVPIDIEEERPIRLMLGTCPTKEDKEAFAIVSVPVSEIRDLDFANDASSMLASAVEKLNEGFISQNDRRFVIQLLEDLVFFVSDVPNNGQNVLDIMVTKPNRERQKLMREQNILKQVFGILKAPFREKGGEGPLVRLEELSDQKNAPYQHMFRLCYRVLRHSQEDYRKNQEHIAKQFGMMQSQIGYDILAEDTITALLHNNRKLLEKHITKTEVETFVSLVRKNREPRFLDYLSDLCVSNHIAIPVTQELICKCVLDPKNSDILIRTELRPVKEMAQSHEYLSIEYSEEEVWLTWTDKNNEHHEKSVRQLAQEARAGNAHDENVLSYYRYQLKLFARMCLDRQYLAIDEISQQLGVDLIFLCMADEMLPFDLRASFCHLMLHVHVDRDPQELVTPVKFARLWTEIPTAITIKDYDSNLNASRDDKKNKFANTMEFVEDYLNNVVSEAVPFANEEKNKLTFEVVSLAHNLIYFGFYSFSELLRLTRTLLGIIDCVQGPPAMLQAYEDPGGKNVRRSIQGVGHMMSTMVLSRKQSVFSAPSLSAGASAAEPLDRSKFEENEDIVVMETKLKILEILQFILNVRLDYRISYLLSVFKKEFVEVFPMQDSGADGTAPAFDSTTANMNLDRIGEQAEAMFGVGKTSSMLEVDDEGGRMFLRVLIHLTMHDYAPLVSGALQLLFKHFSQRQEAMHTFKQVQLLISAQDVENYKVIKSELDRLRTMVEKSELWVDKKGSGKGEEVEAGAAKDKKERPTDEEGFLHPPGEKSSENYQIVKGILERLNKMCGVGEQMRKKQQRLLKNMDAHKVMLDLLQIPYDKGDAKMMEILRYTHQFLQKFCAGNPGNQALLHKHLHLFLTPGLLEAETMQHIFLNNYQLCSEISEPVLQHFVHLLATHGRHVQYLDFLHTVIKAEGKYVKKCQDMIMTELTNAGDDVVVFYNDKASLAHLLDMMKAARDGVEDHSPLMYHISLVDLLAACAEGKNVYTEIKCTSLLPLEDVVSVVTHEDCITEVKMAYVNFVNHCYVDTEVEMKEIYTSNHIWTLFENFTLDMARVCSKREKRVADPTLEKYVLSVVLDTINAFFSSPFSENSTSLQTHQTIVVQLLQSTTRLLECPWLQQQHKGSVEACIRTLAMVAKGRAILLPMDLDAHISSMLSSGASCAAAAQRNASSYKATTRAFPRVTPTANQWDYKNIIEKLQDIITALEERLKPLVQAELSVLVDVLHWPELLFLEGSEAYQRCESGGFLSKLIQHTKDLMESEEKLCIKVLRTLQQMLLKKTKYGDRGNQLRKMLLQNYLQNRKSTSRGDLPDPIGTGLDPDWSAIAATQCRLDKEGATKLVCDLITSTKNEKIFQESIGLAIHLLDGGNTEIQKSFHNLMMSDKKSERFFKVLHDRMKRAQQETKSTVAVNMNDLGSQPHEDREPVDPTTKGRVASFSIPGSSSRYSLGPSLRRGHEVSERVQSSEMGTSVLIMQPILRFLQLLCENHNRDLQNFLRCQNNKTNYNLVCETLQFLDIMCGSTTGGLGLLGLYINEDNVGLVIQTLETLTEYCQGPCHENQTCIVTHESNGIDIITALILNDISPLCKYRMDLVLQLKDNASKLLLALMESRHDSENAERILISLRPQELVDVIKKAYLQEEERENSEVSPREVGHNIYILALQLSRHNKQLQHLLKPVKRIQEEEAEGISSMLSLNNKQLSQMLKSSAPAQEEEEDPLAYYENHTSQIEIVRQDRSMEQIVFPVPGICQFLTEETKHRLFTTTEQDEQGSKVSDFFDQSSFLHNEMEWQRKLRSMPLIYWFSRRMTLWGSISFNLAVFINIIIAFFYPYMEGASTGVLDSPLISLLFWILICFSIAALFTKRYSIRPLIVALILRSIYYLGIGPTLNILGALNLTNKIVFVVSFVGNRGTFIRGYKAMVMDMEFLYHVGYILTSVLGLFAHELFYSILLFDLIYREETLFNVIKSVTRNGRSILLTALLALILVYLFSIVGFLFLKDDFILEVDRLPNNHSTASPLGMPHGAAAFVDTCSGDKMDCVSGLSVPEVLEEDRELDSTERACDTLLMCIVTVMNHGLRNGGGVGDILRKPSKDESLFPARVVYDLLFFFIVIIIVLNLIFGVIIDTFADLRSEKQKKEEILKTTCFICGLERDKFDNKTVSFEEHIKLEHNMWNYLYFIVLVRVKNKTDYTGPESYVAQMIKNKNLDWFPRMRAMSLVSNEGEGEQNEIRILQDKLNSTMKLVSHLTAQLNELKEQMTEQRKRRQRLGFVDVQNCISR

SEQ ID NO: 2162 - protein, 547 aa, unidentified
MAMGLFRVCLVVVTAIINHPLLFPRENATVPENEEEIIRKMQAHQEKLQLEQLRLEEEVARLAAEKEALEQVAEEGRQQNETRVAWDLWSTLCMILFLMIEVWRQDHQEGPSPECLGGEEDELPGLGGAPLQGLTLPNKATLGHFYERCIRGATADAARTREFLEGFVDDLLEALRSLCNRDTDMEVEDFIGVDSMYENWQVDRPLLCHLFVPFTPPEPYRFHPELWCSGRSVPLDRQGYGQIKVVRADGDTLSCICGKTKLGEDMLCLLHGRNSMAPPCGDMENLLCATDSLYLDTMQVMKWFQTALTRAWKGIAHKYEFDLAFGQLDSPGSLKIKFRSGKFMPFNLIPVIQCDDSDLYFVSHLPREPSEGTPASSTDWLLSFAVYERHFLRTTLKALPEGACHLSCLQIASFLLSKQSRLTGPSGLSSYHLKTALLHLLLLRQAADWKAGQLDARLHELLCFLEKSLLQKKLHHFFIGNRKVPEAMGLPEAVLRAEPLNLFRPFVLQRSLYRKTLDSFYEMLKNAPALISEYSLHVPSDQPTPKS

SEQ ID NO: 2163 - protein, 555 aa, unidentified
MNVDAEASMAVISLLFLAVMYVVHHPLMVSDRMDLDTLARSRQLEKRMSEEMRLLEMEFEERKRAAEQRQKAENFWTGDTSSDQLVLGKKDMGWPFQADGQEGPLGWMLGNLWNTGLFCLFLVFELLRQNMQHEPAFDSSSEEEEEEVRVVPVTSYNWLTDFPSQEALDSFYKHYVQNAIRDLPCTCEFVESFVDDLIEACRVLSRQEAHPQLEDCLGIGAAFEKWGTLHETQKFDILVPIVPPQGTMFVLEMRDPALGRRCGCVLVESECVCKREKLLGDVLCLVHHHRDPSAVLGKCSSSIKAALCTGFHLDVCKTVQWFRNMMGNAWALVAHKYDFKLSLPPSTTSCKLRLDYRSGRFLSIHLVLGVQREDTLVYLVSQAPDQEQLTSVDWPESFVACEHLFLKLVGRFAPENTCHLKCLQIILSLRQHQSLPHGASRPILTSYHFKTALMHLLLRLPLTDWAHNMLSQRLQDILWFLGRGLQQRSLHHFLIGNNFLPLTIPIPKTFRNAEPVNLFQHLVLNPKAHSQAVEEFQNLLTQVKTLPHAPLAAAP

SEQ ID NO: 2164 - protein, 535 aa, unidentified
MSVHYTLNLRVFWPLVTGLCTALVCLYHVLRGSGGARAEPADGVDGGFPLLKVAVLLLLSYVLLRCRHAVRQRFLPGSPRLEGHAAFSSRHFREPGLSILLESYYEHEVRLSPHVLGHSKAHVSRIVGELVRAGRARGSPGLIPGGALALAFRGDFIQVGSAYEQHKIRRPDSFDVLVPLRLPPLVALEPRSLGEEPALAPAFRGCFLCALKAPPSPSGASGGHWLRDCKPFADAFCVDVRGRRHLSATLVLRWFQSHLQRSLATVRYSLEGRCRVTLTPGGLEQPPTLHILPCRTDYGCCRLSMAVRLIPAVHLGDGVFLVAPPPPPLPSAPLLELPEGLRAEALWGVNTARQEQKLLSWLQERAAPGACYLKCLQLLKALRDLGARGLDSAAATQWGRILSSYVLKTVLLAVLLRKGAPGQGWDEEHLGRCLEELVQFLRDCLLRRHTLFHCVLGPGGAAAEVGPLPKALREAAPVDLLAAFDGHARELAAARLLSTWQRLPQLLRAYGGPRYLARCPPPRSQRTQGFLEGEP

SEQ ID NO: 2165 - protein, 1721 aa, unidentified
MAQFPTPFGGSLDIWAITVEERAKHDQQFHSLKPISGFITGDQARNFFFQSGLPQPVLAQIWALADMNNDGRMDQVEFSIAMKLIKLKLQGYQLPSALPPVMKQQPVAISSAPAFGMGGIASMPPLTAVAPVPMGSIPVVGMSPTLVSSVPTAAVPPLANGAPPVIQPLPAFAHPAATLPKSSSFSRSGPGSQLNTKLQKAQSFDVASVPPVAEWAVPQSSRLKYRQLFNSHDKTMSGHLTGPQARTILMQSSLPQAQLASIWNLSDIDQDGKLTAEEFILAMHLIDVAMSGQPLPPVLPPEYIPPSFRRVRSGSGISVISSTSVDQRLPEEPVLEDEQQQLEKKLPVTFEDKKRENFERGNLELEKRRQALLEQQRKEQERLAQLERAEQERKERERQEQERKRQLELEKQLEKQRELERQREEERRKEIERREAAKRELERQRQLEWERNRRQELLNQRNKEQEDIVVLKAKKKTLEFELEALNDKKHQLEGKLQDIRCRLTTQRQEIESTNKSRELRIAEITHLQQQLQESQQMLGRLIPEKQILNDQLKQVQQNSLHRDSLVTLKRALEAKELARQHLRDQLDEVEKETRSKLQEIDIFNNQLKELREIHNKQQLQKQKSMEAERLKQKEQERKIIELEKQKEEAQRRAQERDKQWLEHVQQEDEHQRPRKLHEEEKLKREESVKKKDGEEKGKQEAQDKLGRLFHQHQEPAKPAVQAPWSTAEKGPLTISAQENVKVVYYRALYPFESRSHDEITIQPGDIVMVKGEWVDESQTGEPGWLGGELKGKTGWFPANYAEKIPENEVPAPVKPVTDSTSAPAPKLALRETPAPLAVTSSEPSTTPNNWADFSSTWPTSTNEKPETDNWDAWAAQPSLTVPSAGQLRQRSAFTPATATGSSPSPVLGQGEKVEGLQAQALYPWRAKKDNHLNFNKNDVITVLEQQDMWWFGEVQGQKGWFPKSYVKLISGPIRKSTSMDSGSSESPASLKRVASPAAKPVVSGEEFIAMYTYESSEQGDLTFQQGDVILVTKKDGDWWTGTVGDKAGVFPSNYVRLKDSEGSGTAGKTGSLGKKPEIAQVIASYTATGPEQLTLAPGQLILIRKKNPGGWWEGELQARGKKRQIGWFPANYVKLLSPGTSKITPTEPPKSTALAAVCQVIGMYDYTAQNDDELAFNKGQIINVLNKEDPDWWKGEVNGQVGLFPSNYVKLTTDMDPSQQWCSDLHLLDMLTPTERKRQGYIHELIVTEENYVNDLQLVTEIFQKPLMESELLTEKEVAMIFVNWKELIMCNIKLLKALRVRKKMSGEKMPVKMIGDILSAQLPHMQPYIRFCSRQLNGAALIQQKTDEAPDFKEFVKRLAMDPRCKGMPLSSFILKPMQRVTRYPLIIKNILENTPENHPDHSHLKHALEKAEELCSQVNEGVREKENSDRLEWIQAHVQCEGLSEQLVFNSVTNCLGPRKFLHSGKLYKAKSNKELYGFLFNDFLLLTQITKPLGSSGTDKVFSPKSNLQYKMYKTPIFLNEVLVKLPTDPSGDEPIFHISHIDRVYTLRAESINERTAWVQKIKAASELYIETEKKKREKAYLVRSQRATGIGRLMVNVVEGIELKPCRSHGKSNPYCEVTMGSQCHITKTIQDTLNPKWNSNCQFFIRDLEQEVLCITVFERDQFSPDDFLGRTEIRVADIKKDQGSKGPVTKCLLLHEVPTGEIVVRLDLQLFDEP

SEQ ID NO: 2166 - protein, 289 aa, unidentified
MYFLTPILVAILCILVVWIFKNADRSMEKKKGEPRTRAEARPWVDEDLKDSSDLHQAEEDADEWQESEENVEHIPFSHNHYPEKEMVKRSQEFYELLNKRRSVRFISNEQVPMEVIDNVIRTAGTAPSGAHTEPWTFVVVKDPDVKHKIRKIIEEEEEINYMKRMGHRWVTDLKKLRTNWIKEYLDTAPILILIFKQVHGFAANGKKKVHYYNEISVSIACGILLAALQNAGLVTVTTTPLNCGPRLRVLLGRPAHEKLLMLLPVGYPSKEATVPDLKRKPLDQIMVTV

SEQ ID NO: 2167 - protein, 350 aa, unidentified
MGPHFTLLCAALAGCLLPAEGCVICDPSVVLALKSLEKDYLPGHLDAKHHKAMMERVENAVKDFQELSLNEDAYMGVVDEATLQKGSWSLLKDLKRITDSDVKGDLFVKELFWMLHLQKETFATYVARFQKEAYCPNKCGVMLQTLIWCKNCKKEVHACRKSYDCGERNVEVPQMEDMILDCELNWHQASEGLTDYSFYRVWGNNTETLVSKGKEATLTKPMVGPEDAGSYRCELGSVNSSPATIINFHVTVLPKMIKEEKPSPNIVTPGEATTESSISLQPLQPEKMLASRLLGLLICGSLALITGLTFAIFRRRKVIDFIKSSLFGLGSGAAEQTQVPKEKATDSRQQ

SEQ ID NO: 2168 - protein, 221 aa, unidentified
MPLALTLLLLSGLGAPGGWGCLQCDPLVLEALGHLRSALIPSRFQLEQLQARAGAVLMGMEGPFFRDYALNVFVGKVETNQLDLVASFVKNQTQHLMGNSLKDEPLLEELVTLRANVIKEFKKVLISYELKACNPKLCRLLKEEVLDCLHCQRITPKCIHKKYCFVDRQPRVALQYQMDSKYPRNQALLGILISVSLAVFVFVVIVVSACTYRQNRKLLLQ

SEQ ID NO: 2169 - protein, 239 aa, unidentified
MGDLWLFLLLPLSAFHGVKGCLECDPKFIEDVGSLLGNLIPSEVPGRTQLLERQIKEMIHLSFKVSHSDKRLRVLAVQQVVKLRTWLKNEFYKLGNETWKGVFIYQGKLLDVCQNLESKLKELLKNFSEIACSEDCIVVEGPILDCWTCLRMTNRCFKGEYCGDEDPRKAENREIALFLILLATAVILGSAVLLFHFCIFHRRKMKAIRRSLKEYVEKKLEELMGKIDEKEEKDFRLRK

SEQ ID NO: 2170 - protein, 1218 aa, unidentified
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQYGWQGLYCDKCIPHPGCVHGICNEPWQCLCETNWGGQLCDKDLNYCGTHQPCLNGGTCSNTGPDKYQCSCPEGYSGPNCEIAEHACLSDPCHNRGSCKETSLGFECECSPGWTGPTCSTNIDDCSPNNCSHGGTCQDLVNGFKCVCPPQWTGKTCQLDANECEAKPCVNAKSCKNLIASYYCDCLPGWMGQNCDININDCLGQCQNDASCRDLVNGYRCICPPGYAGDHCERDIDECASNPCLNGGHCQNEINRFQCLCPTGFSGNLCQLDIDYCEPNPCQNGAQCYNRASDYFCKCPEDYEGKNCSHLKDHCRTTPCEVIDSCTVAMASNDTPEGVRYISSNVCGPHGKCKSQSGGKFTCDCNKGFTGTYCHENINDCESNPCRNGGTCIDGVNSYKCICSDGWEGAYCETNINDCSQNPCHNGGTCRDLVNDFYCDCKNGWKGKTCHSRDSQCDEATCNNGGTCYDEGDAFKCMCPGGWEGTTCNIARNSSCLPNPCHNGGTCVVNGESFTCVCKEGWEGPICAQNTNDCSPHPCYNSGTCVDGDNWYRCECAPGFAGPDCRININECQSSPCAFGATCVDEINGYRCVCPPGHSGAKCQEVSGRPCITMGSVIPDGAKWDDDCNTCQCLNGRIACSKVWCGPRPCLLHKGHSECPSGQSCIPILDDQCFVHPCTGVGECRSSSLQPVKTKCTSDSYYQDNCANITFTFNKEMMSPGLTTEHICSELRNLNILKNVSAEYSIYIACEPSPSANNEIHVAISAEDIRDDGNPIKEITDKIIDLVSKRDGNSSLIAAVAEVRVQRRPLKNRTDFLVPLLSSVLTVAWICCLVTAFYWCLRKRRKPGSHTHSASEDNTTNNVREQLNQIKNPIEKHGANTVPIKDYENKNSKMSKIRTHNSEVEEDDMDKHQQKARFAKQPAYTLVDREEKPPNGTPTKHPNWTNKQDNRDLESAQSLNRMEYIV

SEQ ID NO: 2171 - protein, 1238 aa, unidentified
MRAQGRGRLPRRLLLLLALWVQAARPMGYFELQLSALRNVNGELLSGACCDGDGRTTRAGGCGHDECDTYVRVCLKEYQAKVTPTGPCSYGHGATPVLGGNSFYLPPAGAAGDRARARARAGGDQDPGLVVIPFQFAWPRSFTLIVEAWDWDNDTTPNEELLIERVSHAGMINPEDRWKSLHFSGHVAHLELQIRVRCDENYYSATCNKFCRPRNDFFGHYTCDQYGNKACMDGWMGKECKEAVCKQGCNLLHGGCTVPGECRCSYGWQGRFCDECVPYPGCVHGSCVEPWQCNCETNWGGLLCDKDLNYCGSHHPCTNGGTCINAEPDQYRCTCPDGYSGRNCEKAEHACTSNPCANGGSCHEVPSGFECHCPSGWSGPTCALDIDECASNPCAAGGTCVDQVDGFECICPEQWVGATCQLDANECEGKPCLNAFSCKNLIGGYYCDCIPGWKGINCHINVNDCRGQCQHGGTCKDLVNGYQCVCPRGFGGRHCELERDECASSPCHSGGLCEDLADGFHCHCPQGFSGPLCEVDVDLCEPSPCRNGARCYNLEGDYYCACPDDFGGKNCSVPREPCPGGACRVIDGCGSDAGPGMPGTAASGVCGPHGRCVSQPGGNFSCICDSGFTGTYCHENIDDCLGQPCRNGGTCIDEVDAFRCFCPSGWEGELCDTNPNDCLPDPCHSRGRCYDLVNDFYCACDDGWKGKTCHSREFQCDAYTCSNGGTCYDSGDTFRCACPPGWKGSTCAVAKNSSCLPNPCVNGGTCVGSGASFSCICRDGWEGRTCTHNTNDCNPLPCYNGGICVDGVNWFRCECAPGFAGPDCRINIDECQSSPCAYGATCVDEINGYRCSCPPGRAGPRCQEVIGFGRSCWSRGTPFPHGSSWVEDCNSCRCLDGRRDCSKVWCGWKPCLLAGQPEALSAQCPLGQRCLEKAPGQCLRPPCEAWGECGAEEPPSTPCLPRSGHLDNNCARLTLHFNRDHVPQGTTVGAICSGIRSLPATRAVARDRLLVLLCDRASSGASAVEVAVSFSPARDLPDSSLIQGAAHAIVAAITQRGNSSLLLAVTEVKVETVVTGGSSTGLLVPVLCGAFSVLWLACVVLCVWWTRKRRKERERSRLPREESANNQWAPLNPIRNPIERPGGHKDVLYQCKNFTPPPRRADEALPGPAGHAAVREDEEDEDLGRGEEDSLEAEKFLSHKFTKDPGRSPGRPAHWASGPKVDNRAVRSINEARYAGKE

SEQ ID NO: 2172 - protein, 183 aa, unidentified
MASRAGPRAAGTDGSDFQHRERVAMHYQMSVTLKYEIKKLIYVHLVIWLLLVAKMSVGHLRLLSHDQVAMPYQWEYPYLLSILPSLLGLLSFPRNNISYLVLSMISMGLFSIAPLIYGSMEMFPAAQQLYRHGKAYRFLFGFSAVSIMYLVLVLAVQVHAWQLYYSKKLLDSWFTSTQEKKHK

SEQ ID NO: 2173 - protein, 626 aa, unidentified
MSKKGRSKGEKPEMETDAVQMANEELRAKLTSIQIEFQQEKSKVGKLRERLQEAKLEREQEQRRHTAYISELKAKLHEEKTKELQALREGLIRQHEQEAARTAKIKEGELQRLQATLNVLRDGAADKVKTALLTEAREEARRAFDGERLRLQQEILELKAARKQAEEALSNCMQADKTKAADLRAAYQAHQDEVHRIKRECERDIRRLMDEIKGKDRVILALEKELGVQAGQTQKLLLQKEALDEQLVQVKEAERHHSSPKRELPPGIGDMVELMGVQDQHMDERDVRRFQLKIAELNSVIRKLEDRNTLLADERNELLKRSRETEVQLKPLVEKNKRMNKKNEDLLQSIQRMEEKIKNLTRENVEMKEKLSAQASLKRHTSLNDLSLTRDEQEIEFLRLQVLEQQHVIDDLSLERERLLRSKRHRGKSLKPPKKHVVETFFGFDEESVDSETLSETSYNTDRTDRTPATPEEDLDDATAREEADLRFCQLTREYQALQRAYALLQEQVGGTLDAEREARTREQLQADLLRCQAKIEDLEKLLVEKGQDSKWVEEKQLLIRTNQDLLEKIYRLEMEENQLKNEMQDAKDQNELLEFRVLELEVRDSICCKLSNGADILFEPKLKFM

SEQ ID NO: 2174 - protein, 810 aa, unidentified
MSKKGRNKGEKPEALIVALQAANEDLRTKLTDIQIELHQEKSKVSKLEREKTQEAKRIRELEQRKHTVLVTELKAKLHEEKMKELQAVRENLIKQHEQEMSRTVKVRDGEIQRLKSALCALRDGSSDKVRTALTIEAREEARKLFDTERLKLLQEIADLKTAKKQVDEALSNMIQADKIKAGDLRSEHQSHQEAISKIKWESERDIRRLMDEIKAKDRIIFSLEKELETQTGYVQKLQLQKEALDEQLFLVKEAECNMSSPKREIPGRAGDGSEHCSSPDLRRNQKRIAELNATIRKLEDRNTLLGDERNELLKRVRETEKQCKPLLERNKCLAKRNDELMVSLQRMEEKLKAVTKENSEMREKITSHPPLKKLKSLNDLDQANEEQETEFLKLQVIEQQNIIDELTRDREKLIRRRKHRRSSKPIKRPVLDPFIGYDEDSMDSETSSMASFRTDRTPATPDDDLDESLAAEESELRFRQLTKEYQALQRAYALLQEQTGGIIDAEREAKAQEQLQAEVLRYKAKIEDLEATLAQKGQDSHWVEDKQLFIKRNQELLEKIEKQEAENHRLQQELQDARDQNELLEFRNLELEERERRSPPFNLQIHPFSDGVSALQIYCMKEGVKDVNIPDLIKQLDILGDNGNLRNEEQVAIIQASTVLSLAEKWIQQIEGAEAALHQKMMELESDMEQFCKIKGYLEEELDYRKQALDQAYMRIQELEATLYNALQQETVIKFGELLSEKQQEELRTAVEKLRRQMLRKSREYDCQILQERMELLQQAHQRIRDLEDKTDIQKRQIKDLEEKSNRKHG

SEQ ID NO: 2175 - protein, 844 aa, unidentified
MSKRGMSSRAKGDKAEALAALQAANEDLRAKLTDIQIELQQEKSKVSKVEREKNQELRQVREHEQHKTAVLLTELKTKLHEEKMKELQAVRETLLRQHEAELLRVIKIKDNENQRLQALLSALRDGGPEKVKTVLLSEAKEEAKKGFEVEKVKMQQEISELKGAKRQVEEALTLVIQADKIKAAEIRSVYHLHQEEITRIKKECEREIRRLMEEIKFKDRAVFVLERELGVQAGHAQRLQLQKEALDEQLSQVREADRHPGSPRRELPHAAGAGDASDHSGSPEQQLDEKDARRFQLKIAELSAIIRKLEDRNALLSEERNELLKRVREAESQYKPLLDKNKRLSRKNEDLSHALRRMENKLKFVTQENIEMRQRAGIIRRPSSLNDLDQSQDEREVDFLKLQIVEQQNLIDELSKTLETAGYVKSVLERDKLLRFRKQRKKMAKLPKPVVVETFFGYDEEASLESDGSSVSYQTDRTDQTPCTPDDDLEEGMAKEETELRFRQLTMEYQALQRAYALLQEQVGGTLDAEREVKTREQLQAEVQRAQARIEDLEKALAEQGQDMKWIEEKQALYRRNQELVEKIKQMETEEARLRHEVQDARDQNELLEFRILELEERERKSPAISFHHTPFVDGKSPLQVYCEAEGVTDIVVAELMKKLDILGDNANLTNEEQVVVIQARTVLTLAEKWLQQIEETEAALQRKMVDLESEKELFSKQKGYLDEELDYRKQALDQANKHILELEAMLYDALQQEAGAKVAELLSEEEREKLKVAVEQWKRQVMSELRERDAQILRERMELLQLAQQRIKELEERIEAQKRQIKELEEKFLFLFLFFSLAFILWS

SEQ ID NO: 2176 - protein, 298 aa, unidentified
MARRSRHRLLLLLLRYLVVALGYHKAYGFSAPKDQQVVTAVEYQEAILACKTPKKTVSSRLEWKKLGRSVSFVYYQQTLQGDFKNRAEMIDFNIRIKNVTRSDAGKYRCEVSAPSEQGQNLEEDTVTLEVLVAPAVPSCEVPSSALSGTVVELRCQDKEGNPAPEYTWFKDGIRLLENPRLGSQSTNSSYTMNTKTGTLQFNTVSKLDTGEYSCEARNSVGYRRCPGKRMQVDDLNISGIIAAVVVVALVISVCGLGVCYAQRKGYFSKETSFQKSNSSSKATTMSENDFKHTKSFII

SEQ ID NO: 2177 - protein, 310 aa, unidentified
MALRRPPRLRLCARLPDFFLLLLFRGCLIGAVNLKSSNRTPVVQEFESVELSCIITDSQTSDPRIEWKKIQDEQTTYVFFDNKIQGDLAGRAEILGKTSLKIWNVTRRDSALYRCEVVARNDRKEIDEIVIELTVQVKPVTPVCRVPKAVPVGKMATLHCQESEGHPRPHYSWYRNDVPLPTDSRANPRFRNSSFHLNSETGTLVFTAVHKDDSGQYYCIASNDAGSARCEEQEMEVYDLNIGGIIGGVLVVLAVLALITLGICCAYRRGYFINNKQDGESYKNPGKPDGVNYIRTDEEGDFRHKSSFVI

SEQ ID NO: 2178 - protein, 394 aa, unidentified
MFCPLKLILLPVLLDYSLGLNDLNVSPPELTVHVGDSALMGCVFQSTEDKCIFKIDWTLSPGEHAKDEYVLYYYSNLSVPIGRFQNRVHLMGDILCNDGSLLLQDVQEADQGTYICEIRLKGESQVFKKAVVLHVLPEEPKELMVHVGGLIQMGCVFQSTEVKHVTKVEWIFSGRRAKEEIVFRYYHKLRMSVEYSQSWGHFQNRVNLVGDIFRNDGSIMLQGVRESDGGNYTCSIHLGNLVFKKTIVLHVSPEEPRTLVTPAALRPLVLGGNQLVIIVGIVCATILLLPVLILIVKKTCGNKSSVNSTVLVKNTKKTNPEIKEKPCHFERCEGEKHIYSPIIVREVIEEEEPSEKSEATYMTMHPVWPSLRSDRNNSLEKKSGGGMPKTQQAF

SEQ ID NO: 2179 - protein, 319 aa, unidentified
MKGEIQQSLGAWVLLTCLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLFSHWLLHAYGIISISRVDKLEQDLPLLALVPTPALFYLFTAKFTEPSRILSEGANGH

SEQ ID NO: 2180 - protein, 661 aa, unidentified
MTGGRFDFDDGGTYCGGWEEGKAHGHGICTGPKGQGEYSGSWSHGFEVVGGYTWPSGNTYQGYWAQGKRHGLGVETKGKWMYRGEWSHGFKGRYGVRQSLCTPARYEGTWSNGLQDGYGVETYGDGGTYQGQWAGGMRHGYGVRQSVPYGMATVIRSPLRTSLASLRSEQSNGSVLHDAAAAADSPAGTRGGFVLNFHADAELAGKKKGGLFRRGSLLGSMKLRKSESKSSISSKRSSVRSDAAMSRISSSDANSTISFGDVDCDFCPVEDHVDATTTETYMGEWKNDKRNGFGVSERSNGMKYEGEWANNKRHGYGCTVFPDGSKEEGKYKNNILVRGIRKQLIPIRHTKTREKVDRAIEGAQRAAAMARTKVEIANSRTAHARAKADAADQAALAARQECDIARAVARELSPDFYQPGPDYVKQRFQEGVDAKENPEEKVPEKPPTPKESPHFYRKGTTPPRSPEASPKHSHSPASSPKPLKKQNPSSGARLNQDKRSVADEQVTAIVNKPLMSKAPTKEAGAVVPQSKYSGRHHIPNPSNGELHSQYHGYYVKLNAPQHPPVDVEDGDGSSQSSSALVHKPSANKWSPSKSVTKPVAKESKAEPKAKKSELAIPKNPASNDSCPALEKEANSGPNSIMIVLVMLLNIGLAILFVHFLT

SEQ ID NO: 2181 - protein, 696 aa, unidentified
MSGGRFDFDDGGAYCGGWEGGKAHGHGLCTGPKGQGEYSGSWNFGFEVAGVYTWPSGNTFEGYWSQGKRHGLGIETKGRWLYKGEWTHGFKGRYGIRQSSSSGAKYEGTWNNGLQDGYGTETYADGGTYQGQFTNGMRHGYGVRQSVPYGMAVVVRSPLRTSLSSLRSEHSNGTVAPDSPASPASDGPALPSPAIPRGGFALSLLANAEAAARAPKGGGLFQRGALLGKLRRAESRTSVGSQRSRVSFLKSDLSSGASDAASTASLGEAAEGADEAAPFEADIDATTTETYMGEWKNDKRSGFGVSERSSGLRYEGEWLDNLRHGYGCTTLPDGHREEGKYRHNVLVKDTKRRMLQLKSNKVRQKVEHSVEGAQRAAAIARQKAEIAASRTSHAKAKAEAAEQAALAANQESNIARTLARELAPDFYQPGPEYQKRRLLQEILENSESLLEPPDRGAGAAGLPQPPRESPQLHERETPRPEGGSPSPAGTPPQPKRPRPGVSKDGLLSPGAWNGEPSGEGSRSVTPSEGAGRRSPARPATERMAIEALQAPPAPSREPEVALYQGYHSYAVRTTPPEPPPFEDQPEPEVSGSESAPSSPATAPLQAPTLRGPEPARETPAKLEPKPIIPKAEPRAKARKTEARGLTKAGAKKKARKEAALAAEAEVEVEEVPNTILICMVILLNIGLAILFVHLLT

SEQ ID NO: 2182 - protein, 748 aa, unidentified
MSSGGRFNFDDGGSYCGGWEDGKAHGHGVCTGPKGQGEYTGSWSHGFEVLGVYTWPSGNTYQGTWAQGKRHGIGLESKGKWVYKGEWTHGFKGRYGVRECAGNGAKYEGTWSNGLQDGYGTETYSDGGTYQGQWVGGMRQGYGVRQSVPYGMAAVIRSPLRTSINSLRSEHTNGTALHPDASPAVAGSPAVSRGGFVLVAHSDSEILKSKKKGLFRRSLLSGLKLRKSESKSSLASQRSKQSSFRSEAGMSTVSSTASDIHSTISLGEAEAELAVIEDDIDATTTETYVGEWKNDKRSGFGVSQRSDGLKYEGEWASNRRHGYGCMTFPDGTKEEGKYKQNILVGGKRKNLIPLRASKIREKVDRAVEAAERAATIAKQKAEIAASRTSHSRAKAEAALTAAQKAQEEARIARITAKEFSPSFQHRENGLEYQRPKRQTSCDDIEVLSTGTPLQQESPELYRKGTTPSDLTPDDSPLQSFPTSPAATPPPAPAARNKVAHFSRQVSVDEERGGDIQMLLEGRAGDCARSSWGEEQAGGSRGVRSGALRGGLLVDDFRTRGSGRKQPGNPKPRERRTESPPVFTWTSHHRASNHSPGGSRLLELQEEKLSNYRMEMKPLLRMETHPQKRRYSKGGACRGLGDDHRPEDRGFGVQRLRSKAQNKENFRPASSAEPAVQKLASLRLGGAEPRLLRWDLTFSPPQKSLPVALESDEENGDELKSSTGSAPILVVMVILLNIGVAILFINFFI

SEQ ID NO: 2183 - protein, 628 aa, unidentified
MSPGGKFDFDDGGCYVGGWEAGRAHGYGVCTGPGAQGEYSGCWAHGFESLGVFTGPGGHSYQGHWQQGKREGLGVERKSRWTYRGEWLGGLKGRSGVWESVSGLRYAGLWKDGFQDGYGTETYSDGGTYQGQWQAGKRHGYGVRQSVPYHQAALLRSPRRTSLDSGHSDPPTPPPPLPLPGDEGGSPASGSRGGFVLAGPGDADGASSRKRTPAAGGFFRRSLLLSGLRAGGRRSSLGSKRGSLRSEVSSEVGSTGPPGSEASGPPAAAPPALIEGSATEVYAGEWRADRRSGFGVSQRSNGLRYEGEWLGNRRHGYGRTTRPDGSREEGKYKRNRLVHGGRVRSLLPLALRRGKVKEKVDRAVEGARRAVSAARQRQEIAAARAADALLKAVAASSVAEKAVEAARMAKLIAQDLQPMLEAPGRRPRQDSEGSDTEPLDEDSPGVYENGLTPSEGSPELPSSPASSRQPWRPPACRSPLPPGGDQGPFSSPKAWPEEWGGAGAQAEELAGYEAEDEAGMQGPGPRDGSPLLGGCSDSSGSLREEEGEDEEPLPPLRAPAGTEPEPIAMLVLRGSSSRGPDAGCLTEELGEPAATERPAQPGAANPLVVGAVALLDLSLAFLFSQLLT

SEQ ID NO: 2184 - protein, 146 aa, unidentified
MLAGAGRPGLPQGRHLCWLLCAFTLKLCQAEAPVQEEKLSASTSNLPCWLVEEFVVAEECSPCSNFRAKTTPECGPTGYVEKITCSSSKRNEFKSCRSALMEQRLFWKFEGAVVCVALIFACLVIIRQRQLDRKALEKVRKQIESI

SEQ ID NO: 2185 - protein, 2986 aa, unidentified
MTDRFWDQWYLWYLRLLRLLDRGSFRNDGLKASDVLPILKEKVAFVSGGRDKRGGPILTFPARSNHDRIRQEDLRKLVTYLASVPSEDVCKRGFTVIIDMRGSKWDLIKPLLKTLQEAFPAEIHVALIIKPDNFWQKQKTNFGSSKFIFETSMVSVEGLTKLVDPSQLTEEFDGSLDYNHEEWIELRLSLEEFFNSAVHLLSRLEDLQEMLARKEFPVDVEGSRRLIDEHTQLKKKVLKAPVEELDREGQRLLQCIRCSDGFSGRNCIPGSADFQSLVPKITSLLDKLHSTRQHLHQMWHVRKLKLDQCFQLRLFEQDAEKMFDWISHNKELFLQSHTEIGVSYQYALDLQTQHNHFAMNSMNAYVNINRIMSVASRLSEAGHYASQQIKQISTQLDQEWKSFAAALDERSTILAMSAVFHQKAEQFLSGVDAWCKMCSEGGLPSEMQDLELAIHHHQTLYEQVTQAYTEVSQDGKALLDVLQRPLSPGNSESLTATANYSKAVHQVLDVVHEVLHHQRRLESIWQHRKVRLHQRLQLCVFQQDVQQVLDWIENHGEAFLSKHTGVGKSLHRARALQKRHDDFEEVAQNTYTNADKLLEAAEQLAQTGECDPEEIYKAARHLEVRIQDFVRRVEQRKLLLDMSVSFHTHTKELWTWMEDLQKEMLEDVCADSVDAVQELIKQFQQQQTATLDATLNVIKEGEDLIQQLRSAPPSLGEPSEARDSAVSNNKTPHSSSISHIESVLQQLDDAQVQMEELFHERKIKLDIFLQLRIFEQYTIEVTAELDAWNEDLLRQMNDFNTEDLTLAEQRLQRHTERKLAMNNMTFEVIQQGQDLHQYITEVQASGIELICEKDIDLAAQVQELLEFLHEKQHELELNAEQTHKRLEQCLQLRHLQAEVKQVLGWIRNGESMLNASLVNASSLSEAEQLQREHEQFQLAIESLFHATSLQKTHQSALQVQQKAEVLLQAGHYDADAIRECAEKVALHWQQLMLKMEDRLKLVNASVAFYKTSEQVCSVLESLEQEYRRDEDWCGGRDKLGPAAEIDHVIPLISKHLEQKEAFLKACTLARRNAEVFLKYIHRNNVSMPSVASHTRGPEQQVKAILSELLQRENRVLHFWTLKKRRLDQCQQYVVFERSAKQALDWIQETGEFYLSTHTSTGETTEETQELLKEYGEFRVPAKQTKEKVKLLIQLADSFVEKGHIHATEIRKWVTTVDKHYRDFSLRMGKYRYSLEKALGVNTEDNKDLELDIIPASLSDREVKLRDANHEVNEEKRKSARKKEFIMAELLQTEKAYVRDLHECLETYLWEMTSGVEEIPPGILNKEHIIFGNIQEIYDFHNNIFLKELEKYEQLPEDVGHCFVTWADKFQMYVTYCKNKPDSNQLILEHAGTFFDEIQQRHGLANSISSYLIKPVQRITKYQLLLKELLTCCEEGKGELKDGLEVMLSVPKKANDAMHVSMLEGFDENLDVQGELILQDAFQVWDPKSLIRKGRERHLFLFEISLVFSKEIKDSSGHTKYVYKNKLLTSELGVTEHVEGDPCKFALWSGRTPSSDNKTVLKASNIETKQEWIKNIREVIQERIIHLKGALKEPLQLPKTPAKQRNNSKRDGVEDIDSQGDGSSQPDTISIASRTSQNTVDSDKLSGGCELTVVLQDFSAGHSSELTIQVGQTVELLERPSERPGWCLVRTTERSPPLEGLVPSSALCISHSRSSVEMDCFFPLVKDAYSHSSSENGGKSESVANLQAQPSLNSIHSSPGPKRSTNTLKKWLTSPVRRLNSGKADGNIKKQKKVRDGRKSFDLGSPKPGDETTPQGDSADEKSKKGWGEDEPDEESHTPLPPPMKIFDNDPTQDEMSSSLLAARQASTEVPTAADLVNAIEKLVKNKLSLEGSSYRGSLKDPAGCLNEGMAPPTPPKNPEEEQKAKALRGRMFVLNELVQTEKDYVKDLGIVVEGFMKRIEEKGVPEDMRGKDKIVFGNIHQIYDWHKDFFLAELEKCIQEQDRLAQLFIKHERKLHIYVWYCQNKPRSEYIVAEYDAYFEEVKQEINQRLTLSDFLIKPIQRITKYQLLLKDFLRYSEKAGLECSDIEKAVELMCLVPKRCNDMMNLGRLQGFEGTLTAQGKLLQQDTFYVIELDAGMQSRTKERRVFLFEQIVIFSELLRKGSLTPGYMFKRSIKMNYLVLEENVDNDPCKFALMNRETSERVVLQAANADIQQAWVQDINQVLETQRDFLNALQSPIEYQRKERSTAVMRSQPARLPQASPRPYSSVPAGSEKPPKGSSYNPPLPPLKISTSNGSPGFEYHQPGDKFEASKQNDLGGCNGTSSMAVIKDYYALKENEICVSQGEVVQVLAVNQQNMCLVYQPASDHSPAAEGWVPGSILAPLTKATAAESSDGSIKKSCSWHTLRMRKRAEVENTGKNEATGPRKPKDILGNKVSVKETNSSEESECDDLDPNTSMEILNPNFIQEVAPEFLVPLVDVTCLLGDTVILQCKVCGRPKPTITWKGPDQNILDTDNSSATYTVSSCDSGEITLKICNLMPQDSGIYTCIATNDHGTTSTSATVKVQGVPAAPNRPIAQERSCTSVILRWLPPSSTGNCTISGYTVEYREEGSQIWQQSVASTLDTYLVIEDLSPGCPYQFRVSASNPWGISLPSEPSEFVRLPEYDAAADGATISWKENFDSAYTELNEIGRGRFSIVKKCIHKATRKDVAVKFVSKKMKKKEQAAHEAALLQHLQHPQYITLHDTYESPTSYILILELMDDGRLLDYLMNHDELMEEKVAFYIRDIMEALQYLHNCRVAHLDIKPENLLIDLRIPVPRVKLIDLEDAVQISGHFHIHHLLGNPEFAAPEVIQGIPVSLGTDIWSIGVLTYVMLSGVSPFLDESKEETCINVCRVDFSFPHEYFCGVSNAARDFINVILQEDFRRRPTAATCLQHPWLQPHNGSYSKIPLDTSRLACFIERRKHQNDVRPIPNVKSYIVNRVNQGT

SEQ ID NO: 2186 - protein, 987 aa, unidentified
MTPALREATAKGISFSSLPSTMESDKMLYMESPRTVDEKLKGDTFSQMLGFPTPEPTLNTNFVNLKHFGSPQSSKHYQTVFLMRSNSTLNKHNENYKQKKLGEPSCNKLKNILYNGSNIQLSKICLSHSEEFIKKEPLSDTTSQCMKDVQIILDSNITKDTNVDKVQLQNCKWYQENALLDKVTDAEIKKGLLHCTQKKIVPGHSNVPVSSSAAEKEEEVHARLLHCVSKQKILLSQARRTQKHLQMLLAKHVVKHYGQQMKLSMKHQLPKMKTFHEPTTILGNSLPKCTEIKPEVNTLTAENKLWDDAKNGFARCTAAEIQRFAFSATGLLSHVEEGLDSDATDSSSDDDLDEYTLRKNVAVNCSTEWKWLVDRARVGSRWTWLQAQISDLECKIQQLTDIHRQIRASKGIVVLEECQLPKDILKKQMQFADQAASLNILGNPQVPQECQDPVPEQDFEMSPSSPTLLLRNIEKQSAQLTEIINSLIAPLNLSPTSSPLSSKSCSHKCLANGIYRSASENLDELSSSSSWLLNQKHSKKKRKDRTRLKSSSLTFMSTSARTRPLQSFHKRKLYRLSPTFYWTPQTLPSKETAFLNTTQMPCLQSASTWSSYEHNSESYLLREHVSELDSSFHSVLSLPSDVPLHFHFETLLKKTEIKGNLAENKFVDEYIISPSPVHSTLNQWRNGYSPICKPQIRSESSAQLLQGRKKRHLSETALGERTKLEESDFQHTESGSHSNFTAVSNVNVLSRIQNSSRNTARRRLRSESSYDIDNIVIPMSLVAPAKLEKLQYKEILTPSWRMVVLQPLDEYNLGKEEIEDLSDEVFSLRHKKYEEREQARWSLWEQSKWHRRNSRAYSKNVEGQDLLLKEYPNNFSSSQQCAAASPPGLPSENQDLCAYGLPSLNQSQETKSLWWERRAFPLKGEDMAALLCQDEKKDQVERSSTAFHGEIFGTSVPENGHHPKKQSDGMEEYKTFGLGLTNVKKNR

SEQ ID NO: 2187 - protein, 495 aa, unidentified
MTVMSGENVDEASAAPGHPQDGSYPRQADHDDHECCERVVINISGLRFETQLKTLAQFPNTLLGNPKKRMRYFDPLRNEYFFDRNRPSFDAILYYYQSGGRLRRPVNVPLDMFSEEIKFYELGEEAMEKFREDEGFIKEEERPLPEKEYQRQVWLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRELGLLIFFLFIGVILFSSAVYFAEAEEAESHFSSIPDAFWWAVVSMTTVGYGDMYPVTIGGKIVGSLCAIAGVLTIALPVPVIVSNFNYFYHRETEGEEQAQLLHVSSPNLASDSDLSRRSSSTMSKSEYMEIEEDMNNSIAHYRQVNIRTANCTTANQNCVNKSKLLTDV

SEQ ID NO: 2188 - protein, 511 aa, unidentified
MDVCGWKEMEVALVNFDNSDEIQEEPGYATDFDSTSPKGRPGGSSFSNGKILISESTNHETAFSKLPGDYADPPGPEPVVLNEGNQRVIINIAGLRFETQLRTLSQFPETLLGDREKRMQFFDSMRNEYFFDRNRPSFDGILYYYQSGGKIRRPANVPIDIFADEISFYELGSEAMDQFREDEGFIKDPETLLPTNDIHRQFWLLFEYPESSSAARAVAVVSVLVVVISITIFCLETLPEFREDRELKVVRDPNLNMSKTVLSQTMFTDPFFMVESTCIVWFTFELVLRFVVCPSKTDFFRNIMNIIDIISIIPYFATLITELVQETEPSAQQNMSLAILRIIRLVRVFRIFKLSRHSKGLQILGQTLKASMRELGLLIFFLFIGVILFSSAVYFAEVDEPESHFSSIPDGFWWAVVTMTTVGYGDMCPTTPGGKIVGTLCAIAGVLTIALPVPVIVSNFNYFYHRETENEEKQNIPGEIERILNSVGSRMGSTDSLNKTNGGCSTEKSRK

SEQ ID NO: 2189 - protein, 499 aa, unidentified
MTVATGDPADEAAALPGHPQDTYDPEADHECCERVVINISGLRFETQLKTLAQFPETLLGDPKKRMRYFDPLRNEYFFDRNRPSFDAILYYYQSGGRLRRPVNVPLDIFSEEIRFYELGEEAMEMFREDEGYIKEEERPLPENEFQRQVWLLFEYPESSGPARIIAIVSVMVILISIVSFCLETLPIFRDENEDMHGSGVTFHTYSNSTIGYQQSTSFTDPFFIVETLCIIWFSFEFLVRFFACPSKAGFFTNIMNIIDIVAIIPYFITLGTELAEKPEDAQQGQQAMSLAILRVIRLVRVFRIFKLSRHSKGLQILGQTLKASMRELGLLIFFLFIGVILFSSAVYFAEADERESQFPSIPDAFWWAVVSMTTVGYGDMVPTTIGGKIVGSLCAIAGVLTIALPVPVIVSNFNYFYHRETEGEEQAQYLQVTSCPKIPSSPDLKKSRSASTISKSDYMEIQEGVNNSNEDFREENLKTANCTLANTNYVNITKMLTDV

SEQ ID NO: 2190 - protein, 575 aa, unidentified
MDERLSLLRSPPPPSARHRAHPPQRPASSGGAHTLVNHGYAEPAAGRELPPDMTVVPGDHLLEPEVADGGGAPPQGGCGGGGCDRYEPLPPSLPAAGEQDCCGERVVINISGLRFETQLKTLCQFPETLLGDPKRRMRYFDPLRNEYFFDRNRPSFDAILYYYQSGGRIRRPVNVPIDIFSEEIRFYQLGEEAMEKFREDEGFLREEERPLPRRDFQRQVWLLFEYPESSGPARGIAIVSVLVILISIVIFCLETLPEFRDEKDYPASTSQDSFEAAGNSTSGSRAGASSFSDPFFVVETLCIIWFSFELLVRFFACPSKATFSRNIMNLIDIVAIIPYFITLGTELAERQGNGQQAMSLAILRVIRLVRVFRIFKLSRHSKGLQILGQTLKASMRELGLLIFFLFIGVILFSSAVYFAEADDPTSGFSSIPDAFWWAVVTMTTVGYGDMHPVTIGGKIVGSLCAIAGVLTIALPVPVIVSNFNYFYHRETEGEEQSQYMHVGSCQHLSSSAEELRKARSNSTLSKSEYMVIEEGGMNHSAFPQTPFKTGNSTATCTTNNNPNSCVNIKKIFTDV

SEQ ID NO: 2191 - protein, 653 aa, unidentified
MEVAMVSAESSGCNSHMPYGYAAQARARERERLAHSRAAAAAAVAAATAAVEGSGGSGGGSHHHHQSRGACTSHDPQSSRGSRRRRRQRSEKKKAHYRQSSFPHCSDLMPSGSEEKILRELSEEEEDEEEEEEEEEEGRFYYSEDDHGDECSYTDLLPQDEGGGGYSSVRYSDCCERVVINVSGLRFETQMKTLAQFPETLLGDPEKRTQYFDPLRNEYFFDRNRPSFDAILYYYQSGGRLKRPVNVPFDIFTEEVKFYQLGEEALLKFREDEGFVREEEDRALPENEFKKQIWLLFEYPESSSPARGIAIVSVLVILISIVIFCLETLPEFRDDRDLVMALSAGGHGGLLNDTSAPHLENSGHTIFNDPFFIVETVCIVWFSFEFVVRCFACPSQALFFKNIMNIIDIVSILPYFITLGTDLAQQQGGGNGQQQQAMSFAILRIIRLVRVFRIFKLSRHSKGLQILGHTLRASMRELGLLIFFLFIGVILFSSAVYFAEADEPTTHFQSIPDAFWWAVVTMTTVGYGDMKPITVGGKIVGSLCAIAGVLTIALPVPVIVSNFNYFYHRETENEEQTQLTQNAVSCPYLPSNLLKKFRSSTSSSLGDKSEYLEMEEGVKESLCAKEEKCQGKGDDSETDKNNCSNAKAVETDV

SEQ ID NO: 2192 - protein, 613 aa, unidentified
MEIALVPLENGGAMTVRGGDEARAGCGQATGGELQCPPTAGLSDGPKEPAPKGRGAQRDADSGVRPLPPLPDPGVRPLPPLPEELPRPRRPPPEDEEEEGDPGLGTVEDQALGTASLHHQRVHINISGLRFETQLGTLAQFPNTLLGDPAKRLRYFDPLRNEYFFDRNRPSFDGILYYYQSGGRLRRPVNVSLDVFADEIRFYQLGDEAMERFREDEGFIKEEEKPLPRNEFQRQVWLIFEYPESSGSARAIAIVSVLVILISIITFCLETLPEFRDERELLRHPPAPHQPPAPAPGANGSGVMAPPSGPTVAPLLPRTLADPFFIVETTCVIWFTFELLVRFFACPSKAGFSRNIMNIIDVVAIFPYFITLGTELAEQQPGGGGGGQNGQQAMSLAILRVIRLVRVFRIFKLSRHSKGLQILGKTLQASMRELGLLIFFLFIGVILFSSAVYFAEADNQGTHFSSIPDAFWWAVVTMTTVGYGDMRPITVGGKIVGSLCAIAGVLTIALPVPVIVSNFNYFYHRETDHEEPAVLKEEQGTQSQGPGLDRGVQRKVSGSRGSFCKAGGTLENADSARRGSCPLEKCNVKAKSNVDLRRSLYALCLDTSRETDL

SEQ ID NO: 2193 - protein, 529 aa, unidentified
MRSEKSLTLAAPGEVRGPEGEQQDAGDFPEAGGGGGCCSSERLVINISGLRFETQLRTLSLFPDTLLGDPGRRVRFFDPLRNEYFFDRNRPSFDAILYYYQSGGRLRRPVNVPLDIFLEEIRFYQLGDEALAAFREDEGCLPEGGEDEKPLPSQPFQRQVWLLFEYPESSGPARGIAIVSVLVILISIVIFCLETLPQFRVDGRGGNNGGVSRVSPVSRGSQEEEEDEDDSYTFHHGITPGEMGTGGSSSLSTLGGSFFTDPFFLVETLCIVWFTFELLVRFSACPSKPAFFRNIMNIIDLVAIFPYFITLGTELVQQQEQQPASGGGGQNGQQAMSLAILRVIRLVRVFRIFKLSRHSKGLQILGKTLQASMRELGLLIFFLFIGVILFSSAVYFAEADDDDSLFPSIPDAFWWAVVTMTTVGYGDMYPMTVGGKIVGSLCAIAGVLTIALPVPVIVSNFNYFYHRETEQEEQGQYTHVTCGQPAPDLRATDNGLGKPDFPEANRERRPSYLPTPHRAYAEKRMLTEV

SEQ ID NO: 2194 - protein, 456 aa, unidentified
MEPRCPPPCGCCERLVLNVAGLRFETRARTLGRFPDTLLGDPARRGRFYDDARREYFFDRHRPSFDAVLYYYQSGGRLRRPAHVPLDVFLEEVAFYGLGAAALARLREDEGCPVPPERPLPRRAFARQLWLLFEFPESSQAARVLAVVSVLVILVSIVVFCLETLPDFRDDRDGTGLAAAAAAGPFPAPLNGSSQMPGNPPRLPFNDPFFVVETLCICWFSFELLVRLLVCPSKAIFFKNVMNLIDFVAILPYFVALGTELARQRGVGQQAMSLAILRVIRLVRVFRIFKLSRHSKGLQILGQTLRASMRELGLLIFFLFIGVVLFSSAVYFAEVDRVDSHFTSIPESFWWAVVTMTTVGYGDMAPVTVGGKIVGSLCAIAGVLTISLPVPVIVSNFSYFYHRETEGEEAGMFSHVDMQPCGPLEGKANGGLVDGEVPELPPPLWAPPGKHLVTEV

SEQ ID NO: 2195 - protein, 858 aa, unidentified [sequence omitted]

SEQ ID NO: 2196 - protein, 911 aa, unidentified
MAEKAPPGLNRKTSRSTLSLPPEPVDIIRSKTCSRRVKINVGGLNHEVLWRTLDRLPRTRLGKLRDCNTHESLLEVCDDYNLNENEYFFDRHPGAFTSILNFYRTGKLHMMEEMCALSFGQELDYWGIDEIYLESCCQARYHQKKEQMNEELRREAETMREREGEEFDNTCCPDKRKKLWDLLEKPNSSVAAKILAIVSILFIVLSTIALSLNTLPELQETDEFGQLNDNRQLAHVEAVCIAWFTMEYLLRFLSSPNKWKFFKGPLNVIDLLAILPYYVTIFLTESNKSVLQFQNVRRVVQIFRIMRILRILKLARHSTGLQSLGFTLRRSYNELGLLILFLAMGIMIFSSLVFFAEKDEDATKFTSIPASFWWATITMTTVGYGDIYPKTLLGKIVGGLCCIAGVLVIALPIPIIVNNFSEFYKEQKRQEKAIKRREALERAKRNGSIVSMNLKDAFARSMELIDVAVEKAGESANTKDSADDNHLSPSRWKWARKALSETSSNKSFENKYQEVSQKDSHEQLNNTSSSSPQHLSAQKLEMLYNEITKTQPHSHPNPDCQEKPERPSAYEEEIEMEEVVCPQEQLAVAQTEVIVDMKSTSSIDSFTSCATDFTETERSPLPPPSASHLQMKFPTDLPGTEEHQRARGPPFLTLSREKGPAARDGTLEYAPVDITVNLDASGSQCGLHSPLQSDNATDSPKSSLKGSNPLKSRSLKVNFKENRGSAPQTPPSTARPLPVTTADFSLTTPQHISTILLEETPSQGDRPLLGTEVSAPCQGPSKGLSPRFPKQKLFPFSSRERRSFTEIDTGDDEDFLELPGAREEKQVDSSPNCFADKPSDGRDPLREEGSVGSSSPQDTGHNCRQDIYHAVSEVKKDSSQEGCKMENHLFAPEIHSNPGDTGYCPTRETSM

SEQ ID NO: 2197 - protein, 638 aa, unidentified
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKGYEKSRSLNNIAGLAGNALRLSPVTSPYNSPCPLRRSRSPIPSIL

SEQ ID NO: 2198 - protein, 757 aa, unidentified
MLSSVCVSSFRGRQGASKQQPAPPPQPPESPPPPPLPPQQQQPAQPGPAASPAGPPAPRGPGDRRAEPCPGLPAAAMGRHGGGGGDSGKIVINVGGVRHETYRSTLRTLPGTRLAGLTEPEAAARFDYDPGADEFFFDRHPGVFAYVLNYYRTGKLHCPADVCGPLFEEELGFWGIDETDVEACCWMTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKATGAPPLPPQDWRKPGPPSFLPDLNANAAAWISP

SEQ ID NO: 2199 - protein, 635 aa, unidentified
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAACFLLSTGDYACADGSVRKGTFVLRDLPLQHSPEAACPPTAGTLFLPH

SEQ ID NO: 2200 - protein, 630 aa, unidentified
MAAGVAAWLPFARAAAIGWMPVASGPMPAPPRQERKRTQDALIVLNVSGTRFQTWQDTLERYPDTLLGSSERDFFYHPETQQYFFDRDPDIFRHILNFYRTGKLHYPRHECISAYDEELAFFGLIPEIIGDCCYEEYKDRRRENAERLQDDADTDTAGESALPTMTARQRVWRAFENPHTSTMALVFYYVTGFFIAVSVIANVVETVPCGSSPGHIKELPCGERYAVAFFCLDTACVMIFTVEYLLRLAAAPSRYRFVRSVMSIIDVVAILPYYIGLVMTDNEDVSGAFVTLRVFRVFRIFKFSRHSQGLRILGYTLKSCASELGFLLFSLTMAIIIFATVMFYAEKGSSASKFTSIPAAFWYTIVTMTTLGYGDMVPKTIAGKIFGSICSLSGVLVIALPVPVIVSNFSRIYHQNQRADKRRAQKKARLARIRAAKSGSANAYMQSKRNGLLSNQLQSSEDEQAFVSKSGSSFETQHHHLLHCLEKTTNHEFVDEQVFEESCMEVATVNRPSSHSPSLSSQQGVTSTCCSRRHKKTFRIPNANVSGSHQGSIQELSTIQIRCVERTPLSNSRSSLNAKMEECVKLNCEQPYVTTAIISIPTPPVTTPEGDDRPESPEYSGGNIVRVSAL

SEQ ID NO: 2201 - protein, 655 aa, unidentified
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTGLSYLVDDPLLSVRTSTIKNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSAL

SEQ ID NO: 2202 - protein, 129 aa, unidentified
MILSNTTAVTPFLTKLWQETVQQGGNMSGLARRSPRSSDGKLEALYVLMVLGFFGFFTLGIMLSYIRSKKLEHSNDPFNVYIESDAWQEKDKAYVQARVLESYRSCYVVENHLAIEQPNTHLPETKPSP

SEQ ID NO: 2203 - protein, 123 aa, unidentified
MSTLSNFTQTLEDVFRRIFITYMDNWRQNTTAEQEALQAKVDAENFYYVILYLMVMIGMFSFIIVAILVSTVKSKRREHSNDPYHQYIVEDWQEKYKSQILNLEESKATIHENIGAAGFKMSP

SEQ ID NO: 2204 - protein, 103 aa, unidentified
METTNGTETWYESLHAVLKALNATLHSNLLCRPGPGLGPDNQTEERRASLPGRDDNSYMYILFVMFLFAVTVGSLILGYTRSRKVDKRSDPYHVYIKNRVSMI

SEQ ID NO: 2205 - protein, 142 aa, unidentified
MNCSESQRLRTLLSRLLLELHHRGNASGLGAGPRPSMGMGVVPDPFVGREVTSAKGDDAYLYILLIMIFYACLAGGLILAYTRSRKLVEAKDEPSQACAEHEWAPGGALTADAEAAAGSQAEGRRQLASEGLPALAQGAERV

SEQ ID NO: 2206 - protein, 494 aa, unidentified
MDGSGERSLPEPGSQSSAASDDIEIVVNVGGVRQVLYGDLLSQYPETRLAELINCLAGGYDTIFSLCDDYDPGKREFYFDRDPDAFKCVIEVYYFGEVHMKKGICPICFKNEMDFWKVDLKFLDDCCKSHLSEKREELEEIARRVQLILDDLGVDAAEGRWRRCQKCVWKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKELGLLLMYLAVGIFVFSALGYTMEQSHPETLFKSIPQSFWWAIITMTTVGYGDIYPKTTLGKLNAAISFLCGVIAIALPIHPIINNFVRYYNKQRVLETAAKHELELMELNSSSGGEGKTGGSRSDLDNLPPEPAGKEAPSCSSRLKLSHSDTFIPLLTEEKHHRTRLQSCK

SEQ ID NO: 2207 - protein, 513 aa, unidentified
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQGHCSQMCHNVFIVESVCVGWFSLEFLLRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSIFHTFSRSYLELKQEQERVMFRRAQFLIKTKSQLSVSQDSDILFGSASSDTRDNN

SEQ ID NO: 2208 - protein, 466 aa, unidentified
MEPWPCSPGGGGGTRARHVIINVGGCRVRLAWAALARCPLARLERLRACRGHDDLLRVCDDYDVSRDEFFFDRSPCAFRAIVALLRAGKLRLLRGPCALAFRDELAYWGIDEARLERCCLRRLRRREEEAAEARAGPTERGAQGSPARALGPRGRLQRGRRRLRDVVDNPHSGLAGKLFACVSVSFVAVTAVGLCLSTMPDIRAEEERGECSPKCRSLFVLETVCVAWFSFEFLLRSLQAESKCAFLRAPLNIIDILALLPFYVSLLLGLAAGPGGTKLLERAGLVLRLLRALRVLYVMRLARHSLGLRSLGLTMRRCAREFGLLLLFLCVAMALFAPLVHLAERELGARRDFSSVPASYWWAVISMTTVGYGDMVPRSLPGQVVALSSILSGILLMAFPVTSIFHTFSRSYSELKEQQQRAASPEPALQEDSTHSATATEDSSQGPDSAGLADDSADALWVRAGR

SEQ ID NO: 2209 - protein, 436 aa, unidentified
MTFGRSGAASVVLNVGGARYSLSRELLKDFPLRRVSRLHGCRSERDVLEVCDDYDRERNEYFFDRHSEAFGFILLYVRGHGKLRFAPRMCELSFYNEMIYWGLEGAHLEYCCQRRLDDRMSDTYTFYSADEPGVLGRDEARPGGAEAAPSRRWLERMRRTFEEPTSSLAAQILASVSVVFVIVSMVVLCASTLPDWRNAAADNRSLDDRSRYSAGPGREPSGIIEAICIGWFTAECIVRFIVSKNKCEFVKRPLNIIDLLAITPYYISVLMTVFTGENSQLQRAGVTLRVLRMMRIFWVIKLARHFIGLQTLGLTLKRCYREMVMLLVFICVAMAIFSALSQLLEHGLDLETSNKDFTSIPAACWWVIISMTTVGYGDMYPITVPGRILGGVCVVSGIVLLALPITFIYHSFVQCYHELKFRSARYSRSLSTEFLN

SEQ ID NO: 2210 - protein, 519 aa, unidentified
MPMPSRDGGLHPRHHHYGSHSPWSQLLSSPMETPSIKGLYYRRVRKVGALDASPVDLKKEILINVGGRRYLLPWSTLDRFPLSRLSKLRLCRSYEEIVQLCDDYDEDSQEFFFDRSPSAFGVIVSFLAAGKLVLLQEMCALSFQEELAYWGIEEAHLERCCLRKLLRKLEELEELAKLHREDVLRQQRETRRPASHSSRWGLCMNRLREMVENPQSGLPGKVFACLSILFVATTAVSLCVSTMPDLRAEEDQGECSRKCYYIFIVETICVAWFSLEFCLRFVQAQDKCQFFQGPLNIIDILAISPYYVSLAVSEEPPEDGERPSGSSYLEKVGLVLRVLRALRILYVMRLARHSLGLQTLGLTVRRCTREFGLLLLFLAVAITLFSPLVYVAEKESGRVLEFTSIPASYWWAIISMTTVGYGDMVPRSVPGQMVALSSILSGILIMAFPATSIFHTFSHSYLELKKEQEQLQARLRHLQNTGPASECELLDPHVASEHELMNDVNDLILEGPALPIMHM

SEQ ID NO: 2211 - protein, 989 aa, unidentified
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEVSAFMGDPGKIGFADQIPPPLEGRESQGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 2212 - protein, 1159 aa, unidentified
MPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 2213 - protein, 1083 aa, unidentified
MPAMRGLLAPQNTFLDTIATRFDGTHSNFVLGNAQVAGLFPVVYCSDGFCDLTGFSRAEVMQRGCACSFLYGPDTSELVRQQIRKALDEHKEFKAELILYRKSGLPFWCLLDVIPIKNEKGEVALFLVSHKDISETKNRGGPDRWKETGGGRRRYGRARSKGFNANRRRSRAVLYHLSGHLQKQPKGKHKLNKGVFGEKPNLPEYKVAAIRKSPFILLHCGALRATWDGFILLATLYVAVTVPYSVCVSTAREPSAARGPPSVCDLAVEVLFILDIVLNFRTTFVSKSGQVVFAPKSICLHYVTTWFLLDVIAALPFDLLHAFKVNVYFGAHLLKTVRLLRLLRLLPRLDRYSQYSAVVLTLLMAVFALLAHWVACVWFYIGQREIESSESELPEIGWLQELARRLETPYYLVGRRPAGGNSSGQSDNCSSSSEANGTGLELLGGPSLRSAYITSLYFALSSLTSVGFGNVSANTDTEKIFSICTMLIGALMHAVVFGNVTAIIQRMYARRFLYHSRTRDLRDYIRIHRIPKPLKQRMLEYFQATWAVNNGIDTTELLQSLPDELRADIAMHLHKEVLQLPLFEAASRGCLRALSLALRPAFCTPGEYLIHQGDALQALYFVCSGSMEVLKGGTVLAILGKGDLIGCELPRREQVVKANADVKGLTYCVLQCLQLAGLHDSLALYPEFAPRFSRGLRGELSYNLGAGGGSAEVDTSSLSGDNTLMSTLEEKETDGEQGPTVSPAPADEPSSPLLSPGCTSSSSAAKLLSPRRTAPRPRLGGRGRPGRAGALKAEAGPSAPPRALEGLRLPPMPWNVPPDLSPRVVDGIEDGCGSDQPKFSFRVGQSGPECSSSPSPGPESGLLTVPHGPSEARNTDTLDKLRQAVTELSEQVLQMREGLQSLRQAVQLVLAPHREGPCPRASGEGPCPASTSGLLQPLCVDTGASSYCLQPPAGSVLSGTWPHPRPGPPPLMAPWPWGPPASQSSPWPRATAFWTSTSDSEPPASGDLCSEPSTPASPPPSEEGARTGPAEPVSQAEATSTGEPPPGSGGLALPWDPHSLEMVLIGCHGSGTVQWTQEEGTGV

SEQ ID NO: 2214 - protein, 1017 aa, unidentified
MPVMKGLLAPQNTFLDTIATRFDGTHSNFLLANAQGTRGFPIVYCSDGFCELTGYGRTEVMQKTCSCRFLYGPETSEPALQRLHKALEGHQEHRAEICFYRKDGSAFWCLLDMMPIKNEMGEVVLFLFSFKDITQSGSPGLGPQGGRGDSNHENSLGRRGATWKFRSARRRSRTVLHRLTGHFGRRGQGGMKANNNVFEPKPSVPEYKVASVGGSRCLLLHYSVSKAIWDGLILLATFYVAVTVPYNVCFSGDDDTPITSRHTLVSDIAVEMLFILDIILNFRTTYVSQSGQVISAPRSIGLHYLATWFFIDLIAALPFDLLYIFNITVTSLVHLLKTVRLLRLLRLLQKLERYSQCSAVVLTLLMSVFALLAHWMACIWYVIGRREMEANDPLLWDIGWLHELGKRLEVPYVNGSVGGPSRRSAYIAALYFTLSSLTSVGFGNVCANTDAEKIFSICTMLIGALMHAVVFGNVTAIIQRMYSRRSLYHSRMKDLKDFIRVHRLPRPLKQRMLEYFQTTWAVNSGIDANELLRDFPDELRADIAMHLNREILQLPLFGAASRGCLRALSLHIKTSFCAPGEYLLRRGDALQAHYYVCSGSLEVLRDNMVLAILGKGDLIGADIPEPGQEPGLGADPNFVLKTSADVKALTYCGLQQLSSRGLAEVLRLYPEYGAAFRAGLPRDLTFNLRQGSDTSGLSRFSRSPRLSQPRSESLGSSSDKTLPSITEAESGAEPGGGPRPRRPLLLPNLSPARPRGSLVSLLGEELPPFSALVSSPSLSPSLSPALAGQGHSASPHGPPRCSAAWKPPQLLIPPLGTFGPPDLSPRIVDGIEDSGSTAEAPSFRFSRRPELPRPRSQAPPTGTRPSPELASEAEEVKEKVCRLNQEISRLNQEVSQLSRELRHIMGLLQARLGPPGHPAGSAWTPDPPCPQLRPPCLSPCASRPPPSLQDTTLAEVHCPASVGTMETGTALLDLRPSILPPYPSEPDPLGPSPVPEASPPTPSLLRHSFQSRSDTFH

SEQ ID NO: 2215 - protein, 988 aa, unidentified
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRIIFRKISDVKKEEEERLRQKNEVTLSIPVDHPVRKLFQKFKQQKELRNQGSTQGDPERNQLQVESRSLQNGASITGTSVVTVSQITPIQTSLAYVKTSESLKQNNRDAMELKPNGGADQKCLKVNSPIRMKNGNGKGWLRLKNNMGAHEEKKEDWNNVTKAESMGLLSEDPKSSDSENSVTKNPLRKTDSCDSGITKSDLRLDKAGEARSPLEHSPIQADAKHPFYPIPEQALQTTLQEVKHELKEDIQLLSCRMTALEKQVAEILKILSEKSVPQASSPKSQMPLQVPPQIPCQDIFSVSRPESPESDKDEIHF

SEQ ID NO: 2216 - protein, 994 aa, unidentified
MPVRRGHVAPQNTYLDTIIRKFEGQSRKFLIANAQMENCAIIYCNDGFCELFGYSRVEVMQQPCTCDFLTGPNTPSSAVSRLAQALLGAEECKVDILYYRKDASSFRCLVDVVPVKNEDGAVIMFILNFEDLAQLLAKCSSRSLSQRLLSQSFLGSEGSHGRPGGPGPGTGRGKYRTISQIPQFTLNFVEFNLEKHRSSSTTEIEIIAPHKVVERTQNVTEKVTQVLSLGADVLPEYKLQAPRIHRWTILHYSPFKAVWDWLILLLVIYTAVFTPYSAAFLLSDQDESRRGACSYTCSPLTVVDLIVDIMFVVDIVINFRTTYVNTNDEVVSHPRRIAVHYFKGWFLIDMVAAIPFDLLIFRTGSDETTTLIGLLKTARLLRLVRVARKLDRYSEYGAAVLFLLMCTFALIAHWLACIWYAIGNVERPYLEHKIGWLDSLGVQLGKRYNGSDPASGPSVQDKYVTALYFTFSSLTSVGFGNVSPNTNSEKVFSICVMLIGSLMYASIFGNVSAIIQRLYSGTARYHTQMLRVKEFIRFHQIPNPLRQRLEEYFQHAWSYTNGIDMNAVLKGFPECLQADICLHLHRALLQHCPAFSGAGKGCLRALAVKFKTTHAPPGDTLVHLGDVLSTLYFISRGSIEILRDDVVVAILGKNDIFGEPVSLHAQPGKSSADVRALTYCDLHKIQRADLLEVLDMYPAFAESFWSKLEVTFNLRDAAGGLHSSPRQAPGSQDHQGFFLSDNQSGSPHELGPQFPSKGYSLLGPGSQNSMGAGPCAPGHPDAAPPLSISDASGLWPELLQEMPPRHSPQSPQEDPDCWPLKLGSRLEQLQAQMNRLESRVSSDLSRILQLLQKPMPQGHASYILEAPASNDLALVPIASETTSPGPRLPQGFLPPAQTPSYGDLDDCSPKHRNSSPRMPHLAVATDKTLAPSSEQEQPEGLWPPLASPLHPLEVQGLICGPCFSSLPEHLGSVPKQLDFQRHGSDPGFAGSWGH

SEQ ID NO: 2217 - protein, 1196 aa, unidentified
MPVRRGHVAPQNTFLGTIIRKFEGQNKKFIIANARVQNCAIIYCNDGFCEMTGFSRPDVMQKPCTCDFLHGPETKRHDIAQIAQALLGSEERKVEVTYYHKNGSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEDNGRNVKGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVLKGFPECLQADICLHLNQTLLQNCKAFRGASKGCLRALAMKFKTTHAPPGDTLVHCGDVLTALYFLSRGSIEILKDDIVVAILGKNDIFGEMVHLYAKPGKSNADVRALTYCDLHKIQREDLLEVLDMYPEFSDHFLTNLELTFNLRHESAKADLLRSQSMNDSEGDNCKLRRRKLSFESEGEKENSTNDPEDSADTIRHYQSSKRHFEEKKSRSSSFISSIDDEQKPLFSGIVDSSPGIGKASGLDFEETVPTSGRMHIDKRSHSCKDITDMRSWERENAHPQPEDSSPSALQRAAWGISETESDLTYGEVEQRLDLLQEQLNRLESQMTTDIQTILQLLQKQTTVVPPAYSMVTAGSEYQRPIIQLMRTSQPEASIKTDRSFSPSSQCPEFLDLEKSKLKSKESLSSGVHLNTASEDNLTSLLKQDSDLSLELHLRQRKTYVHPIRHPSLPDSSLSTVGIVGLHRHVSDPGLPGK

SEQ ID NO: 2218 - protein, 1107 aa, unidentified
MPVMKGLLAPQNTFLDTIATRFDGTHSNFILANAQVAKGFPIVYCSDGFCELAGFARTEVMQKSCSCKFLFGVETNEQLMLQIEKSLEEKTEFKGEIMFYKKNGSPFWCLLDIVPIKNEKGDVVLFLASFKDITDTKVKITPEDKKEDKVKGRSRAGTHFDSARRRSRAVLYHISGHLQRREKNKLKINNNVFVDKPAFPEYKVSDAKKSKFILLHFSTFKAGWDWLILLATFYVAVTVPYNVCFIGNDDLSTTRSTTVSDIAVEILFIIDIILNFRTTYVSKSGQVIFEARSICIHYVTTWFIIDLIAALPFDLLYAFNVTVVSLVHLLKTVRLLRLLRLLQKLDRYSQHSTIVLTLLMSMFALLAHWMACIWYVIGKMEREDNSLLKWEVGWLHELGKRLESPYYGNNTLGGPSIRSAYIAALYFTLSSLTSVGFGNVSANTDAEKIFSICTMLIGALMHALVFGNVTAIIQRMYSRWSLYHTRTKDLKDFIRVHHLPQQLKQRMLEYFQTTWSVNNGIDSNELLKDFPDELRSDITMHLNKEILQLSLFECASRGCLRSLSLHIKTSFCAPGEYLLRQGDALQAIYFVCSGSMEVLKDSMVLAILGKGDLIGANLSIKDQVIKTNADVKALTYCDLQCIILKGLFEVLDLYPEYAHKFVEDIQHDLTYNLREGHESDVISRLSNKSMVSQSEPKGNGNINKRLPSIVEDEEEEEEGEEEEAVSLSPICTRGSSSRNKKVGSNKAYLGLSLKQLASGTVPFHSPIRVSRSNSPKTKQEIDPPNHNKRKEKNLKLQLSTLNNAGPPDLSPRIVDGIEDGNSSEESQTFDFGSERIRSEPRISPPLGDPEIGAAVLFIKAEETKQQINKLNSEVTTLTQEVSQLGKDMRNVIQLLENVLSPQQPSRFCSLHSTSVCPSRESLQTRTSWSAHQPCLHLQTGGAAYTQAQLCSSNITSDIWSVDPSSVGSSPQRTGAHEQNPADSELYHSPSLDYSPSHYQVVQEGHLQFLRCISPHSDSTLTPLQSISATLSSSVCSSSETSLHLVLPSRSEEGSFSQGTVSSFSLENLPGSWNQEGMASASTKPLENLPLEVVTSTAEVKDNKAINV

SEQ ID NO: 2219 - protein, 250 aa, unidentified
MNVRRVESISAQLEEASSTGGFLYAQNSTKRSIKERLMKLLPCSAAKTSSPAIQNSVEDELEMATVRHRPEALELLEAQSKFTKKELQILYRGFKNECPSGVVNEETFKEIYSQFFPQGDSTTYAHFLFNAFDTDHNGAVSFEDFIKGLSILLRGTVQEKLNWAFNLYDINKDGYITKEEMLDIMKAIYDMMGKCTYPVLKEDAPRQHVETFFQKMDKNKDGVVTIDEFIESCQKDENIMRSMQLFENVI

SEQ ID NO: 2220 - protein, 391 aa, unidentified
MNASSRNVFDTLIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 2221 - protein, 379 aa, unidentified
MTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQVNVTFQVDTASDSPFLILPLTFYHVVDETSPLKDLPLRSGEGDFELVLILSGTVESTSATCQVRTSYLPEEILWGYEFTPAISLSASGKYIADFSLFDQVVKVASPSGLRDSTVRYGDPEKLKLEESLREQAEKEGSALSVRISNV

SEQ ID NO: 2222 - protein, 390 aa, unidentified
MLSRKGIIPEEYVLTRLAEDPAEPRYRARQRRARFVSKKGNCNVAHKNIREQGRFLQDVFTTLVDLKWPHTLLIFTMSFLCSWLLFAMAWWLIAFAHGDLAPSEGTAEPCVTSIHSFSSAFLFSIEVQVTIGFGGRMVTEECPLAILILIVQNIVGLMINAIMLGCIFMKTAQAHRRAETLIFSKHAVIALRHGRLCFMLRVGDLRKSMIISATIHMQVVRKTTSPEGEVVPLHQVDIPMENGVGGNSIFLVAPLIIYHVIDANSPLYDLAPSDLHHHQDLEIIVILEGVVETTGITTQARTSYLADEILWGQRFVPIVAEEDGRYSVDYSKFGNTIKVPTPLCTARQLDEDHSLLEALTLASARGPLRKRSVPMAKAKPKFSISPDSLS

SEQ ID NO: 2223 - protein, 433 aa, unidentified
MTAASRANPYSIVSSEEDGLHLVTMSGANGFGNGKVHTRRRCRNRFVKKNGQCNIEFANMDEKSQRYLADMFTTCVDIRWRYMLLIFSLAFLASWLLFGIIFWVIAVAHGDLEPAEGRGRTPCVMQVHGFMAAFLFSIETQTTIGYGLRCVTEECPVAVFMVVAQSIVGCIIDSFMIGAIMAKMARPKKRAQTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRESEI

SEQ ID NO: 2224 - protein, 360 aa, unidentified
MDSSNCKVIAPLLSQRYRRMVTKDGHSTLQMDGAQRGLAYLRDAWGILMDMRWRWMMLVFSASFVVHWLVFAVLWYVLAEMNGDLELDHDAPPENHTICVKYITSFTAAFSFSLETQLTIGYGTMFPSGDCPSAIALLAIQMLLGLMLEAFITGAFVAKIARPKNRAFSIRFTDTAVVAHMDGKPNLIFQVANTRPSPLTSVRVSAVLYQERENGKLYQTSVDFHLDGISSDECPFFIFPLTYYHSITPSSPLATLLQHENPSHFELVVFLSAMQEGTGEICQRRTSYLPSEIMLHHCFASLLTRGSKGEYQIKMENFDKTVPEFPTPLVSKSPNRTDLDIHINGQSIDNFQISETGLTE

SEQ ID NO: 2225 - protein, 436 aa, unidentified
MGLARALRRLSGALDSGDSRAGDEEEAGPGLCRNGWAPAPVQSPVGRRRGRFVKKDGHCNVRFVNLGGQGARYLSDLFTTCVDVRWRWMCLLFSCSFLASWLLFGLAFWLIASLHGDLAAPPPPAPCFSHVASFLAAFLFALETQTSIGYGVRSVTEECPAAVAAVVLQCIAGCVLDAFVVGAVMAKMAKPKKRNETLVFSENAVVALRDHRLCLMWRVGNLRRSHLVEAHVRAQLLQPRVTPEGEYIPLDHQDVDVGFDGGTDRIFLVSPITIVHEIDSASPLYELGRAELARADFELVVILEGMVEATAMTTQCRSSYLPGELLWGHRFEPVLFQRGSQYEVDYRHFHRTYEVPGTPVCSAKELDERAEQASHSLKSSFPGSLTAFCYENELALSCCQEEDEDDETEEGNGVETEDGAASPRVLTPTLALTLPP

SEQ ID NO: 2226 - protein, 375 aa, unidentified
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLIEIFITGTFLAKIARPKKRAETIKFSHCAVITKQNGKLCLVIQVANMRKSLLIQCQLSGKLLQTHVTKEGERILLNQATVKFHVDSSSESPFLILPMTFYHVLDETSPLRDLTPQNLKEKEFELVVLLNATVESTSAVCQSRTSYIPEEIYWGFEFVPVVSLSKNGKYVADFSQFEQIRKSPDCTFYCADSEKQQLEEKYRQEDQRERELRTLLLQQSNV

SEQ ID NO: 2227 - protein, 453 aa, unidentified
MLKMVLTENPNQEIATSLEFLLLQNSPGSLRAQQRMSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 2228 - protein, 427 aa, unidentified
MGSVRTNRYSIVSSEEDGMKLATMAVANGFGNGKSKVHTRQQCRSRFVKKDGHCNVQFINVGEKGQRYLADIFTTCVDIRWRWMLVIFCLAFVLSWLFFGCVFWLIALLHGDLDASKEGKACVSEVNSFTAAFLFSIETQTTIGYGFRCVTDECPIAVFMVVFQSIVGCIIDAFIIGAVMAKMAKPKKRNETLVFSHNAVIAMRDGKLCLMWRVGNLRKSHLVEAHVRAQLLKSRITSEGEYIPLDQIDINVGFDSGIDRIFLVSPITIVHEIDEDSPLYDLSKQDIDNADFEIVVILEGMVEATAMTTQCRSSYLANEILWGHRYEPVLFEEKHYYKVDYSRFHKTYEVPNTPLCSARDLAEKKYILSNANSFCYENEVALTSKEEDDSENGVPESTSTDTPPDIDLHNQASVPLEPRPLRRESEI

SEQ ID NO: 2229 - protein, 501 aa, unidentified
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGKLTLMFRVGNLRNSHMVSAQIRCKLLKSRQTPEGEFLPLDQLELDVGFSTGADQLFLVSPLTICHVIDAKSPFYDLSQRSMQTEQFEIVVILEGIVETTGMTCQARTSYTEDEVLWGHRFFPVISLEEGFFKVDYSQFHATFEVPTPPYSVKEQEEMLLMSSPLIAPAITNSKERHNSVECLDGLDDITTKLPSKLQKITGREDFPKKLLRMSSTTSEKAYSLGDLPMKLQRISSVPGNSEEKLVSKTTKMLSDPMSQSVADLPPKLQKMAGGAARMEGNLPAKLRKMNSDRFT

SEQ ID NO: 2230 - protein, 445 aa, unidentified
MHGHSRNGQAHVPRRKRRNRFVKKNGQCNVYFANLSNKSQRYMADIFTTCVDTRWRYMLMIFSAAFLVSWLFFGLLFWCIAFFHGDLEASPGVPAAGGPAAGGGGAAPVAPKPCIMHVNGFLGAFLFSVETQTTIGYGFRCVTEECPLAVIAVVVQSIVGCVIDSFMIGTIMAKMARPKKRAQTLLFSHHAVISVRDGKLCLMWRVGNLRKSHIVEAHVRAQLIKPYMTQEGEYLPLDQRDLNVGYDIGLDRIFLVSPIIIVHEIDEDSPLYGMGKEELESEDFEIVVILEGMVEATAMTTQARSSYLASEILWGHRFEPVVFEEKSHYKVDYSRFHKTYEVAGTPCCSARELQESKITVLPAPPPPPSAFCYENELALMSQEEEEMEEEAAAAAAVAAGLGLEAGSKEEAGIIRMLEFGSHLDLERMQASLPLDNISYRRESAI

SEQ ID NO: 2231 - protein, 419 aa, unidentified
MAGDSRNAMNQDMEIGVTPWDPKKIPKQARDYVPIATDRTRLLAEGKKPRQRYMEKSGKCNVHHGNVQETYRYLSDLFTTLVDLKWRFNLLVFTMVYTVTWLFFGFIWWLIAYIRGDLDHVGDQEWIPCVENLSGFVSAFLFSIETETTIGYGFRVITEKCPEGIILLLVQAILGSIVNAFMVGCMFVKISQPKKRAETLMFSNNAVISMRDEKLCLMFRVGDLRNSHIVEASIRAKLIKSRQTKEGEFIPLNQTDINVGFDTGDDRLFLVSPLIISHEINQKSPFWEMSQAQLHQEEFEVVVILEGMVEATGMTCQARSSYMDTEVLWGHRFTPVLTLEKGFYEVDYNTFHDTYETNTPSCCAKELAEMKREGRLLQYLPSPPLLGGCAEAGLDAEAEQNEEDEPKGLGGSREARGSV

SEQ ID NO: 2232 - protein, 423 aa, unidentified
MAKLTESMTNVLEGDSMDQDVESPVAIHQPKLPKQARDDLPRHISRDRTKRKIQRYVRKDGKCNVHHGNVRETYRYLTDIFTTLVDLKWRFNLLIFVMVYTVTWLFFGMIWWLIAYIRGDMDHIEDPSWTPCVTNLNGFVSAFLFSIETETTIGYGYRVITDKCPEGIILLLIQSVLGSIVNAFMVGCMFVKISQPKKRAETLVFSTHAVISMRDGKLCLMFRVGDLRNSHIVEASIRAKLIKSKQTSEGEFIPLNQTDINVGYYTGDDRLFLVSPLIISHEINQQSPFWEISKAQLPKEELEIVVILEGMVEATGMTCQARSSYITSEILWGYRFTPVLTLEDGFYEVDYNSFHETYETSTPSLSAKELAELASRAELPLSWSVSSKLNQHAELETEEEEKNLEEQTERNGDVANLENESKV

SEQ ID NO: 2233 - protein, 424 aa, unidentified
MLARKSIIPEEYVLARIAAENLRKPRIRDRLPKARFIAKSGACNLAHKNIREQGRFLQDIFTTLVDLKWRHTLVIFTMSFLCSWLLFAIMWWLVAFAHGDIYAYMEKSGMEKSGLESTVCVTNVRSFTSAFLFSIEVQVTIGFGGRMMTEECPLAITVLILQNIVGLIINAVMLGCIFMKTAQAHRRAETLIFSRHAVIAVRNGKLCFMFRVGDLRKSMIISASVRIQVVKKTTTPEGEVVPIHQLDIPVDNPIESNNIFLVAPLIICHVIDKRSPLYDISATDLANQDLEVIVILEGVVETTGITTQARTSYIAEEIQWGHRFVSIVTEEEGVYSVDYSKFGNTVKVAAPRCSARELDEKPSILIQTLQKSELSHQNSLRKRNSMRRNNSMRRNNSIRRNNSSLMVPKVQFMTPEGNQNTSES

SEQ ID NO: 2234 - protein, 393 aa, unidentified
MAQENAAFSPGQEEPPRRRGRQRYVEKDGRCNVQQGNVRETYRYLTDLFTTLVDLQWRLSLLFFVLAYALTWLFFGAIWWLIAYGRGDLEHLEDTAWTPCVNNLNGFVAAFLFSIETETTIGYGHRVITDQCPEGIVLLLLQAILGSMVNAFMVGCMFVKISQPNKRAATLVFSSHAVVSLRDGRLCLMFRVGDLRSSHIVEASIRAKLIRSRQTLEGEFIPLHQTDLSVGFDTGDDRLFLVSPLVISHEIDAASPFWEASRRALERDDFEIVVILEGMVEATGMTCQARSSYLVDEVLWGHRFTSVLTLEDGFYEVDYASFHETFEVPTPSCSARELAEAAARLDAHLYWSIPSRLDEKVEEEGAGEGAGGEAGADKEQNGCLPPPESESKV

SEQ ID NO: 2235 - protein, 336 aa, unidentified
MLQSLAGSSCVRLVERHRSAWCFGFLVLGYLLYLVFGAVVFSSVELPYEDLLRQELRKLKRRFLEEHECLSEQQLEQFLGRVLEASNYGVSVLSNASGNWNWDFTSALFFASTVLSTTGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 2236 - protein, 538 aa, unidentified
MFFLYTDFFLSLVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 2237 - protein, 430 aa, unidentified
MSSRSPRPPPRRSRRRLPRPSCCCCCCRRSHLNEDTGRFVLLAALIGLYLVAGATVFSALESPGEAEARARWGATLRNFSAAHGVAEPELRAFLRHYEAALAAGVRADALRPRWDFPGAFYFVGTVVSTIGFGMTTPATVGGKAFLIAYGLFGCAGTILFFNLFLERIISLLAFIMRACRERQLRRSGLLPATFRRGSALSEADSLAGWKPSVYHVLLILGLFAVLLSCCASAMYTSVEGWDYVDSLYFCFVTFSTIGFGDLVSSQHAAYRNQGLYRLGNFLFILLGVCCIYSLFNVISILIKQVLNWMLRKLSCRCCARCCPAPGAPLARRNAITPGSRLRRRLAALGADPAARDSDAEGRRLSGELISMRDLTASNKVSLALLQKQLSETANGYPRSVCVNTRQNGFSGGVGALGIMNNRLAETSASR

SEQ ID NO: 2238 - protein, 408 aa, unidentified
MAGRGFSWGPGHLNEDNARFLLLAALIVLYLLGGAAVFSALELAHERQAKQRWEERLANFSRGHNLSRDELRGFLRHYEEATRAGIRVDNVRPRWDFTGAFYFVGTVVSTIGFGMTTPATVGGKIFLIFYGLVGCSSTILFFNLFLERLITIIAYIMKSCHQRQLRRRGALPQESLKDAGQCEVDSLAGWKPSVYYVMLILCTASILISCCASAMYTPIEGWSYFDSLYFCFVAFSTIGFGDLVSSQNAHYESQGLYRFANFVFILMGVCCIYSLFNVISILIKQSLNWILRKMDSGCCPQCQRGLLRSRRNVVMPGSVRNRCNISIETDGVAESDTDGRRLSGEMISMKDLLAANKASLAILQKQLSEMANGCPHQTSTLARDNEFSGGVGAFAIMNNRLAETSGDR

SEQ ID NO: 2239 - protein, 330 aa, unidentified
MRRPSVRAAGLVLCTLCYLLVGAAVFDALESEAESGRQRLLVQKRGALRRKFGFSAEDYRELERLALQAEPHRAGRQWKFPGSFYFAITVITTIGYGHAAPGTDSGKVFCMFYALLGIPLTLVTFQSLGERLNAVVRRLLLAAKCCLGLRWTCVSTENLVVAGLLACAATLALGAVAFSHFEGWTFFHAYYYCFITLTTIGFGDFVALQSGEALQRKLPYVAFSFLYILLGLTVIGAFLNLVVLRFLVASADWPERAARPPSPRPPGAPESRGLWLPRRPARSVGSASVFCHVHKLERCARDNLGFSPPSSPGVVRGGQAPRPGARWKSI

SEQ ID NO: 2240 - protein, 309 aa, unidentified
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGTDPSKHYISVYRSLAAIWILLGLAWLALILPLGPLLLHRCCQLWLLSLRQGCGAKAAPGRRPRRGSTAARGVQVTPQDFPISKKGLGS

SEQ ID NO: 2241 - protein, 332 aa, unidentified
MYRPRARAAPEGRVRGCAVPSTVLLLLAYLAYLALGTGVFWTLEGRAAQDSSRSFQRDKWELLQNFTCLDRPALDSLIRDVVQAYKNGASLLSNTTSMGRWELVGSFFFSVSTITTIGYGNLSPNTMAARLFCIFFALVGIPLNLVVLNRLGHLMQQGVNHWASRLGGTWQDPDKARWLAGSGALLSGLLLFLLLPPLLFSHMEGWSYTEGFYFAFITLSTVGFGDYVIGMNPSQRYPLWYKNMVSLWILFGMAWLALIIKLILSQLETPGRVCSCCHHSSKEDFKSQSWRQGPDREPESHSPQQGCYPEGPMGIIQHLEPSAHAAGCGKDS

SEQ ID NO: 2242 - protein, 384 aa, unidentified
MEVSGHPQARRCCPEALGKLFPGLCFLCFLVTYALVGAVVFSAIEDGQVLVAADDGEFEKFLEELCRILNCSETVVEDRKQDLQGHLQKVKPQWFNRTTHWSFLSSLFFCCTVFSTVGYGYIYPVTRLGKYLCMLYALFGIPLMFLVLTDTGDILATILSTSYNRFRKFPFFTRPLLSKWCPKSLFKKKPDPKPADEAVPQIIISAEELPGPKLGTCPSRPSCSMELFERSHALEKQNTLQLPPQAMERSNSCPELVLGRLSYSIISNLDEVGQQVERLDIPLPIIALIVFAYISCAAAILPFWETQLDFENAFYFCFVTLTTIGFGDTVLEHPNFFLFFSIYIIVGMEIVFIAFKLVQNRLIDIYKNVMLFFAKGKFYHLVKK

SEQ ID NO: 2243 - protein, 426 aa, unidentified
MLPSASRERPGYRAGVAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 2244 - protein, 394 aa, unidentified
MKRQNVRTLALIVCTFTYLLVGAAVFDALESEPELIERQRLELRQQELRARYNLSQGGYEELERVVLRLKPHKAGVQWRFAGSFYFAITVITTIGYGHAAPSTDGGKVFCMFYALLGIPLTLVMFQSLGERINTLVRYLLHRAKKGLGMRRADVSMANMVLIGFFSCISTLCIGAAAFSHYEHWTFFQAYYYCFITLTTIGFGDYVALQKDQALQTQPQYVAFSFVYILTGLTVIGAFLNLVVLRFMTMNAEDEKRDAEHRALLTRNGQAGGGGGGGSAHTTDTASSTAAAGGGGFRNVYAEVLHFQSMCSCLWYKSREKLQYSIPMIIPRDLSTSDTCVEQSHSSPGGGGRYSDTPSRRCLCSGAPRSAISSVSTGLHSLSTFRGLMKRRSSV

SEQ ID NO: 2245 - protein, 393 aa, unidentified
MRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPV

SEQ ID NO: 2246 - protein, 499 aa, unidentified
MVDRGPLLTSAIIFYLAIGAAIFEVLEEPHWKEAKKNYYTQKLHLLKEFPCLGQEGLDKILEVVSDAAGQGVAITGNQTFNNWNWPNAMIFAATVITTIGYGNVAPKTPAGRLFCVFYGLFGVPLCLTWISALGKFFGGRAKRLGQFLTKRGVSLRKAQITCTVIFIVWGVLVHLVIPPFVFMVTEGWNYIEGLYYSFITISTIGFGDFVAGVNPSANYHALYRYFVELWIYLGLAWLSLFVNWKVSMFVEVHKAIKKRRRRRKESFESSPHSRKALQVKGSTASKDVNIFSFLSKKEETYNDLIKQIGKKAMKTSGGGETGPGPGLGPQGGGLPALPPSLVPLVVYSKNRVPTLEEVSQTLRSKGHVSRSPDEEAVARAPEDSSPAPEVFMNQLDRISEECEPWDAQDYHPLIFQDASITFVNTEAGLSDEETSKSSLEDNLAGEESPQQGAEAKAPLNMGEFPSSSESTFTSTESELSVPYEQLMNEYNKANSPKGT

SEQ ID NO: 2247 - protein, 313 aa, unidentified
MRRGALLAGALAAYAAYLVLGALLVARLEGPHEARLRAELETLRAQLLQRSPCVAAPALDAFVERVLAAGRLGRVVLANASGSANASDPAWDFASALFFASTLITTVGYGYTTPLTDAGKAFSIAFALLGVPTTMLLLTASAQRLSLLLTHVPLSWLSMRWGWDPRRAACWHLVALLGVVVTVCFLVPAVIFAHLEEAWSFLDAFYFCFISLSTIGLGDYVPGEAPGQPYRALYKVLVTVYLFLGLVAMVLVLQTFRHVSDLHGLTELILLPPPCPASFNADEDDRVDILGPQPESHQQLSASSHTDYASIPR

SEQ ID NO: 2248 - protein, 307 aa, unidentified
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGYLLLGLLAMLLAVETFSELPQVRAMGKFFRPSGPVTAEDQGGILGQDELALSTLPPAAPASGQAPAC

SEQ ID NO: 2249 - protein, 374 aa, unidentified
MKRQNVRTLSLIVCTFTYLLVGAAVFDALESDHEMREEEKLKAEEIRIKGKYNISSEDYRQLELVILQSEPHRAGVQWKFAGSFYFAITVITTIGYGHAAPGTDAGKAFCMFYAVLGIPLTLVMFQSLGERMNTFVRYLLKRIKKCCGMRNTDVSMENMVTVGFFSCMGTLCIGAAAFSQCEEWSFFHAYYYCFITLTTIGFGDYVALQTKGALQKKPLYVAFSFMYILVGLTVIGAFLNLVVLRFLTMNSEDERRDAEERASLAGNRNSMVIHIPEEPRPSRPRYKADVPDLQSVCSCTCYRSQDYGGRSVAPQNSFSAKLAPHYFHSISYKIEEISPSTLKNSLFPSPISSISPGLHSFTDHQRLMKRRKSV

SEQ ID NO: 2250 - protein, 1236 aa, unidentified
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 2251 - protein, 191 aa, unidentified
MVKKLVMAQKRGETRALCLGVTMVVCAVITYYILVTTVLPLYQKSVWTQESKCHLIETNIRDQEELKGKKVPQYPCLWVNVSAAGRWAVLYHTEDTRDQNQQCSYIPGSVDNYQTARADVEKVRAKFQEQQVFYCFSAPRGNETSVLFQRLYGPQALLFSLFWPTFLLTGGLLIIAMVKSNQYLSILAAQK

SEQ ID NO: 2252 - protein, 235 aa, unidentified
MFIWTSGRTSSSYRHDEKRNIYQKIRDHDLLDKRKTVTALKAGEDRAILLGLAMMVCSIMMYFLLGITLLRSYMQSVWTEESQCTLLNASITETFNCSFSCGPDCWKLSQYPCLQVYVNLTSSGEKLLLYHTEETIKINQKCSYIPKCGKNFEESMSLVNVVMENFRKYQHFSCYSDPEGNQKSVILTKLYSSNVLFHSLFWPTCMMAGGVAIVAMVKLTQYLSLLCERIQRINR

SEQ ID NO: 2253 - protein, 279 aa, unidentified
MDFSPSSELGFHFVAFILLTRHRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 2254 - protein, 210 aa, unidentified
MAKLRVAYEYTEAEDKSIRLGLFLIISGVVSLFIFGFCWLSPALQDLQATEANCTVLSVQQIGEVFECTFTCGADCRGTSQYPCVQVYVNNSESNSRALLHSDEHQLLTNPKCSYIPPCKRENQKNLESVMNWQQYWKDEIGSQPFTCYFNQHQRPDDVLLHRTHDEIVLLHCFLWPLVTFVVGVLIVVLTICAKSLAVKAEAMKKRKFS

SEQ ID NO: 2255 - protein, 543 aa, unidentified
MNSHSYNGSVGRPLGSGPGALGRDPPDPEAGHPPQPPHSPGLQVVVAKSEPARPSPGSPRGQPQDQDDDEDDEEDEAGRQRASGKPSNVGHRLGHRRALFEKRKRLSDYALIFGMFGIVVMVTETELSWGVYTKESLYSFALKCLISLSTAILLGLVVLYHAREIQLFMVDNGADDWRIAMTCERVFLISLELAVCAIHPVPGHYRFTWTARLAFTYAPSVAEADVDVLLSIPMFLRLYLLGRVMLLHSKIFTDASSRSIGALNKITFNTRFVMKTLMTICPGTVLLVFSISSWIIAAWTVRVCERYHDKQEVTSNFLGAMWLISITFLSIGYGDMVPHTYCGKGVCLLTGIMGAGCTALVVAVVARKLELTKAEKHVHNFMMDTQLTKRVKNAAANVLRETWLIYKHTRLVKKPDQARVRKHQRKFLQAIHQAQKLRSVKIEQGKLNDQANTLTDLAKTQTVMYDLVSELHAQHEELEARLATLESRLDALGASLQALPGLIAQAIRPPPPPLPPRPGPGPQDQAARSSPCRWTPVAPSDCG

SEQ ID NO: 2256 - protein, 579 aa, unidentified
MSSCRYNGGVMRPLSNLSASRRNLHEMDSEAQPLQPPASVGGGGGASSPSAAAAAAAAVSSSAPEIVVSKPEHNNSNNLALYGTGGGGSTGGGGGGGGSGHGSSSGTKSSKKKNQNIGYKLGHRRALFEKRKRLSDYALIFGMFGIVVMVIETELSWGAYDKASLYSLALKCLISLSTIILLGLIIVYHAREIQLFMVDNGADDWRIAMTYERIFFICLEILVCAIHPIPGNYTFTWTARLAFSYAPSTTTADVDIILSIPMFLRLYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 2257 - protein, 731 aa, unidentified
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 2258 - protein, 427 aa, unidentified
MGGDLVLGLGALRRRKRLLEQEKSLAGWALVLAGTGIGLMVLHAEMLWFGGCSWALYLFLVKCTISISTFLLLCLIVAFHAKEVQLFMTDNGLRDWRVALTGRQAAQIVLELVVCGLHPAPVRGPPCVQDLGAPLTSPQPWPGFLGQGEALLSLAMLLRLYLVPRAVLLRSGVLLNASYRSIGALNQVRFRHWFVAKLYMNTHPGRLLLGLTLGLWLTTAWVLSVAERQAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 2259 - protein, 676 aa, unidentified [sequence omitted]

SEQ ID NO: 2260 - protein, 872 aa, unidentified [sequence omitted]

SEQ ID NO: 2261 - protein, 872 aa, unidentified
MGLKARRAAGAAGGGGDGGGGGGGAANPAGGDAAAAGDEERKVGLAPGDVEQVTLALGAGADKDGTLLLEGGGRDEGQRRTPQGIGLLAKTPLSRPVKRNNAKYRRIQTLIYDALERPRGWALLYHALVFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 2262 - protein, 695 aa, unidentified [sequence omitted]

SEQ ID NO: 2263 - protein, 932 aa, unidentified
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 2264 - protein, 526 aa, unidentified
MLMLLVRGTHYENLRSKVVLPTPLGGRSTETFVSEFPGPDTGIRWRRSDEALRVNVGGVRRQLSARALARFPGTRLGRLQAAASEEQARRLCDDYDEAAREFYFDRHPGFFLSLLHFYRTGHLHVLDELCVFAFGQEADYWGLGENALAACCRARYLERRLTQPHAWDEDSDTPSSVDPCPDEISDVQRELARYGAARCGRLRRRLWLTMENPGYSLPSKLFSCVSISVVLASIAAMCIHSLPEYQAREAAAAVAAVAAGRSPEGVRDDPVLRRLEYFCIAWFSFEVSSRLLLAPSTRNFFCHPLNLIDIVSVLPFYLTLLAGVALGDQGGKEFGHLGKVVQVFRLMRIFRVLKLARHSTGLRSLGATLKHSYREVGILLLYLAVGVSVFSGVAYTAEKEEDVGFNTIPACWWWGTVSMTTVGYGDVVPVTVAGKLAASGCILGGILVVALPITIIFNKFSHFYRRQKALEAAVRNSNHQEFEDLLSSIDGVSEASLETSRETSQEGQSADLESQAPSEPPHPQMY

SEQ ID NO: 2265 - protein, 477 aa, unidentified
MTGQSLWDVSEANVEDGEIRINVGGFKRRLRSHTLLRFPETRLGRLLLCHSREAILELCDDYDDVQREFYFDRNPELFPYVLHFYHTGKLHVMAELCVFSFSQEIEYWGINEFFIDSCCSYSYHGRKVEPEQEKWDEQSDQESTTSSFDEILAFYNDASKFDGQPLGNFRRQLWLALDNPGYSVLSRVFSILSILVVMGSIITMCLNSLPDFQIPDSQGNPGEDPRFEIVEHFGIAWFTFELVARFAVAPDFLKFFKNALNLIDLMSIVPFYITLVVNLVVESTPTLANLGRVAQVLRLMRIFRILKLARHSTGLRSLGATLKYSYKEVGLLLLYLSVGISIFSVVAYTIEKEENEGLATIPACWWWATVSMTTVGYGDVVPGTTAGKLTASACILAGILVVVLPITLIFNKFSHFYRRQKQLESAMRSCDFGDGMKEVPSVNLRDYYAHKVKSLMASLTNMSRSSPSELSLNDSLR

SEQ ID NO: 2266 - protein, 491 aa, unidentified
MVFGEFFHRPGQDEELVNLNVGGFKQSVDQSTLLRFPHTRLGKLLTCHSEEAILELCDDYSVADKEYYFDRNPSLFRYVLNFYYTGKLHVMEELCVFSFCQEIEYWGINELFIDSCCSNRYQERKEENHEKDWDQKSHDVSTDSSFEESSLFEKELEKFDTLRFGQLRKKIWIRMENPAYCLSAKLIAISSLSVVLASIVAMCVHSMSEFQNEDGEVDDPVLEGVEIACIAWFTGELAVRLAAAPCQKKFWKNPLNIIDFVSIIPFYATLAVDTKEEESEDIENMGKVVQILRLMRIFRILKLARHSVGLRSLGATLRHSYHEVGLLLLFLSVGISIFSVLIYSVEKDDHTSSLTSIPICWWWATISMTTVGYGDTHPVTLAGKLIASTCIICGILVVALPITIIFNKFSKYYQKQKDIDVDQCSEDAPEKCHELPYFNIRDIYAQRMHTFITSLSSVGIVVSDPDSTDASSIEDNEDICNTTSLENCTAK

SEQ ID NO: 2267 - protein, 1230 aa, unidentified
MARAKLPRSPSEGKAGPGGAPAGAAAPEEPHGLSPLLPARGGGSVGSDVGQRLPVEDFSLDSSLSQVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSESQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 2268 - protein, 1135 aa, unidentified
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPPDMHFLDAICWFPMVYYMVGSIDNLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 2269 - protein, 1149 aa, unidentified
MFQTKLRNETWEDLPKMSCTTEIQAAFILSSFVTFFSGLIILLIFRLIWRSVKKWQIIKGTGIILELFTSGTIARSHVRSLHFQGQFRDHIEMLLSAQTFVGQVLVILVFVLSIGSLIIYFINSADPVGSCSSYEDKTIPIDLVFNAFFSFYFGLRFMAADDKIKFWLEMNSIVDIFTIPPTFISYYLKSNWLGLRFLRALRLLELPQILQILRAIKTSNSVKFSKLLSIILSTWFTAAGFIHLVENSGDPWLKGRNSQNISYFESIYLVMATTSTVGFGDVVAKTSLGRTFIMFFTLGSLILFANYIPEMVELFANKRKYTSSYEALKGKKFIVVCGNITVDSVTAFLRNFLRDKSGEINTEIVFLGETPPSLELETIFKCYLAYTTFISGSAMKWEDLRRVAVESAEACLIIANPLCSDSHAEDISNIMRVLSIKNYDSTTRIIIQILQSHNKVYLPKIPSWNWDTGDNIICFAELKLGFIAQGCLVPGLCTFLTSLFVEQNKKVMPKQTWKKHFLNSMKNKILTQRLSDDFAGMSFPEVARLCFLKMHLLLIAIEYKSLFTDGFCGLILNPPPQVRIRKNTLGFFIAETPKDVRRALFYCSVCHDDVFIPELITNCGCKSRSRQHITVPSVKRMKKCLKGISSRISGQDSPPRVSASTSSISNFTTRTLQHDVEQDSDQLDSSGMFHWCKPTSLDKVTLKRTGKSKYKFRNHIVACVFGDAHSAPMGLRNFVMPLRASNYTRKELKDIVFIGSLDYLQREWRFLWNFPQIYILPGCALYSGDLHAANIEQCSMCAVLSPPPQPSSNQTLVDTEAIMATLTIGSLQIDSSSDPSPSVSEETPGYTNGHNEKSNCRKVPILTELKNPSNIHFIEQLGGLEGSLQETNLHLSTAFSTGTVFSGSFLDSLLATAFYNYHVLELLQMLVTGGVSSQLEQHLDKDKVYGVADSCTSLLSGRNRCKLGLLSLHETILSDVNPRNTFGQLFCGSLDLFGILCVGLYRIIDEEELNPENKRFVITRPANEFKLLPSDLVFCAIPFSTACYKRNEEFSLQKSYEIVNKASQTTETHSDTNCPPTIDSVTETLYSPVYSYQPRTNSLSFPKQIAWNQSRTNSIISSQIPLGDNAKENERKTSDEVYDEDPFAYSEPL

SEQ ID NO: 2270 - protein, 500 aa, unidentified
MPSSGRALLDSPLDSGSLTSLDSSVFCSEGEGEPLALGDCFTVNVGGSRFVLSQQALSCFPHTRLGKLAVVVASYRRPGALAAVPSPLELCDDANPVDNEYFFDRSSQAFRYVLHYYRTGRLHVMEQLCALSFLQEIQYWGIDELSIDSCCRDRYFRRKELSETLDFKKDTEDQESQHESEQDFSQGPCPTVRQKLWNILEKPGSSTAARIFGVISIIFVVVSIINMALMSAELSWLDLQLLEILEYVCISWFTGEFVLRFLCVRDRCRFLRKVPNIIDLLAILPFYITLLVESLSGSQTTQELENVGRIVQVLRLLRALRMLKLGRHSTGLRSLGMTITQCYEEVGLLLLFLSVGISIFSTVEYFAEQSIPDTTFTSVPCAWWWATTSMTTVGYGDIRPDTTTGKIVAFMCILSGILVLALPIAIINDRFSACYFTLKLKEAAVRQREALKKLTKNIATDSYISVNLRDVYARSIMEMLRLKGRERASTRSSGGDDFWF

SEQ ID NO: 2271 - protein, 545 aa, unidentified
MLKQSERRRSWSYRPWNTTENEGSQHRRSICSLGARSGSQASIHGWTEGNYNYYIEEDEDGEEEDQWKDDLAEEDQQAGEVTTAKPEGPSDPPALLSTLNVNVGGHSYQLDYCELAGFPKTRLGRLATSTSRSRQLSLCDDYEEQTDEYFFDRDPAVFQLVYNFYLSGVLLVLDGLCPRRFLEELGYWGVRLKYTPRCCRICFEERRDELSERLKIQHELRAQAQVEEAEELFRDMRFYGPQRRRLWNLMEKPFSSVAAKAIGVASSTFVLVSVVALALNTVEEMQQHSGQGEGGPDLRPILEHVEMLCMGFFTLEYLLRLASTPDLRRFARSALNLVDLVAILPLYLQLLLECFTGEGHQRGQTVGSVGKVGQVLRVMRLMRIFRILKLARHSTGLRAFGFTLRQCYQQVGCLLLFIAMGIFTFSAAVYSVEHDVPSTNFTTIPHSWWWAAVSISTVGYGDMYPETHLGRFFAFLCIAFGIILNGMPISILYNKFSDYYSKLKAYEYTTIRRERGEVNFMQRARKKIAECLLGSNPQLTPRQEN

SEQ ID NO: 2272 - protein, 289 aa, unidentified
MVVVTGREPDSRRQDGAMSSSDAEDDFLEPATPTATQAGHALPLLPQEFPEVVPLNIGGAHFTTRLSTLRCYEDTMLAAMFSGRHYIPTDSEGRYFIDRDGTHFGDVLNFLRSGDLPPRERVRAVYKEAQYYAIGPLLEQLENMQPLKGEKVRQAFLGLMPYYKDHLERIVEIARLRAVQRKARFAKLKVCVFKEEMPITPYECPLLNSLRFERSESDGQLFEHHCEVDVSFGPWEAVADVYDLLHCLVTDLSAQGLTVDHQCIGVCDKHLVNHYYCKRPIYEFKITWW

SEQ ID NO: 2273 - protein, 473 aa, unidentified
MALKDTGSGGSTILPISEMVSSSSSPGASAAAAPGPCAPSPFPEVVELNVGGQVYVTKHSTLLSVPDSTLASMFSPSSPRGGARRRGELPRDSRARFFIDRDGFLFRYVLDYLRDKQLALPEHFPEKERLLREAEYFQLTDLVKLLSPKVTKQNSLNDEGCQSDLEDNVSQGSSDALLLRGAAAAVPSGPGAHGGGGGGGAQDKRSGFLTLGYRGSYTTVRDNQADAKFRRVARIMVCGRIALAKEVFGDTLNESRDPDRQPEKYTSRFYLKFTYLEQAFDRLSEAGFHMVACNSSGTAAFVNQYRDDKIWSSYTEYIFFRPPQKIVSPKQEHEDRKHDKVTDKGSESGTSCNELSTSSCDSHSEASTPQDNPSSAQQATAHQPNTLTLDRPSKKAPVQWIPPPDKRRNSELFQTLISKSRETNLSKKKVCEKLSVEEEMKKCIQDFKKIHIPDYFPERKRQWQSELLQKYGL

SEQ ID NO: 2274 - protein, 212 aa, unidentified
MNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 2275 - protein, 212 aa, unidentified
MNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 2276 - protein, 214 aa, unidentified
MNVFRILGDLSHLLAMILLLGKIWRSKCCKGISGKSQILFALVFTTRYLDLFTNFISIYNTVMKVVFLLCAYVTVYMIYGKFRKTFDSENDTFRLEFLLVPVIGLSFLENYSFTLLEILWTFSIYLESVAILPQLFMISKTGEAETITTHYLFFLGLYRALYLANWIRRYQTENFYDQIAVVSGVVQTIFYCDFFYLYVTKVLKGKKLSLPMPI

SEQ ID NO: 2277 - protein, 1356 aa, unidentified
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKPFVAFGSGMESLVEATVGERVRIPAKYLGYPPPEIKWYKNGIPLESNHTIKAGHVLTIMEVSERDTGNYTVILTNPISKEKQSHVVSLVVYVPPQIGEKSLISPVDSYQYGTTQTLTCTVYAIPPPHHIHWYWQLEEECANEPSQAVSVTNPYPCEEWRSVEDFQGGNKIEVNKNQFALIEGKNKTVSTLVIQAANVSALYKCEAVNKVGRGERVISFHVTRGPEITLQPDMQPTEQESVSLWCTADRSTFENLTWYKLGPQPLPIHVGELPTPVCKNLDTLWKLNATMFSNSTNDILIMELKNASLQDQGDYVCLAQDRKTKKRHCVVRQLTVLERVAPTITGNLENQTTSIGESIEVSCTASGNPPPQIMWFKDNETLVEDSGIVLKDGNRNLTIRRVRKEDEGLYTCQACSVLGCAKVEAFFIIEGAQEKTNLEIIILVGTAVIAMFFWLLLVIILRTVKRANGGELKTGYLSIVMDPDELPLDEHCERLPYDASKWEFPRDRLKLGKPLGRGAFGQVIEADAFGIDKTATCRTVAVKMLKEGATHSEHRALMSELKILIHIGHHLNVVNLLGACTKPGGPLMVIVEFCKFGNLSTYLRSKRNEFVPYKTKGARFRQGKDYVGAIPVDLKRRLDSITSSQSSASSGFVEEKSLSDVEEEEAPEDLYKDFLTLEHLICYSFQVAKGMEFLASRKCIHRDLAARNILLSEKNVVKICDFGLARDIYKDPDYVRKGDARLPLKWMAPETIFDRVYTIQSDVWSFGVLLWEIFSLGASPYPGVKIDEEFCRRLKEGTRMRAPDYTTPEMYQTMLDCWHGEPSQRPTFSELVEHLGNLLQANAQQDGKDYIVLPISETLSMEEDSGLSLPTSPVSCMEEEEVCDPKFHYDNTAGISQYLQNSKRKSRPVSVKTFEDIPLEEPEVKVIPDDNQTDSGMVLASEELKTLEDRTKLSPSFGGMVPSKSRESVASEGSNQTSGYQSGYHSDDTDTTVYSSEEAELLKLIEIGVQTGSTAQILQPDSGTTLSSPPV

SEQ ID NO: 2278 - protein, 332 aa, unidentified
MLLLAAAFLVAFVLLLYMVSPLISPKPLALPGAHVVVTGGSSGIGKCIAIECYKQGAFITLVARNEDKLLQAKKEIEMHSINDKQVVLCISVDVSQDYNQVENVIKQAQEKLGPVDMLVNCAGMAVSGKFEDLEVSTFERLMSINYLGSVYPSRAVITTMKERRVGRIVFVSSQAGQLGLFGFTAYSASKFAIRGLAEALQMEVKPYNVYITVAYPPDTDTPGFAEENRTKPLETRLISETTSVCKPEQVAKQIVKDAIQGNFNSSLGSDGYMLSALTCGMAPVTSITEGLQQVVTMGLFRTIALFYLGSFDSIVRRCMMQREKSENADKTA

SEQ ID NO: 2279 - protein, 732 aa, unidentified
MEGGDQSEEEPRERSQAGGMGTLWSQESTPEERLPVEGSRPWAVARRVLTAILILGLLLCFSVLLFYNFQNCGPRPCETSVCLDLRDHYLASGNTSVAPCTDFFSFACGRAKETNNSFQELATKNKNRLRRILEVQNSWHPGSGEEKAFQFYNSCMDTLAIEAAGTGPLRQVIEELGGWRISGKWTSLNFNRTLRLLMSQYGHFPFFRAYLGPHPASPHTPVIQIDQPEFDVPLKQDQEQKIYAQIFREYLTYLNQLGTLLGGDPSKVQEHSSLSISITSRLFQFLRPLEQRRAQGKLFQMVTIDQLKEMAPAIDWLSCLQATFTPMSLSPSQSLVVHDVEYLKNMSQLVEEMLLKQRDFLQSHMILGLVVTLSPALDSQFQEARRKLSQKLRELTEQPPMPARPRWMKCVEETGTFFEPTLAALFVREAFGPSTRSAAMKLFTAIRDALITRLRNLPWMNEETQNMAQDKVAQLQVEMGASEWALKPELARQEYNDIQLGSSFLQSVLSCVRSLRARIVQSFLQPHPQHRWKVSPWDVNAYYSVSDHVVVFPAGLLQPPFFHPGYPRAVNFGAAGSIMAHELLHIFYQLLLPGGCLACDNHALQEAHLCLKRHYAAFPLPSRTSFNDSLTFLENAADVGGLAIALQAYSKRLLRHHGETVLPSLDLSPQQIFFRSYAQVMCRKPSPQDSHDTHSPPHLRVHGPLSSTPAFARYFRCARGALLNPSSRCQLW

SEQ ID NO: 2280 - protein, 237 aa, unidentified
MLSAFQRLFRVLFVIETVSEYGVLIFIYGWPFLQTLAMLLIGTVSFHLWIRRNRERNSRSGKTRCRSKRSEQSMDMGTSALSKKPWWTLPQNFHAPMVFHMEEDQEELIFGHGDTYLRCIEVHSHTLIQLESWFTATGQTRVTVVGPHRARQWLLHMFCCVGSQDSYHHARGLEMLERVRSQPLTNDDLVTSISVPPYTGDLSLAPRISGTVCLSVPQPSPYQVIGCSGFHLSSLYP

SEQ ID NO: 2281 - protein, 1072 aa, unidentified
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 2282 - protein, 1049 aa, unidentified
MEKRLGVKPNPASWILSGYYWQTSAKWLRSLYLFYTCFCFSVLWLSTDASESRCQQGKTQFGVGLRSGGENHLWLLEGTPSLQSCWAACCQDSACHVFWWLEGMCIQADCSRPQSCRAFRTHSSNSMLVFLKKFQTADDLGFLPEDDVPHLLGLGWNWASWRQSPPRAALRPAVSSSDQQSLIRKLQKRGSPSDVVTPIVTQHSKVNDSNELGGLTTSGSAEVHKAITISSPLTTDLTAELSGGPKNVSVQPEISEGLATTPSTQQVKSSEKTQIAVPQPVAPSYSYATPTPQASFQSTSAPYPVIKELVVSAGESVQITLPKNEVQLNAYVLQEPPKGETYTYDWQLITHPRDYSGEMEGKHSQILKLSKLTPGLYEFKVIVEGQNAHGEGYVNVTVKPEPRKNRPPIAIVSPQFQEISLPTTSTVIDGSQSTDDDKIVQYHWEELKGPLREEKISEDTAILKLSKLVPGNYTFSLTVVDSDGATNSTTANLTVNKAVDYPPVANAGPNQVITLPQNSITLFGNQSTDDHGITSYEWSLSPSSKGKVVEMQGVRTPTLQLSAMQEGDYTYQLTVTDTIGQQATAQVTVIVQPENNKPPQADAGPDKELTLPVDSTTLDGSKSSDDQKIISYLWEKTQGPDGVQLENANSSVATVTGLQVGTYVFTLTVKDERNLQSQSSVNVIVKEEINKPPIAKITGNVVITLPTSTAELDGSKSSDDKGIVSYLWTRDEGSPAAGEVLNHSDHHPILFLSNLVEGTYTFHLKVTDAKGESDTDRTTVEVKPDPRKNNLVEIILDINVSQLTERLKGMFIRQIGVLLGVLDSDIIVQKIQPYTEQSTKMVFFVQNEPPHQIFKGHEVAAMLKSELRKQKADFLIFRALEVNTVTCQLNCSDHGHCDSFTKRCICDPFWMENFIKVQLRDGDSNCEWSVLYVIIATFVIVVALGILSWTVICCCKRQKGKPKRKSKYKILDATDQESLELKPTSRAGIKQKGLLLSSSLMHSESELDSDDAIFTWPDREKGKLLHGQNGSVPNGQTPLKARSPREEIL

SEQ ID NO: 2283 - protein, 1609 aa, unidentified
MAGLRRPQPGCYCRTAAAVNLLLGVFQVLLPCCRPGGAQGQAIEPLPNVVELWQAEEGELLLPTQGDSEEGLEEPSQEQSFSDKLFSGKGLHFQPSVLDFGIQFLGHPVAKILHAYNPSRDSEVVVNSVFAAAGHFHVPPVPCRVIPAMGKTSFRIIFLPTEEGSIESSLFINTSSYGVLSYHVSGIGTRRISTEGSAKQLPNAYFLLPKVQSIQLSQMQAETTNTSLLQVQLECSLHNKVCQQLKGCYLESDDVLRLQMSIMVTMENFSKEFEENTQHLLDHLSIVYVATDESETSDDSAVNMYILHSGNSLIWIQDIRHFSQRDALSLQFEPVLLPTSTTNFTKIASFTCKATSCDSGIIEDVKKTTHTPTLKACLFSSVAQGYFRMDSSATQFHIETHENTSGLWSIWYRNHFDRSVVLNDVFLSKETKHMLKILNFTGPLFLPPGCWNIFSLKLAVKDIAINLFTNVFLTTNIGAIFAIPLQIYSAPTKEGSLGFEVIAHCGMHYFMGKSKAGNPNWNGSLSLDQSTWNVDSELANKLYERWKKYKNGDVCKRNVLGTTRFAHLKKSKESESFVFFLPRLIAEPGLMLNFSATALRSRMIKYFVVQNPSSWPVSLQLLPLSLYPKPEALVHLLHRWFGTDMQMINFTTGEFQLTEACPYLGTHSEESRFGILHLHLQPLEMKRVGVVFTPADYGKVTSLILIRNNLTVIDMIGVEGFGARELLKVGGRLPGAGGSLRFKVPESTLMDCRRQLKDSKQILSITKNFKVENIGPLPITVSSLKINGYNCQGYGFEVLDCHQFSLDPNTSRDISIVFTPDFTSSWVIRDLSLVTAADLEFRFTLNVTLPHHLLPLCADVVPGPSWEESFWRLTVFFVSLSLLGVILIAFQQAQYILMEFMKTRQRQNASSSSQQNNGPMDVISPHSYKSNCKNFLDTYGPSDKGRGKNCLPVNTPQSRIQNAAKRSPATYGHSQKKHKCSVYYSKHKTSTAAASSTSTTTEEKQTSPLGSSLPAAKEDICTDAMRENWISLRYASGINVNLQKNLTLPKNLLNKEENTLKNTIVFSNPSSECSMKEGIQTCMFPKETDIKTSENTAEFKERELCPLKTSKKLPENHLPRNSPQYHQPDLPEISRKNNGNNQQVPVKNEVDHCENLKKVDTKPSSEKKIHKTSREDMFSEKQDIPFVEQEDPYRKKKLQEKREGNLQNLNWSKSRTCRKNKKRGVAPVSRPPEQSDLKLVCSDFERSELSSDINVRSWCIQESTREVCKADAEIASSLPAAQREAEGYYQKPEKKCVDKFCSDSSSDCGSSSGSVRASRGSWGSWSSTSSSDGDKKPMVDAQHFLPAGDSVSQNDFPSEAPISLNLSHNICNPMTVNSLPQYAEPSCPSLPAGPTGVEEDKGLYSPGDLWPTPPVCVTSSLNCTLENGVPCVIQESAPVHNSFIDWSATCEGQFSSAYCPLELNDYNAFPEENMNYANGFPCPADVQTDFIDHNSQSTWNTPPNMPAAWGHASFISSPPYLTSTRSLSPMSGLFGSIWAPQSDVYENCCPINPTTEHSTHMENQAVVCKEYYPGFNPFRAYMNLDIWTTTANRNANFPLSRDSSYCGNV

SEQ ID NO: 2284 - protein, 916 aa, unidentified
METSQETSLFLVKILEELDSKQNTVSYQDLCKSLCARFDLSQLAKLRSVLFYTACLDPNFPATLFKDKMKCTVNNQQSKKIMVAADIVTIFNLIQMNGGAAKEKLPTGRQKVRKKEASFESCRSDTEICNAAECEPLNCELSERSFSRGYPIRQSSKCRKMDCKDCPQFVPASEPNFLLGVSKEVKNRAASLDRLQALAPYSVTSPQPCEMQRTYFPMNIENESISDQDSLPINQSIKETFISNEEPFVVQSCVQKRNIFKEDFHNLMAVSPSLVGPISKAENEHREPQSRKEPHKPPFFNHSFEMPYNSQYLNPVYSPVPDKRRAKHESLDDLQASTYFGPTPVMGTQEARRCLGKPNKQTPWPAKSWSLNTEEVPDFERSFFNRNPSEEKLHYPNASSQTPNFPAPERRPTYLVPKDQQPILPIAYAAKQNGLKSKEISSPVDLEKHEPVKKFKDKSINCTSGQLSSDTSSVGTQTEHVLEPKKCRDLCTSGQGKYSDRHTMKHSDDDSEIVSDDISDIFRFLDDMSISGSTGVIQSSCYNSTGSLSQLHKSDCDSSPEHNLTKIANGVPNSKGDKGNRPENTHHSEEELKTSVCKLVLRIGEIERKLESLSGVRDEISQVLGKLNKLDQKMQQPEKVSVQIDLNSLTSEGPSDDSASPRMFHAHSGSHGPKLENNPDWCCSDASGSNSESLRVKALKKSLFTRPSSRSLTEENSATESKIASISNSPRDWRTITYTNRVGLNEEEIKDTGPGDNKDWHRKSKEADRQYDIPPQHRLPKQPKDGFLVEQVFSPHPYPASLKAHMKSNPLYTDMRLTELAEVKRGQPSWTIEEYARNAGDKGKLTALDLQTQESLNPNNLEYWMEDIYTPGYDSLLKRKEAEFRRAKVCKIAALIAAAACTVILVIVVPICTMKS

SEQ ID NO: 2285 - protein, 190 aa, unidentified
MDLSVLPNNNHPDKFLQLDVKSLTRSSALLQASLVRFPGGNYPAAQHWQNLVYSQREKKNIAAQRIRGSSADSLVTADSPPPSMSSVMKNNPLYGDLSLEEAMEERKKNPSWTIEEYDKHSLHTNLSGHLKENPNDLRFWLGDMYTPGFDTLLKKEEKQEKHSKFCRMGLILLVVISILVTIVTIITFFT

SEQ ID NO: 2286 - protein, 5005 aa, unidentified
MDQRKNESIVPSITQLEDFLTEHNSNVVWLLVATILSCGWIIYLTYYNSRNVGLILTLVLNRLYKHGYIHIGSFSFSVLSGKVMVREIYYITEDMSIRIQDGFIIFRWWKMYNPKQKQHDPKAETRLYITVNDFEFHVYNRSDLYGRLQELFGLEPTIIPPKKDDDKTREIGRTRTQSKIERVKVKTESQDPTSSWRSLIPVIKVNVSTGRLAFGNHYQPQTLCINFDDAFLTYTTKPPSSHLDQFMHIVKGKLENVRVMLVPSPRYVGLQNDEPPRLMGEGFVVMQSNDVDIYYYMDEPGLVPEETEENIEGEMSSEDCKLQDLPPCWGLDIVCGKGTDFNYGPWADRQRDCLWKFFFPPDYQVLKVSEIAQPGRPRQILAFELRMNIIADATIDLLFTKNRETNAVHVNVGAGSYLEINIPMTVEENGYTPAIKGQLLHVDATTSMQYRTLLEAEMLAFHINASYPRIWNMPQTWQCELEVYKATYHFIFAQKNFFTDLIQDWSSDSPPDIFSFVPYTWNFKIMFHQFEMIWAANQHNWIDCSTKQQENVYLAACGETLNIDFSLPFTDFVPATCNTKFSLRGEDVDLHLFLPDCHPSKYSLFMLVKNCHPNKMIHDTGIPAECQSGQKTVKPKWRNVTQEKSGWVECWTVPSVMLTIDYTWHPIYPQKADEQLKQSLSEMEETMLSVLRPSQKTSDRVVSSPSTSSRPPIDPSELPPDKLHVEMELSPDSQITLYGPLLNAFLCIKENYFGEDDMYMDFEEVISSPVLSLSTSSSSGWTAVGMENDKKENEGSAKSIHPLALRPWDITVLVNLYKVHGRLPVHGTTDGPECPTAFLERLCFEMKKGFRETMLQLILSPLNVFVSDNYQQRPPVDEVLREGHINLSGLQLRAHAMFSAEGLPLGSDSLEYAWLIDVQAGSLTAKVTAPQLACLLEWGQTFVFHVVCREYELERPKSVIICQHGIDRRFCESKLSCIPGPCPTSDDLKYTMIRLAVDGADIYIVEHGCATNIKMGAIRVANCNLHNQSVGEGISAAIQDFQVRQYIEQLNNCRIGLQPAVLRRAYWLEAGSANLGLITVDIALAADHHSKHEAQRHFLETHDARTKRLWFLWPDDILKNKRCRNKCGCLGGCRFFGGTVTGLDFFKLEELTPSSSSAFSSTSAESDMYYGQSLLQPGEWIITKEIPKIIDGNVNGMKRKEWENKSVGIEVERKTQHLSLQVPLRSHSSSSSSEENSSSSAAQPLLAGEKESPSSVADDHLVQKEFLHGTKRDDGQASIPTEISGNSPVSPNTQDKSVGQSPLRSPLKRQASVCSTRLGSTKSLTAAFYGDKQPVTVGVQFSSDVSRSDENVLDSPKQRRSFGSFPYTPSADSNSFHQYRSMDSSMSMADSEAYFSAAEEFEPISSDEGPGTYPGRKKKKKQTQQIDYSRGSIYHSVEGPLTGHGESIQDSRTLPFKTHPSQASFVSALGGEDDVIEHLYIVEGEKTVESEQITPQQPVMNCYQTYLTQFQVINWSVKHPTNKRTSKSSLHRPLDLDTPTSEESSSSFEQLSVPTFKVIKQGLTANSLLDRGMQLSGSTSNTPYTPLEKKLADNTDDETLTEEWTLDQPVSQTRTTAIVEVKGTVDIVLTPLVAEALDRYIEAMVHCASTRHPAAIVDDLHAKVLREAVQNSKTTFSENLSSKQDIRGTKTEQSTIGTTNQGQAQTNLTMKQDNVTIKGLQTNVSIPKVNLCLLQASVEESPTTAPSRSVTHVSLVALCFDRIATQVRMNRGVVEETSNNAEPGRTSNFDRYVHATKMQPQSSGSLRSNAGAEKGKEIAAKLNIHRVHGQLRGLDTTDIGTCAITAIPFEKSKVLFTLEELDEFTFVDETDQQAVPDVTRIGPSQEKWGWIMFECGLENLTIKGGRQSGAVLYNSFGIMGKASDTERGGVLTSNNSSDSPTGSGYNTDVSDDNLPCDRTSPSSDLNGNSVSDEQDEGVESDDLKKDLPLMPPPPDSCSMKLTIKEIWFSFAAPTNVRSHTHAFSRQLNLLSTATPAVGAWLVPIDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTFPEETELDLLSVTIEGPSHYSSNSEGSCSVFSSPKTPGGFSPGIPFQTEEGRRDDSLSSTSEDSEKDEKDEDHERERFYIYRKPSHTSRKKATGFAAVHQLFTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYGMKDSATSPPSPPLPSTVQSKTNTLLPPQPPPIPAAKGKGSGGVKTAKLYAWVALQSLPEEMVISPCLLDFLEKALETIPITPVERNYTAVSSQDEDMGHFEIPDPMEESTTSLVSSSTSAYSSFPVDVVVYVRVQPSQIKFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISAVCDIGSASFKYDMRRLSEILAFPRAWYRRSIARRLFLGDQTINLPTSGPGTPDSIEGVSQHLSPESSRKAYCKTWEQPSQSASFTHMPQSPNVFNEHMTNSTMSPGTVGQSLKSPASIRSRSVSDSSVPRRDSLSKTSTPFNKSNKAASQQGTPWETLVVFAINLKQLNVQMNMSNVMGNTTWTTSGLKSQGRLSVGSNRDREISMSVGLGRSQLDSKGGVVGGTIDVNALEMVAHISEHPNQQPSHKIQITMGSTEARVDYMGSSILMGIFSNADLKLQDEWKVNLYNTLDSSITDKSEIFVHGDLKWDIFQVMISRSTTPDLIKIGMKLQEFFTQQFDTSKRALSTWGPVPYLPPKTMTSNLEKSSQEQLLDAAHHRHWPGVLKVVSGCHISLFQIPLPEDGMQFGGSMSLHGNHMTLACFHGPNFRSKSWALFHLEEPNIAFWTEAQKIWEDGSSDHSTYIVQTLDFHLGHNTMVTKPCGALESPMATITKITRRRHENPPHGVASVKEWFNYVTATRNEELNLLRNVDANNTENSTTVKNSSLLSGFRGGSSYNHETETIFALPRMQLDFKSIHVQEPQEPSLQDASLKPKVECSVVTEFTDHICVTMDAELIMFLHDLVSAYLKEKEKAIFPPRILSTRPGQKSPIIIHDDNSSDKDREDSITYTTVDWRDFMCNTWHLEPTLRLISWTGRKIDPVGVDYILQKLGFHHARTTIPKWLQRGVMDPLDKVLSVLIKKLGTALQDEKEKKGKDKEEH

SEQ ID NO: 2287 - protein, 714 aa, unidentified
MLQNPQEKSQAYPRRRRPGCYAYRQNPEAIAAAAMYTFLPDNFSPAKPKPSKDLKPLLGSAVLGLLLVLAAVVAWCYYSVSLRKAERLRAELLDLKAGGFSIRNQKGEQVFRLAFRSGALDLDSCSRDGALLGCSLTADGLPLHFFIQTVRPKDTVMCYRVRWEEAAPGRAVEHAMFLGDAAAHWYGGAEMRTQHWPIRLDGQQEPQPFVTSDVYSSDAAFGGILERYWLSSRAAAIKVNDSVPFHLGWNSTERSLRLQARYHDTPYKPPAGRAAAPELSYRVCVGSDVTSIHKYMVRRYFNKPSRVPAPEAFRDPIWSTWALYGRAVDQDKVLRFAQQIRLHHFNSSHLEIDDMYTPAYGDFDFDEVKFPNASDMFRRLRDAGFRVTLWVHPFVNYNSSRFGEGVERELFVREPTGRLPALVRWWNGIGAVLDFTHPKARDWFQGHLRRLRSRYSVASFKFDAGEVSYLPRDFSTYRPLPDPSVWSRRYTEMALPFFSLAEVRVGYQSQNISCFFRLVDRDSVWGYDLGLRSLIPAVLTVSMLGYPFILPDMVGGNAVPQRTAGGDVPERELYIRWLEVAAFMPAMQFSIPPWRYDAEVVAIAQKFAALRASLVAPLLLELAGEVTDTGDPIVRPLWWIAPGDETAHRIDSQFLIGDTLLVAPVLEPGKQERDVYLPAGKWRSYKGELFDKTPVLLTDYPVDLDEIAYFTWAS

SEQ ID NO: 2288 - protein, 1013 aa, unidentified
MAEPGHSHHLSARVRGRTERRIPRLWRLLLWAGTAFQVTQGTGPELHACKESEYHYEYTACDSTGSRWRVAVPHTPGLCTSLPDPIKGTECSFSCNAGEFLDMKDQSCKPCAEGRYSLGTGIRFDEWDELPHGFASLSANMELDDSAAESTGNCTSSKWVPRGDYIASNTDECTATLMYAVNLKQSGTVNFEYYYPDSSIIFEFFVQNDQCQPNADDSRWMKTTEKGWEFHSVELNRGNNVLYWRTTAFSVWTKVPKPVLVRNIAITGVAYTSECFPCKPGTYADKQGSSFCKLCPANSYSNKGETSCHQCDPDKYSEKGSSSCNVRPACTDKDYFYTHTACDANGETQLMYKWAKPKICSEDLEGAVKLPASGVKTHCPPCNPGFFKTNNSTCQPCPYGSYSNGSDCTRCPAGTEPAVGFEYKWWNTLPTNMETTVLSGINFEYKGMTGWEVAGDHIYTAAGASDNDFMILTLVVPGFRPPQSVMADTENKEVARITFVFETLCSVNCELYFMVGVNSRTNTPVETWKGSKGKQSYTYIIEENTTTSFTWAFQRTTFHEASRKYTNDVAKIYSINVTNVMNGVASYCRPCALEASDVGSSCTSCPAGYYIDRDSGTCHSCPTNTILKAHQPYGVQACVPCGPGTKNNKIHSLCYNDCTFSRNTPTRTFNYNFSALANTVTLAGGPSFTSKGLKYFHHFTLSLCGNQGRKMSVCTDNVTDLRIPEGESGFSKSITAYVCQAVIIPPEVTGYKAGVSSQPVSLADRLIGVTTDMTLDGITSPAELFHLESLGIPDVIFFYRSNDVTQSCSSGRSTTIRVRCSPQKTVPGSLLLPGTCSDGTCDGCNFHFLWESAAACPLCSVADYHAIVSSCVAGIQKTTYVWREPKLCSGGISLPEQRVTICKTIDFWLKVGISAGTCTAILLTVLTCYFWKKNQKLEYKYSKLVMNATLKDCDLPAADSCAIMEGEDVEDDLIFTSKKSLFGKIKSFTSKRTPDGFDSVPLKTSSGGLDMDL

SEQ ID NO: 2289 - protein, 1029 aa, unidentified
MLFRARGPVRGRGWGRPAEAPRRGRSPPWSPAWICCWALAGCQAAWAGDLPSSSSRPLPPCQEKDYHFEYTECDSSGSRWRVAIPNSAVDCSGLPDPVRGKECTFSCASGEYLEMKNQVCSKCGEGTYSLGSGIKFDEWDELPAGFSNIATFMDTVVGPSDSRPDGCNNSSWIPRGNYIESNRDDCTVSLIYAVHLKKSGYVFFEYQYVDNNIFFEFFIQNDQCQEMDTTTDKWVKLTDNGEWGSHSVMLKSGTNILYWRTTGILMGSKAVKPVLVKNITIEGVAYTSECFPCKPGTFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRCNPTKSGAGVISVPSKCPAGTCDGCTFYFLWESAEACPLCTEHDFHEIEGACKRGFQETLYVWNEPKWCIKGISLPEKKLATCETVDFWLKVGAGVGAFTAVLLVALTCYFWKKNQKLEYKYSKLVMTTNSKECELPAADSCAIMEGEDNEEEVVYSNKQSLLGKLKSLATKEKEDHFESVQLKTSRSPNI

SEQ ID NO: 2290 - protein, 1216 aa, unidentified
MAAMAPGGSGSGGGVNPFLSDSDEDDDEVAATEERRAVLRLGAGSGLDPGSAGSLSPQDPVALGSSARPGLPGEASAAAVALGGTGETPARLSIDAIAAQLLRDQYLLTALELHTELLESGRELPRLRDYFSNPGNFERQSGTPPGMGAPGVPGAAGVGGAGGREPSTASGGGQLNRAGSISTLDSLDFARYSDDGNRETDEKVAVLEFELRKAKETIQALRANLTKAAEHEVPLQERKNYKSSPEIQEPIKPLEKRALNFLVNEFLLKNNYKLTSITFSDENDDQDFELWDDVGLNIPKPPDLLQLYRDFGNHQVTGKDLVDVASGVEEDELEALTPIISNLPPTLETPQPAENSMLVQKLEDKISLLNSEKWSLMEQIRRLKSEMDFLKNEHFAIPAVCDSVQPPLDQLPHKDSEDSGQHPDVNSSDKGKNTDIHLSISDEADSTIPKENSPNSFPRREREGMPPSSLSSKKTVHFDKPNRKLSPAFHQALLSFCRMSADSRLGYEVSRIADSEKSVMLMLGRCLPHIVPNVLLAKREELIPLILCTACLHPEPKERDQLLHILFNLIKRPDDEQRQMILTGCVAFARHVGPTRVEAELLPQCWEQINHKYPERRLLVAESCGALAPYLPKEIRSSLVLSMLQQMLMEDKADLVREAVIKSLGIIMGYIDDPDKYHQGFELLLSALGDPSERVVSATHQVFLPAYAAWTTELGNLQSHLILTLLNKIEKLLREGEHGLDEHKLHMYLSALQSLIPSLFALVLQNAPFSSKAKLHGEVPQIEVTRFPRPMSPLQDVSTIIGSREQLAVLLQLYDYQLEQEGTTGWESLLWVVNQLLPQLIEIVGKINVTSTACVHEFSRFFWRLCRTFGKIFTNTKVKPQFQEILRLSEENIDSSAGNGVLTKATVPIYATGVLTCYIQEEDRKLLVGFLEDVMTLLSLSHAPLDSLKASFVELGANPAYHELLLTVLWYGVVHTSALVRCTAARMFELTLRGMSEALVDKRVAPALVTLSSDPEFSVRIATIPAFGTIMETVIQRELLERVKMQLASFLEDPQYQDQHSLHTEIIKTFGRVGPNAEPRFRDEFVIPHLHKLALVNNLQIVDSKRLDIATHLFEAYSALSCCFISEDLMVNHFLPGLRCLRTDMEHLSPEHEVILSSMIKECEQKVENKTVQEPQGSMSIAASLVSEDTKTKFLNKMGQLTTSGAMLANVFQRKK

SEQ ID NO: 2291 - protein, 905 aa, unidentified [sequence omitted]

SEQ ID NO: 2292 - protein, 1950 aa, unidentified
MPGARRRRRGAAMEGKPRAGVALAPGPSGRRPSARCARRRRPGLLLPGLWLLLLARPASCAPDELSPEQHNLSLYSMELVLKKSTGHSAAQVALTETAPGSQHSSPLHVTAPPSATTFDTAFFNQGKQTKSTADPSIFVATYVSVTSKEVAVNDDEMDNFLPDTHWTTPRMVSPIQYITVSPPGLPREALEPMLTPSLPMVSLQDEEVTSGWQNTTRQPAAYAESASHFHTFRSAFRTSEGIVPTPGRNLVLYPTDAYSHLSSRTLPEIVASLTEGVETTLFLSSRSLMPQPLGDGITIPLPSLGEVSQPPEEVWATSADRYTDVTTVLSQSLEETISPRTYPTVTASHAALAFSRTHSPLLSTPLAFASSASPTDVSSNPFLPSDSSKTSELHSNSALPGPVDNTHILSPVSSFRPYTWCAACTVPSPQQVLATSLMEKDVGSGDGAETLCMTVLEESSISLMSSVVADFSEFEEDPQVFNTLFPSRPIVPLSSRSMEISETSVGISAEVDMSSVTTTQVPPAHGRLSVPASLDPTAGSLSVAETQVTPSSVTTAFFSVITSILLDSSFSVIANKNTPSLAVRDPSVFTPYSLVPSVESSLFSDQERSSFSEHKPRGALDFASSFFSTPPLELSGSISSPSEAPASLSLMPSDLSPFTSQSFSPLVETFTLFDSSDLQSSQLSLPSSTNLEFSQLQPSSELPLNTIMLLPSRSEVSPWSSFPSDSLEFVEASTVSLTDSEAHFTSAFIETTSYLESSLISHESAVTALVPPGSESFDILTAGIQATSPLTTVHTTPILTESSLFSTLTPPDDQISALDGHVSVLASFSKAIPTGTVLITDAYLPSGSSFVSEATPFPLPTELTVVGPSLTPTEVPLNTSTEVSTTSTGAATGGPLDSTLMGDAASQSPPESSAAPPLPSLRPVTAFTLEATVDTPTLATAKPPYVCDITVPDAYLITTVLARRAVQEYIITAIKEVLRIHFNRAVELKVYELFTDFTFLVTSGPFVYTAISVINVLINSKLVRDQTPLILSVKPSFLVPESRFQVQTVLQFVPPSVDTGFCNFTQRIEKGLMTALFEVRKHHQGTYNLTVQILNITISSSRVTPRRGPVNIIFAVKSTQGFLNGSEVSELLRNLSVVEFSFYLGYPVLQIAEPFQYPQLNLSQLLKSSWVRTVLLGVMEKQLQNEVFQAEMERKLAQLLSEVSTRRRMWRRATVAAGNSVVQVVNVSRLEGDDNPVQLIYFVEDQDGERLSAVKSSDLINKMDLQRAAIILGYRIQGVIAQPVDRVKRPSPESQSNNLWVIVGVVIPVLVVMVIVVILYWKLCRTDKLDFQPDTVANIQQRQKLQIPSVKGFDFAKQHLGQHNKDDILIIHEPAPLPGPLKDHTTPSENGDVPSPKSKIPSKNVRHRGRVSPSDADSTVSEESSERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRIKRSPKPRRKHQVNGCPADAEKDRLITTDSDGTYRRPPGVHNSAYIGCPSDPDLPADVQTPSSVELGRYPALPFPASQYIPPQPSIEEARQTMHSLLDDAFALVAPSSQPASTAGVGPGVPPGLPANSTPSQEERRATQWGSFYSPAQTANNPCSRYEDYGMTPPTGPLPRPGFGPGLLQSTELVPPDPQQPQASAEAPFAARGIYSEEMPSVARPRPVGGTTGSQIQHLTQVGIASRIGAQPVEIPPSRGSQYGGPGWPSYGEDEAGRREATHMLGHQEYSSSPLFQVPRTSGREPSAPSGNLPHRGLQGPGLGYPTSSTEDLQPGHSSASLIKAIREELLRLSQKQSTVQNFHS

SEQ ID NO: 2293 - protein, 1849 aa, unidentified
MDHTASQNAQDLIGIPHLGVSGSSTKWHSELSPTEGPHSAGSSTPGFLSPMAELSHPSPPPPALGSLLQLPDGSPSWSMLEVASGPASTQQIKAGVPGRVHNGVSLPTFKNTETATHEAEPPLFQTAESGAIEMTSRKLASATANDSANPLHLSAAPENSRGPALSAEHTSSLVPSLHITTLGQEQAILSGAVPASPSTGTADFPSILTFLQPTENHASPSPVPEMPTLPAEGSDGSPPATRDLLLSSKVPNLLSTSWTFPRWKKDSVTAILGKNEEANVTIPLQAFPRKEVLSLHTVNGFVSDFSTGSVSSPIITAPRTNPLPSGPPLPSILSIQATQTVFPSLGFSSTKPEAYAAAVDHSGLPASASKQVRASPSSMDVYDSLTIGDMKKPATTDVFWSSLSAETGSLSTESIISGLQQQTNYDLNGHTISTTSWETHLAPTAPPNGLTSAADAIKSQDFKDTAGHSVTAEGFSIQDLVLGTSIEQPVQQSDMTMVGSHIDLWPTSNNNHSRDFQTAEVAYYSPTTRHSVSHPQLQLPNQPAHPLLLTSPGPTSTGSLQEMLSDGTDTGSEISSDINSSPERNASTPFQNILGYHSAAESSISTSVFPRTSSRVLRASQHPKKWTADTVSSKVQPTAAAAVTLFLRKSSPPALSAALVAKGTSSSPLAVASGPAKSSSMTTLAKNVTNKAASGPKRTPGAVHTAFPFTPTYMYARTGHTTSTHTAMQGNMDTASGLLSTTYLPRKPQAMHTGLPNPTNLEMPRASTPRPLTVTAALTSITASVKATRLPPLRAENTDAVLPAASAAVVTTGKMASNLECQMSSKLLVKTVLFLTQRRVQISESLKFSIAKGLTQALRKAFHQNDVSAHVDILEYSHNVTVGYYATKGKLVYLPAVVIEMLGVYGVSNVTADLKQHTPHLQSVAVLASPWNPQPAGYFQLKTVLQFVSQADNIQSCKFAQTMEQRLQKAFQDAERKVLNTKSNLTIQIVSTSNASQAVTLVYVVGNQSTFLNGTVASSLLSQLSAELVGFYLTYPPLTIAEPLEYPNLDISETTRDYWVITVLQGVDNSLVGLHNQSFARVMEQRLAQLFMMSQQQGRRFKRATTLGSYTVQMVKMQRVPGPKDPAELTYYTLYNGKPLLGTAAAKILSTIDSQRMALTLHHVVLLQADPVVKNPPNNLWIIAAVLAPIAVVTVIIIIITAVLCRKNKNDFKPDTMINLPQRAKPVQGFDYAKQHLGQQGADEEVIPVTQETVVLPLPIRDAPQERDVAQDGSTIKTAKSTETRKSRSPSENGSVISNESGKPSSGRRSPQNVMAQQKVTKEEARKRNVPASDEEEGAVLFDNSSKVAAEPFDTSSGSVQLIAIKPTALPMVPPTSDRSQESSAVLNGEVNKALKQKSDIEHYRNKLRLKAKRKGYYDFPAVETSKGLTERKKMYEKAPKEMEHVLDPDSELCAPFTESKNRQQMKNSVYRSRQSLNSPSPGETEMDLLVTRERPRRGIRNSGYDTEPEIIEETNIDRVPEPRGYSRSRQVKGHSETSTLSSQPSIDEVRQQMHMLLEEAFSLASAGHAGQSRHQEAYGSAQHLPYSEVVTSAPGTMTRPRAGVQWVPTYRPEMYQYSLPRPAYRFSQLPEMVMGSPPPPVPPRTGPVAVASLRRSTSDIGSKTRMAESTGPEPAQLHDSASFTQMSRGPVSVTQLDQSALNYSGNTVPAVFAIPAANRPGFTGYFIPTPPSSYRNQAWMSYAGENELPSQWADSVPLPGYIEAYPRSRYPQSSPSRLPRQYSQPANLHPSLEQAPAPSTAASQQSLAENDPSDAPLTNISTAALVKAIREEVAKLAKKQTDMFEFQV

SEQ ID NO: 2294 - protein, 199 aa, unidentified
MTSCGQQSLNVLAVLFSLLFSAVLSAHFRVCEPYTDHKGRYHFGFHCPRLSDNKTFILCCHHNNTVFKYCCNETEFQAVMQANLTASSEGYMHNNYTALLGVWIYGFFVLMLLVLDLLYYSAMNYDICKVYLARWGIQGRWMKQDPRRWGNPARAPRPGQRAPQPQPPPGPLPQAPQAVHTLRGDAHSPPLMTFQSSSA

SEQ ID NO: 2295 - protein, 634 aa, unidentified
MWLQQRLKGLPGLLSSSWARRLLCLLGLLLLLLWFGGSGARRAAGGLHLLPWSRGEPGAAEPSACLEAATRAWRGLRERGEVVPLGPGVPALVANGFLALDVAANRLWVTPGEREPAVAPDFVPFVQLRPLSALAEAGEAVLLLREGLLRRVRCLQLGSPGPGPVAAGPGPASVSGLAAGSGRDCVLLQEDFLAHRGRPHVYLQRIQLNNPTERVAALQTVGPTAGPAPKAFTSTLEKVGDHQFLLYSGRSPPTPTGLVHLVVVAAKKLVNRLQVAPKTQLDETVLWVVHVSGPINPQVLKSKAAKELKALQDLARKEMLELLDMPAAELLQDHQLLWAQLFSPGVEMKKITDTHTPSGLTVNLTLYYMLSCSPAPLLSPSLSHRERDQMESTLNYEDHCFSGHATMHAENLWPGRLSSVQQILQLSDLWRLTLQKRGCKGLVKVGAPGILQGMVLSFGGLQFTENHLQFQADPDVLHNSYALHGIRYKNDHINLAVLADAEGKPYLHVSVESRGQPVKIYACKAGCLDEPVELTSAPTGHTFSVMVTQPITPLLYISTDLTHLQDLRHTLHLKAILAHDEHMAQQDPGLPFLFWFSVASLITLFHLFLFKLIYNEYCGPGAKPLFRSKEDPSV

SEQ ID NO: 2296 - protein, 1771 aa, unidentified
MSVLISQSVINYVEEENIPALKALLEKCKDVDERNECGQTPLMIAAEQGNLEIVKELIKNGANCNLEDLDNWTALISASKEGHVHIVEELLKCGVNLEHRDMGGWTALMWACYKGRTDVVELLLSHGANPSVTGLYSVYPIIWAAGRGHADIVHLLLQNGAKVNCSDKYGTTPLVWAARKGHLECVKHLLAMGADVDQEGANSMTALIVAVKGGYTQSVKEILKRNPNVNLTDKDGNTALMIASKEGHTEIVQDLLDAGTYVNIPDRSGDTVLIGAVRGGHVEIVRALLQKYADIDIRGQDNKTALYWAVEKGNATMVRDILQCNPDTEICTKDGETPLIKATKMRNIEVVELLLDKGAKVSAVDKKGDTPLHIAIRGRSRKLAELLLRNPKDGRLLYRPNKAGETPYNIDCSHQKSILTQIFGARHLSPTETDGDMLGYDLYSSALADILSEPTMQPPICVGLYAQWGSGKSFLLKKLEDEMKTFAGQQIEPLFQFSWLIVFLTLLLCGGLGLLFAFTVHPNLGIAVSLSFLALLYIFFIVIYFGGRREGESWNWAWVLSTRLARHIGYLELLLKLMFVNPPELPEQTTKALPVRFLFTDYNRLSSVGGETSLAEMIATLSDACEREFGFLATRLFRVFKTEDTQGKKKWKKTCCLPSFVIFLFIIGCIISGITLLAIFRVDPKHLTVNAVLISIASVVGLAFVLNCRTWWQVLDSLLNSQRKRLHNAASKLHKLKSEGFMKVLKCEVELMARMAKTIDSFTQNQTRLVVIIDGLDACEQDKVLQMLDTVRVLFSKGPFIAIFASDPHIIIKAINQNLNSVLRDSNINGHDYMRNIVHLPVFLNSRGLSNARKFLVTSATNGDVPCSDTTGIQEDADRRVSQNSLGEMTKLGSKTALNRRDTYRRRQMQRTITRQMSFDLTKLLVTEDWFSDISPQTMRRLLNIVSVTGRLLRANQISFNWDRLASWINLTEQWPYRTSWLILYLEETEGIPDQMTLKTIYERISKNIPTTKDVEPLLEIDGDIRNFEVFLSSRTPVLVARDVKVFLPCTVNLDPKLREIIADVRAAREQISIGGLAYPPLPLHEGPPRAPSGYSQPPSVCSSTSFNGPFAGGVVSPQPHSSYYSGMTGPQHPFYNRPFFAPYLYTPRYYPGGSQHLISRPSVKTSLPRDQNNGLEVIKEDAAEGLSSPTDSSRGSGPAPGPVVLLNSLNVDAVCEKLKQIEGLDQSMLPQYCTTIKKANINGRVLAQCNIDELKKEMNMNFGDWHLFRSTVLEMRNAESHVVPEDPRFLSESSSGPAPHGEPARRASHNELPHTELSSQTPYTLNFSFEELNTLGLDEGAPRHSNLSWQSQTRRTPSLSSLNSQDSSIEISKLTDKVQAEYRDAYREYIAQMSQLEGGPGSTTISGRSSPHSTYYMGQSSSGGSIHSNLEQEKGKDSEPKPDDGRKSFLMKRGDVIDYSSSGVSTNDASPLDPITEEDEKSDQSGSKLLPGKKSSERSSLFQTDLKLKGSGLRYQKLPSDEDESGTEESDNTPLLKDDKDRKAEGKVERVPKSPEHSAEPIRTFIKAKEYLSDALLDKKDSSDSGVRSSESSPNHSLHNEVADDSQLEKANLIELEDDSHSGKRGIPHSLSGLQDPIIARMSICSEDKKSPSECSLIASSPEENWPACQKAYNLNRTPSTVTLNNNSAPANRANQNFDEMEGIRETSQVILRPSSSPNPTTIQNENLKSMTHKRSQRSSYTRLSKDPPELHAAASSESTGFGEERESIL

SEQ ID NO: 2297 - protein, 348 aa, unidentified [sequence omitted]

SEQ ID NO: 2298 - protein, 341 aa, unidentified
MSLMVVSMVCVGFFLLQGAWPHEGVHRKPSLLAHPGPLVKSEETVILQCWSDVRFQHFLLHREGKFKDTLHLIGEHHDGVSKANFSIGPMMQDLAGTYRCYGSVTHSPYQLSAPSDPLDIVITGLYEKPSLSAQPGPTVLAGESVTLSCSSRSSYDMYHLSREGEAHERRFSAGPKVNGTFQADFPLGPATHGGTYRCFGSFRDSPYEWSNSSDPLLVSVTGNPSNSWPSPTEPSSETGNPRHLHVLIGTSVVIILFILLLFFLLHRWCCNKKNAVVMDQEPAGNRTVNREDSDEQDPQEVTYAQLNHCVFTQRKITRPSQRPKTPPTDIIVYTELPNAEP

SEQ ID NO: 2299 - protein, 377 aa, unidentified
MSMSPTVIILACLGFFLDQSVWAHVGGQDKPFCSAWPSAVVPQGGHVTLRCHYRRGFNIFTLYKKDGVPVPELYNRIFWNSFLISPVTPAHAGTYRCRGFHPHSPTEWSAPSNPLVIMVTGLYEKPSLTARPGPTVRAGENVTLSCSSQSSFDIYHLSREGEAHELRLPAVPSINGTFQADFPLGPATHGETYRCFGSFHGSPYEWSDPSDPLPVSVTGNPSSSWPSPTEPSFKTGIARHLHAVIRYSVAIILFTILPFFLLHRWCSKKKDAAVMNQEPAGHRTVNREDSDEQDPQEVTYAQLDHCIFTQRKITGPSQRSKRPSTDTSVCIELPNAEPRALSPAHEHHSQALMGSSRETTALSQTQLASSNVPAAGI

SEQ ID NO: 2300 - protein, 444 aa, unidentified
MSLMVVSMACVGLFLVQRAGPHMGGQDKPFLSAWPSAVVPRGGHVTLRCHYRHRFNNFMLYKEDRIHIPIFHGRIFQESFNMSPVTTAHAGNYTCRGSHPHSPTGWSAPSNPVVIMVTGNHRKPSLLAHPGPLVKSGERVILQCWSDIMFEHFFLHKEGISKDPSRLVGQIHDGVSKANFSIGPMMLALAGTYRCYGSVTHTPYQLSAPSDPLDIVVTGPYEKPSLSAQPGPKVQAGESVTLSCSSRSSYDMYHLSREGGAHERRLPAVRKVNRTFQADFPLGPATHGGTYRCFGSFRHSPYEWSDPSDPLLVSVTGNPSSSWPSPTEPSSKSGNPRHLHILIGTSVVIILFILLLFFLLHLWCSNKKNAAVMDQEPAGNRTANSEDSDEQDPEEVTYAQLDHCVFTQRKITRPSQRPKTPPTDTILYTELPNAKPRSKVVSCP

SEQ ID NO: 2301 - protein, 455 aa, unidentified
MSLTVVSMACVGFFLLQGAWPLMGGQDKPFLSARPSTVVPRGGHVALQCHYRRGFNNFMLYKEDRSHVPIFHGRIFQESFIMGPVTPAHAGTYRCRGSRPHSLTGWSAPSNPLVIMVTGNHRKPSLLAHPGPLLKSGETVILQCWSDVMFEHFFLHREGISEDPSRLVGQIHDGVSKANFSIGPLMPVLAGTYRCYGSVPHSPYQLSAPSDPLDIVITGLYEKPSLSAQPGPTVQAGENVTLSCSSWSSYDIYHLSREGEAHERRLRAVPKVNRTFQADFPLGPATHGGTYRCFGSFRALPCVWSNSSDPLLVSVTGNPSSSWPSPTEPSSKSGICRHLHVLIGTSVVIFLFILLLFFLLYRWCSNKKNAAVMDQEPAGDRTVNRQDSDEQDPQEVTYAQLDHCVFIQRKISRPSQRPKTPLTDTSVYTELPNAEPRSKVVSCPRAPQSGLEGVF

SEQ ID NO: 2302 - protein, 410 aa, unidentified
MSLMVVSMACVGFFLLEGPWPHVGGQDKPFLSAWPGTVVSEGQHVTLQCRSRLGFNEFSLSKEDGMPVPELYNRIFRNSFLMGPVTPAHAGTYRCCSSHPHSPTGWSAPSNPVVIMVTGVHRKPSLLAHPGPLVKSGETVILQCWSDVRFERFLLHREGITEDPLRLVGQLHDAGSQVNYSMGPMTPALAGTYRCFGSVTHLPYELSAPSDPLDIVVVGLYGKPSLSAQPGPTVQAGENVTLSCSSRSLFDIYHLSREAEAGELRLTAVLRVNGTFQANFPLGPVTHGGNYRCFGSFRALPHAWSDPSDPLPVSVTGNSRHLHVLIGTSVVIIPFAILLFFLLHRWCANKKNAVVMDQEPAGNRTVNREDSDEQDPQEVTYAQLNHCVFTQRKITRPSQRPKTPPTDTSV

SEQ ID NO: 2303 - protein, 757 aa, unidentified
MLSLLVWILTLSDTFSQGTQTRFSQEPADQTVVAGQRAVLPCVLLNYSGIVQWTKDGLALGMGQGLKAWPRYRVVGSADAGQYNLEITDAELSDDASYECQATEAALRSRRAKLTVLIPPEDTRIDGGPVILLQAGTPHNLTCRAFNAKPAATIIWFRDGTQQEGAVASTELLKDGKRETTVSQLLINPTDLDIGRVFTCRSMNEAIPSGKETSIELDVHHPPTVTLSIEPQTVQEGERVVFTCQATANPEILGYRWAKGGFLIEDAHESRYETNVDYSFFTEPVSCEVHNKVGSTNVSTLVNVHFAPRIVVDPKPTTTDIGSDVTLTCVWVGNPPLTLTWTKKDSNMVLSNSNQLLLKSVTQADAGTYTCRAIVPRIGVAEREVPLYVNGPPIISSEAVQYAVRGDGGKVECFIGSTPPPDRIAWAWKENFLEVGTLERYTVERTNSGSGVLSTLTINNVMEADFQTHYNCTAWNSFGPGTAIIQLEEREVLPVGIIAGATIGASILLIFFFIALVFFLYRRRKGSRKDVTLRKLDIKVETVNREPLTMHSDREDDTASVSTATRVMKAIYSSFKDDVDLKQDLRCDTIDTREEYEMKDPTNGYYNVRAHEDRPSSRAVLYADYRAPGPARFDGRPSSRLSHSSGYAQLNTYSRGPASDYGPEPTPPGPAAPAGTDTTSQLSYENYEKFNSHPFPGAAGYPTYRLGYPQAPPSGLERTPYEAYDPIGKYATATRFSYTSQHSDYGQRFQQRMQTHV

SEQ ID NO: 2304 - protein, 708 aa, unidentified
MLRMRVPALLVLLFCFRGRAGPSPHFLQQPEDLVVLLGEEARLPCALGAYWGLVQWTKSGLALGGQRDLPGWSRYWISGNAANGQHDLHIRPVELEDEASYECQATQAGLRSRPAQLHVLVPPEAPQVLGGPSVSLVAGVPANLTCRSRGDARPTPELLWFRDGVLLDGATFHQTLLKEGTPGSVESTLTLTPFSHDDGATFVCRARSQALPTGRDTAITLSLQYPPEVTLSASPHTVQEGEKVIFLCQATAQPPVTGYRWAKGGSPVLGARGPRLEVVADASFLTEPVSCEVSNAVGSANRSTALDVLFGPILQAKPEPVSVDVGEDASFSCAWRGNPLPRVTWTRRGGAQVLGSGATLRLPSVGPEDAGDYVCRAEAGLSGLRGGAAEARLTVNAPPVVTALHSAPAFLRGPARLQCLVFASPAPDAVVWSWDEGFLEAGSQGRFLVETFPAPESRGGLGPGLISVLHISGTQESDFSRSFNCSARNRLGEGGAQASLGRRDLLPTVRIVAGVAAATTTLLMVITGVALCCWRHSKASASFSEQKNLMRIPGSSDGSSSRGPEEEETGSREDRGPIVHTDHSDLVLEEKGTLETKDPTNGYYKVRGVSVSLSLGEAPGGGLFLPPPSPLGPPGTPTFYDFNPHLGMVPPCRLYRARAGYLTTPHPRAFTSYIKPTSFGPPDLAPGTPPFPYAAFPTPSHPRLQTHV

SEQ ID NO: 2305 - protein, 778 aa, unidentified
MKPFQLDLLFVCFFLFSQELGLQKRGCCLVLGYMAKDKFRRMNEGQVYSFSQQPQDQVVVSGQPVTLLCAIPEYDGFVLWIKDGLALGVGRDLSSYPQYLVVGNHLSGEHHLKILRAELQDDAVYECQAIQAAIRSRPARLTVLVPPDDPVILGGPVISLRAGDPLNLTCHADNAKPAASIIWLRKGEVINGATYSKTLLRDGKRESIVSTLFISPGDVENGQSIVCRATNKAIPGGKETSVTIDIQHPPLVNLSVEPQPVLEDNVVTFHCSAKANPAVTQYRWAKRGQIIKEASGEVYRTTVDYTYFSEPVSCEVTNALGSTNLSRTVDVYFGPRMTTEPQSLLVDLGSDAIFSCAWTGNPSLTIVWMKRGSGVVLSNEKTLTLKSVRQEDAGKYVCRAVVPRVGAGEREVTLTVNGPPIISSTQTQHALHGEKGQIKCFIRSTPPPDRIAWSWKENVLESGTSGRYTVETISTEEGVISTLTISNIVRADFQTIYNCTAWNSFGSDTEIIRLKEQGSEMKSGAGLEAESVPMAVIIGVAVGAGVAFLVLMATIVAFCCARSQRNLKGVVSAKNDIRVEIVHKEPASGREGEEHSTIKQLMMDRGEFQQDSVLKQLEVLKEEEKEFQNLKDPTNGYYSVNTFKEHHSTPTISLSSCQPDLRPAGKQRVPTGMSFTNIYSTLSGQGRLYDYGQRFVLGMGSSSIELCEREFQRGSLSDSSSFLDTQCDSSVSSSGKQDGYVQFDKASKASASSSHHSQSSSQNSDPSRPLQRRMQTHV

SEQ ID NO: 2306 - protein, 398 aa, unidentified
MHTVATSGPNASWGAPANASGCPGCGANASDGPVPSPRAVDAWLVPLFFAALMLLGLVGNSLVIYVICRHKPMRTVTNFYIANLAATDVTFLLCCVPFTALLYPLPGWVLGDFMCKFVNYIQQVSVQATCATLTAMSVDRWYVTVFPLRALHRRTPRLALAVSLSIWVGSAAVSAPVLALHRLSPGPRAYCSEAFPSRALERAFALYNLLALYLLPLLATCACYAAMLRHLGRVAVRPAPADSALQGQVLAERAGAVRAKVSRLVAAVVLLFAACWGPIQLFLVLQALGPAGSWHPRSYAAYALKTWAHCMSYSNSALNPLLYAFLGSHFRQAFRRVCPCAPRRPRRPRRPGPSDPAAPHAELLRLGSHPAPARAQKPGSSGLAARGLCVLGEDNAPL

SEQ ID NO: 2307 - protein, 976 aa, unidentified [sequence omitted]

SEQ ID NO: 2308 - protein, 273 aa, unidentified
MKKTQTWILTCIYLQLLLFNPLVKTEGICRNRVTNNVKDVTKLVANLPKDYMITLKYVPGMDVLPSHCWISEMVVQLSDSLTDLLDKFSNISEGLSNYSIIDKLVNIVDDLVECVKENSSKDLKKSFKSPEPRLFTPEEFFRIFNRSIDAFKDFVVASETSDCVVSSTLSPEKDSRVSVTKPFMLPPVAASSLRNDSSSSNRKAKNPPGDSSLHWAAMALPALFSLIIGFAFGALYWKKRQPSLTRAVENIQINEEDNEISMLQEKEREFQEV

SEQ ID NO: 2309 - protein, 1012 aa, unidentified
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAPGIRGSPRLGYLVAHNLLLAHAKVWHLYNTSFRPTQGGQVSIALSSHWINPRRMTDHSIKECQKSLDFVLGWFAKPVFIDGDYPESMKNNLSSILPDFTESEKKFIKGTADFFALCFGPTLSFQLLDPHMKFRQLESPNLRQLLSWIDLEFNHPQIFIVENGWFVSGTTKRDDAKYMYYLKKFIMETLKAIKLDGVDVIGYTAWSLMDGFEWHRGYSIRRGLFYVDFLSQDKMLLPKSSALFYQKLIEKNGFPPLPENQPLEGTFPCDFAWGVVDNYIQVDTTLSQFTDLNVYLWDVHHSKRLIKVDGVVTKKRKSYCVDFAAIQPQIALLQEMHVTHFRFSLDWALILPLGNQSQVNHTILQYYRCMASELVRVNITPVVALWQPMAPNQGLPRLLARQGAWENPYTALAFAEYARLCFQELGHHVKLWITMNEPYTRNMTYSAGHNLLKAHALAWHVYNEKFRHAQNGKISIALQADWIEPACPFSQKDKEVAERVLEFDIGWLAEPIFGSGDYPWVMRDWLNQRNNFLLPYFTEDEKKLIQGTFDFLALSHYTTILVDSEKEDPIKYNDYLEVQEMTDITWLNSPSQVAVVPWGLRKVLNWLKFKYGDLPMYIISNGIDDGLHAEDDQLRVYYMQNYINEALKAHILDGINLCGYFAYSFNDRTAPRFGLYRYAADQFEPKASMKHYRKIIDSNGFPGPETLERFCPEEFTVCTECSFFHTRKSLLAFIAFLFFASIISLSLIFYYSKKGRRSYK

SEQ ID NO: 2310 - protein, 1044 aa, unidentified
MKPGCAAGSPGNEWIFFSTDEITTRYRNTMSNGGLQRSVILSALILLRAVTGFSGDGRAIWSKNPNFTPVNESQLFLYDTFPKNFFWGIGTGALQVEGSWKKDGKGPSIWDHFIHTHLKNVSSTNGSSDSYIFLEKDLSALDFIGVSFYQFSISWPRLFPDGIVTVANAKGLQYYSTLLDALVLRNIEPIVTLYHWDLPLALQEKYGGWKNDTIIDIFNDYATYCFQMFGDRVKYWITIHNPYLVAWHGYGTGMHAPGEKGNLAAVYTVGHNLIKAHSKVWHNYNTHFRPHQKGWLSITLGSHWIEPNRSENTMDIFKCQQSMVSVLGWFANPIHGDGDYPEGMRKKLFSVLPIFSEAEKHEMRGTADFFAFSFGPNNFKPLNTMAKMGQNVSLNLREALNWIKLEYNNPRILIAENGWFTDSRVKTEDTTAIYMMKNFLSQVLQAIRLDEIRVFGYTAWSLLDGFEWQDAYTIRRGLFYVDFNSKQKERKPKSSAHYYKQIIRENGFSLKESTPDVQGQFPCDFSWGVTESVLKPESVASSPQFSDPHLYVWNATGNRLLHRVEGVRLKTRPAQCTDFVNIKKQLEMLARMKVTHYRFALDWASVLPTGNLSAVNRQALRYYRCVVSEGLKLGISAMVTLYYPTHAHLGLPEPLLHADGWLNPSTAEAFQAYAGLCFQELGDLVKLWITINEPNRLSDIYNRSGNDTYGAAHNLLVAHALAWRLYDRQFRPSQRGAVSLSLHADWAEPANPYADSHWRAAERFLQFEIAWFAEPLFKTGDYPAAMREYIASKHRRGLSSSALPRLTEAERRLLKGTVDFCALNHFTTRFVMHEQLAGSRYDSDRDIQFLQDITRLSSPTRLAVIPWGVRKLLRWVRRNYGDMDIYITASGIDDQALEDDRLRKYYLGKYLQEVLKAYLIDKVRIKGYYAFKLAEEKSKPRFGFFTSDFKAKSSIQFYNKVISSRGFPFENSSSRCSQTQENTECTVCLFLVQKKPLIFLGCCFFSTLVLLLSIAIFQRQKRRKFWKAKNLQHIPLKKGKRVVS

SEQ ID NO: 2311 - protein, 755 aa, unidentified
MNVIYFPLHIFVVYSRAYTSLVLVGCTNLCAVLFARCLDDHLVSLRMSGSRKEFDVKQILKIRWRWFGHQASSPNSTVDSQQGEFWNRGQTGANGGRKFLDPCSLQLPLASIGYRRSSQLDFQNSPSWPMASTSEVPAFEFTAEDCGGAHWLDRPEVDDGTSEEENESDSSSCRTSNSSQTLSSCHTMEPCTSDEFFQALNHAEQTFKKMENYLRHKQLCDVILVAGDRRIPAHRLVLSSVSDYFAAMFTNDVREARQEEIKMEGVEPNSLWSLIQYAYTGRLELKEDNIECLLSTACLLQLSQVVEACCKFLMKQLHPSNCLGIRSFADAQGCTDLHKVAHNYTMEHFMEVIRNQEFVLLPASEIAKLLASDDMNIPNEETILNALLTWVRHDLEQRRKDLSKLLAYIRLPLLAPQFLADMENNVLFRDDIECQKLIMEAMKYHLLPERRPMLQSPRTKPRKSTVGTLFAVGGMDSTKGATSIEKYDLRTNMWTPVANMNGRRLQFGVAVLDDKLYVVGGRDGLKTLNTVECYNPKTKTWSVMPPMSTHRHGLGVAVLEGPMYAVGGHDGWSYLNTVERWDPQARQWNFVATMSTPRSTVGVAVLSGKLYAVGGRDGSSCLKSVECFDPHTNKWTLCAQMSKRRGGVGVTTWNGLLYAIGGHDAPASNLTSRLSDCVERYDPKTDMWTAVASMSISRDAVGVCLLGDKLYAVGGYDGQAYLNTVEAYDPQTNEWTQVAPLCLGRAGACVVTVKL

SEQ ID NO: 2312 - protein, 225 aa, unidentified
MDQQAIYAELNLPTDSGPESSSPSSLPRDVCQGSPWHQFALKLSCAGIILLVLVVTGLSVSVTSLIQKSSIEKCSVDIQQSRNKTTERPGLLNCPIYWQQLREKCLLFSHTVNPWNNSLADCSTKESSLLLIRDKDELIHTQNLIRDKAILFWIGLNFSLSEKNWKWINGSFLNSNDLEIRGDAKENSCISISQTSVYSEYCSTEIRWICQKELTPVRNKVYPDS

SEQ ID NO: 2313 - protein, 233 aa, unidentified
MDNQGVIYSDLNLPPNPKRQQRKPKGNKNSILATEQEITYAELNLQKASQDFQGNDKTYHCKDLPSAPEKLIVGILGIICLILMASVVTIVVIPSTLIQRHNNSSLNTRTQKARHCGHCPEEWITYSNSCYYIGKERRTWEESLLACTSKNSSLLSIDNEEEMKFLSIISPSSWIGVFRNSSHHPWVTMNGLAFKHEIKDSDNAELNCAVLQVNRLKSAQCGSSIIYHCKHKL

SEQ ID NO: 2314 - protein, 231 aa, unidentified
MSKQRGTFSEVSLAQDPKRQQRKPKGNKSSISGTEQEIFQVELNLQNPSLNHQGIDKIYDCQGLLPPPEKLTAEVLGIICIVLMATVLKTIVLIPFLEQNNSSPNTRTQKARHCGHCPEEWITYSNSCYYIGKERRTWEESLLACTSKNSSLLSIDNEEEMKFLASILPSSWIGVFRNSSHHPWVTINGLAFKHKIKDSDNAELNCAVLQVNRLKSAQCGSSMIYHCKHKL

SEQ ID NO: 2315 - protein, 240 aa, unidentified
MSKQRGTFSEVSLAQDPKWQQRKPKGNKSSISGTEQEIFQVELNLQNASLNHQGIDKIYDCQGLLPPPEKLTAEVLGIICIVLMATVLKTIVLIPFLEQNNSSPNARTQKARHCGHCPEEWITYSNSCYYIGKERRTWEESLQACASKNSSSLLCIDNEEEMKFLASILPSSWIGVFRNSSHHPWVTINGLAFKHEIKDSDHAERNCAMLHVRGLISDQCGSSRIIRRGFIMLTRLVLNS

SEQ ID NO: 2316 - protein, 158 aa, unidentified
MNKQRGTYSEVSLAQDPKRQQRKLKGNKISISGTKQEIFQVELNLQNASSDHQGNDKTYHCKGLLPPPEKLTAEVLGIICIVLMATVLKTIVLIPCIGVLEQNNFSLNRRMQKARHCGHCPEEWITYSNSCYYIGKERRTWEERVCWPVLRRTLICFL

SEQ ID NO: 2317 - protein, 179 aa, unidentified
MAVFKTTLWRLISGTLGIICLSLMSTLGILLKNSFTKLSIEPAFTPGPNIELQKDSDCCSCQEKWVGYRCNCYFISSEQKTWNESRHLCASQKSSLLQLQNTDELDFMSSSQQFYWIGLSYSEEHTAWLWENGSALSQYLFPSFETFNTKNCIAYNPNGNALDESCEDKNRYICKQQLI

SEQ ID NO: 2318 - protein, 231 aa, unidentified
MQDEERYMTLNVQSKKRSSAQTSQLTFKDYSVTLHWYKILLGISGTVNGILTLTLISLILLVSQGVLLKCQKGSCSNATQYEDTGDLKVNNGTRRNISNKDLCASRSADQTVLCQSEWLKYQGKCYWFSNEMKSWSDSYVYCLERKSHLLIIHDQLEMAFIQKNLRQLNYVWIGLNFTSLKMTWTWVDGSPIDSKIFFIKGPAKENSCAAIKESKIFSETCSSVFKWICQY

SEQ ID NO: 2319 - protein, 207 aa, unidentified
MENEDGYMTLSFKNRCKSKQKSKDFSLYPQYYCLLLIFGCIVILIFIMTGIDLKFWHKKMDFSQNVNVSSLSGHNYLCPNDWLLNEGKCYWFSTSFKTWKESQRDCTQLQAHLLVIQNLDELEFIQNSLKPGHFGWIGLYVTFQGNLWMWIDEHFLVPELFSVIGPTDDRSCAVITGNWVYSEDCSSTFKGICQRDAILTHNGTSGV

SEQ ID NO: 2320 - protein, 195 aa, unidentified
MTDSVIYSMLELPTATQAQNDYGPQQKSSSSRPSCSCLVAIALGLLTAVLLSVLLYQWILCQGSNYSTCASCPSCPDRWMKYGNHCYYFSVEEKDWNSSLEFCLARDSHLLVITDNQEMSLLQVFLSEAFCWIGLRNNSGWRWEDGSPLNFSRISSNSFVQTCGAINKNGLQASSCEVPLHWVCKKCPFADQALF

SEQ ID NO: 2321 - protein, 409 aa, unidentified
MEESWEAAPGGQAGAELPMEPVGSLVPTLEQPQVPAKVRQPEGPESSPSPAGAVEKAAGAGLEPSSKKKPPSPRPGSPRVPPLSLGYGVCPEPPSPGPALVKLPRNGEAPGAEPAPSAWAPMELQVDVRVKPVGAAGGSSTPSPRPSTRFLKVPVPESPAFSRHADPAHQLLLRAPSQGGTWGRRSPLAAARTESGCDAEGRASPAEGSAGSPGSPTCCRCKELGLEKEDAALLPRAGLDGDEKLPRAVTLTGLPMYVKSLYWALAFMAVLLAVSGVVIVVLASRAGARCQQCPPGWVLSEEHCYYFSAEAQAWEASQAFCSAYHATLPLLSHTQDFLGRYPVSRHSWVGAWRGPQGWHWIDEAPLPPQLLPEDGEDNLDINCGALEEGTLVAANCSTPRPWVCAKGTQ

SEQ ID NO: 2322 - protein, 216 aa, unidentified
MGWIRGRRSRHSWEMSEFHNYNLDLKKSDFSTRWQKQRCPVVKSKCRENASPFFFCCFIAVAMGIRFIIMVAIWSAVFLNSLFNQEVQIPLTESYCGPCPKNWICYKNNCYQFFDESKNWYESQASCMSQNASLLKVYSKEDQDLLKLVKSYHWMGLVHIPTNGSWQWEDGSILSPNLLTIIEMQKGDCALYASSFKGYIENCSTPNTYICMQRTV

SEQ ID NO: 2323 - protein, 486 aa, unidentified
MDSSVIQRKKVAVIGGGLVGSLQACFLAKRNFQIDVYEAREDTRVATFTRGRSINLALSHRGRQALKAVGLEDQIVSQGIPMRARMIHSLSGKKSAIPYGTKSQYILSVSRENLNKDLLTAAEKYPNVKMHFNHRLLKCNPEEGMITVLGSDKVPKDVTCDLIVGCDGAYSTVRSHLMKKPRFDYSQQYIPHGYMELTIPPKNGDYAMEPNYLHIWPRNTFMMIALPNMNKSFTCTLFMPFEEFEKLLTSNDVVDFFQKYFPDAIPLIGEKLLVQDFFLLPAQPMISVKCSSFHFKSHCVLLGDAAHAIVPFFGQGMNAGFEDCLVFDELMDKFSNDLSLCLPVFSRLRIPDDHAISDLSMYNYIEMRAHVNSSWFIFQKNMERFLHAIMPSTFIPLYTMVTFSRIRYHEAVQRWHWQKKVINKGLFFLGSLIAISSTYLLIHYMSPRSFLRLRRPWNWIAHFRNTTCFPAKAVDSLEQISNLISR

SEQ ID NO: 2324 - protein, 1858 aa, unidentified
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETSTPTPSPYATPTHTDITPMDPSFATPPRIKSDDETCRNGYKPIYSPVTPVTPGTPGNTMHFENISSPESSPEIKRRTYSQEGYDRSSTMLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPPAPGPHLVQQPNSHQQHSVAHVVGPVHAVTPGSHIHSQTAGHHLPPPPPPPGPAPHHHPPPHPSTGLQGLQAQHQHVVNSAPPPPPPPPPSSVLASGHHTTSAQALHHPPHQGPPLFPSSAHPTVPPYPSQATHHTTLGPGPQHQPSGTGPHCPLPVTGPHLQPQGPNSIPTPTASGFCPHPGSVALPHGVQGPQQASPVPGQIPIHRAQVPPTFQNNYHGSGWH

SEQ ID NO: 2325 - protein, 124 aa, unidentified
MDIPISSRDFRGLQLACVALGLVAGSIIIGISVSKAAAAMGGVFIGAAVLGLLILAYPFLKARFNLDHILPTIGSLRIHPHPGADHGEGRSSTNGNKEGARSSLSTVSRTLEKLKPGTRGAEEC

SEQ ID NO: 2326 - protein, 473 aa, unidentified
MAPPAARLALLSAAALTLAARPAPSPGLGPECFTANGADYRGTQNWTALQGGKPCLFWNETFQHPYNTLKYPNGEGGLGEHNYCRNPDGDVSPWCYVAEHEDGVYWKYCEIPACQMPGNLGCYKDHGNPPPLTGTSKTSNKLTIQTCISFCRSQRFKFAGMESGYACFCGNNPDYWKYGEAASTECNSVCFGDHTQPCGGDGRIILFDTLVGACGGNYSAMSSVVYSPDFPDTYATGRVCYWTIRVPGASHIHFSFPLFDIRDSADMVELLDGYTHRVLARFHGRSRPPLSFNVSLDFVILYFFSDRINQAQGFAVLYQAVKEELPQERPAVNQTVAEVITEQANLSVSAARSSKVLYVITTSPSHPPQTVPGSNSWAPPMGAGSHRVEGWTVYGLATLLILTVTAIVAKILLHVTFKSHRVPASGDLRDCHQPGTSGEIWSIFYKPSTSISIFKKKLKGQSQQDDRNPLVSD

SEQ ID NO: 2327 - protein, 462 aa, unidentified
MGTQALQGFLFLLFLPLLQPRGASAGSLHSPGLSECFQVNGADYRGHQNRTGPRGAGRPCLFWDQTQQHSYSSASDPHGRWGLGAHNFCRNPDGDVQPWCYVAETEEGIYWRYCDIPSCHMPGYLGCFVDSGAPPALSGPSGTSTKLTVQVCLRFCRMKGYQLAGVEAGYACFCGSESDLARGRLAPATDCDQICFGHPGQLCGGDGRLGVYEVSVGSCQGNWTAPQGVIYSPDFPDEYGPDRNCSWALGPPGAALELTFRLFELADPRDRLELRDAASGSLLRAFDGARPPPSGPLRLGTAALLLTFRSDARGHAQGFALTYRGLQDAAEDPEAPEGSAQTPAAPLDGANVSCSPRPGAPPAAIGARVFSTVTAVSVLLLLLLGLLRPLRRRSCLLAPGKGPPALGASRGPRRSWAVWYQQPRGVALPCSPGDPQAEGSAAGYRPLSASSQSSLRSLISAL

SEQ ID NO: 2328 - protein, 136 aa, unidentified
MVVGTGTSLALSSLLSLLLFAGMQMYSRQLASTEWLTIQGGLLGSGLFVFSLTAFNNLENLVFGKGFQAKIFPEILLCLLLALFASGLIHRVCVTTCFIFSMVGLYYINKISSTLYQAAAPVLTPAKVTGKSKKRN

SEQ ID NO: 2329 - protein, 240 aa, unidentified
MRRCSLCAFDAARGPRRLMRVGLALILVGHVNLLLGAVLHGTVLRHVANPRGAVTPEYTVANVISVGSGLLSVSVGLVALLASRNLLRPPLHWVLLALALVNLLLSVACSLGLLLAVSLTVANGGRRLIADCHPGLLDPLVPLDEGPGHTDCPFDPTRIYDTALALWIPSLLMSAGEAALSGYCCVAALTLRGVGPCRKDGLQGQLEEMTELESPKCKRQENEQLLDQNQEIRASQRSWV

SEQ ID NO: 2330 - protein, 1357 aa, unidentified
MEFYESAYFIVLIPSIVITVIFLFFWLFMKETLYDEVLAKQKREQKLIPTKTDKKKAEKKKNKKKEIQNGNLHESDSESVPRDFKLSDALAVEDDQVAPVPLNVVETSSSVRERKKKEKKQKPVLEEQVIKESDASKIPGKKVEPVPVTKQPTPPSEAAASKKKPGQKKSKNGSDDQDKKVETLMVPSKRQEALPLHQETKQESGSGKKKASSKKQKTENVFVDEPLIHATTYIPLMDNADSSPVVDKREVIDLLKPDQVEGIQKSGTKKLKTETDKENAEVKFKDFLLSLKTMMFSEDEALCVVDLLKEKSGVIQDALKKSSKGELTTLIHQLQEKDKLLAAVKEDAAATKDRCKQLTQEMMTEKERSNVVITRMKDRIGTLEKEHNVFQNKIHVSYQETQQMQMKFQQVREQMEAEIAHLKQENGILRDAVSNTTNQLESKQSAELNKLRQDYARLVNELTEKTGKLQQEEVQKKNAEQAATQLKVQLQEAERRWEEVQSYIRKRTAEHEAAQQDLQSKFVAKENEVQSLHSKLTDTLVSKQQLEQRLMQLMESEQKRVNKEESLQMQVQDILEQNEALKAQIQQFHSQIAAQTSASVLAEELHKVIAEKDKQIKQTEDSLASERDRLTSKEEELKDIQNMNFLLKAEVQKLQALANEQAAAAHELEKMQQSVYVKDDKIRLLEEQLQHEISNKMEEFKILNDQNKALKSEVQKLQTLVSEQPNKDVVEQMEKCIQEKDEKLKTVEELLETGLIQVATKEEELNAIRTENSSLTKEVQDLKAKQNDQVSFASLVEELKKVIHEKDGKIKSVEELLEAELLKVANKEKTVQDLKQEIKALKEEIGNVQLEKAQQLSITSKVQELQNLLKGKEEQMNTMKAVLEEKEKDLANTGKWLQDLQEENESLKAHVQEVAQHNLKEASSASQFEELEIVLKEKENELKRLEAMLKERESDLSSKTQLLQDVQDENKLFKSQIEQLKQQNYQQASSFPPHEELLKVISEREKEISGLWNELDSLKDAVEHQRKKNNDLREKNWEAMEALASTEKMLQDKVNKTSKERQQQVEAVELEAKEVLKKLFPKVSVPSNLSYGEWLHGFEKKAKECMAGTSGSEEVKVLEHKLKEADEMHTLLQLECEKYKSVLAETEGILQKLQRSVEQEENKWKVKVDESHKTIKQMQSSFTSSEQELERLRSENKDIENLRREREHLEMELEKAEMERSTYVTEVRELKDLLTELQKKLDDSYSEAVRQNEELNLLKAQLNETLTKLRTEQNERQKVAGDLHKAQQSLELIQSKIVKAAGDTTVIENSDVSPETESSEKETMSVSLNQTVTQLQQLLQAVNQQLTKEKEHYQVLE

SEQ ID NO: 2331 - protein, 1257 aa, unidentified
MVVALRYVWPLLLCSPCLLIQIPEEYEGHHVMEPPVITEQSPRRLVVFPTDDISLKCEASGKPEVQFRWTRDGVHFKPKEELGVTVYQSPHSGSFTITGNNSNFAQRFQGIYRCFASNKLGTAMSHEIRLMAEGAPKWPKETVKPVEVEEGESVVLPCNPPPSAEPLRIYWMNSKILHIKQDERVTMGQNGNLYFANVLTSDNHSDYICHAHFPGTRTIIQKEPIDLRVKATNSMIDRKPRLLFPTNSSSHLVALQGQPLVLECIAEGFPTPTIKWLRPSGPMPADRVTYQNHNKTLQLLKVGEEDDGEYRCLAENSLGSARHAYYVTVEAAPYWLHKPQSHLYGPGETARLDCQVQGRPQPEVTWRINGIPVEELAKDQKYRIQRGALILSNVQPSDTMVTQCEARNRHGLLLANAYIYVVQLPAKILTADNQTYMAVQGSTAYLLCKAFGAPVPSVQWLDEDGTTVLQDERFFPYANGTLGIRDLQANDTGRYFCLAANDQNNVTIMANLKVKDATQITQGPRSTIEKKGSRVTFTCQASFDPSLQPSITWRGDGRDLQELGDSDKYFIEDGRLVIHSLDYSDQGNYSCVASTELDVVESRAQLLVVGSPGPVPRLVLSDLHLLTQSQVRVSWSPAEDHNAPIEKYDIEFEDKEMAPEKWYSLGKVPGNQTSTTLKLSPYVHYTFRVTAINKYGPGEPSPVSETVVTPEAAPEKNPVDVKGEGNETTNMVITWKPLRWMDWNAPQVQYRVQWRPQGTRGPWQEQIVSDPFLVVSNTSTFVPYEIKVQAVNSQGKGPEPQVTIGYSGEDYPQAIPELEGIEILNSSAVLVKWRPVDLAQVKGHLRGYNVTYWREGSQRKHSKRHIHKDHVVVPANTTSVILSGLRPYSSYHLEVQAFNGRGSGPASEFTFSTPEGVPGHPEALHLECQSNTSLLLRWQPPLSHNGVLTGYVLSYHPLDEGGKGQLSFNLRDPELRTHNLTDLSPHLRYRFQLQATTKEGPGEAIVREGGTMALSGISDFGNISATAGENYSVVSWVPKEGQCNFRFHILFKALGEEKGGASLSPQYVSYNQSSYTQWDLQPDTDYEIHLFKERMFRHQMAVKTNGTGRVRLPPAGFATEGWFIGFVSAIILLLLVLLILCFIKRSKGGKYSVKDKEDTQVDSEARPMKDETFGEYRSLESDNEEKAFGSSQPSLNGDIKPLGSDDSLADYGGSVDVQFNEDGSFIGQYSGKKEKEAAGGNDSSGATSPINPAVALE

SEQ ID NO: 2332 - protein, 525 aa, unidentified
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 2333 - protein, 287 aa, unidentified
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 2334 - protein, 417 aa, unidentified
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 2335 - protein, 410 aa, unidentified
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKHHHAGYEQF

SEQ ID NO: 2336 - protein, 416 aa, unidentified
MPRQLSAAAALFASLAVILHDGSQMRAKAFPETRDYSQPTAAATVQDIKKPVQQPAKQAPHQTLAARFMDGHITFQTAATVKIPTTTPATTKNTATTSPITYTLVTTQATPNNSHTAPPVTEVTVGPSLAPYSLPPTITPPAHTTGTSSSTVSHTTGNTTQPSNQTTLPATLSIALHKSTTGQKPVQPTHAPGTTAAAHNTTRTAAPASTVPGPTLAPQPSSVKTGIYQVLNGSRLCIKAEMGIQLIVQDKESVFSPRRYFNIDPNATQASGNCGTRKSNLLLNFQGGFVNLTFTKDEESYYISEVGAYLTVSDPETIYQGIKHAVVMFQTAVGHSFKCVSEQSLQLSAHLQVKTTDVQLQAFDFEDDHFGNVDECSSDYTIVLPVIGAIVVGLCLMGMGVYKIRLRCQSSGYQRI

SEQ ID NO: 2337 - protein, 280 aa, unidentified
MDLQGRGVPSIDRLRVLLMLFHTMAQIMAEQEVENLSGLSTNPEKDIFVVRENGTTCLMAEFAAKFIVPYDVWASNYVDLITEQADIALTRGAEVKGRCGHSQSELQVFWVDRAYALKMLFVKESHNMSKGPEATWRLSKVQFVYDSSEKTHFKDAVSAGKHTANSHHLSALVTPAGKSYECQAQQTISLASSDPQKTVTMILSAVHIQPFDIISDFVFSEEHKCPVDEREQLEETLPLILGLILGLVIMVTLAIYHVHHKMTANQVQIPRDRSQYKHMG

SEQ ID NO: 2338 - protein, 233 aa, unidentified
MVSMSFKRNRSDRFYSTRCCGCCHVRTGTIILGTWYMVVNLLMAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLDQLPDFPYKDDLLALDSSCLLFIVLVFFALFIIFKAYLINCVWNCYKYINNRNVPEIAVYPAFEAPPQYVLPTYEMAVKMPEKEPPPPYLPA

SEQ ID NO: 2339 - protein, 317 aa, unidentified
MTSRTRVTWPSPPRPLPVPAAAAVAFGAKGTDPAEARSSRGIEEAGPRAHGRAGREPERRRSRQQRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 2340 - protein, 262 aa, unidentified
MDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMNYLPSQEDMPHNQFIKMMIIFSIAFITVLIFKVYMFKCVWRCYRLIKCMNSVEEKRNSKMLQKVVLPSYEEALSLPSKTPEGGPAPPPYSEV

SEQ ID NO: 2341 - protein, 738 aa, unidentified
MTSDQDAKVVAEPQTQRVQEGKDSAHLMNGPISQTTSQTSSIPPLSQVPATKVSELNPNAEVWGAPVLHLEASSAADGVSAAWEEVAGHHADRGPQGSDANGDGDQGHENAALPDPQESDPADMNALALGPSEYDSLPENSETGGNESQPDSQEDPREVLKKTLEFCLSRENLASDMYLISQMDSDQYVPITTVANLDHIKKLSTDVDLIVEVLRSLPLVQVDEKGEKVRPNQNRCIVILREISESTPVEEVEALFKGDNLPKFINCEFAYNDNWFITFETEADAQQAYKYLREEVKTFQGKPIKARIKAKAIAINTFLPKNGFRPLDVSLYAQQRYATSFYFPPMYSPQQQFPLYSLITPQTWSATHSYLDPPLVTPFPNTGFINGFTSPAFKPAASPLTSLRQYPPRSRNPSKSHLRHAIPSAERGPGLLESPSIFNFTADRLINGVRSPQTRQAGQTRTRIQNPSAYAKREAGPGRVEPGSLESSPGLGRGRKNSFGYRKKREEKFTSSQTQSPTPPKPPSPSFELGLSSFPPLPGAAGNLKTEDLFENRLSSLIIGPSKERTLSADASVNTLPVVVSREPSVPASCAVSATYERSPSPAHLPDDPKVAEKQRETHSVDRLPSALTATACKSVQVNGAATELRKPSYAEICQRTSKEPPSSPLQPQKEQKPNTVGCGKEEKKLAEPAERYREPPALKSTPGAPRDQRRPAGGRPSPSAMGKRLSREQSTPPKSPQ

SEQ ID NO: 2342 - protein, 398 aa, unidentified
MDGVTPTLSTIRGRTLESSTLHVTPRSLDRNKDQITNIFSGFAGLLAILLVVAVFCILWNWNKRKKRQVPYLRVTVMPLLTLPQTRQRAKNIYDILPWRQEDLGRHESRSMRIFSTESLLSRNSESPEHVPSQAGNAFQEHTAHIHATEYAVGIYDNAMVPQMCGNLTPSAHCINVRASRDCASISSEDSHDYVNVPTAEEIAETLASTKSPSRNLFVLPSTQKLEFTEERDEGCGDAGDCTSLYSPGAEDSDSLSNGEGSSQISNDYVNMTGLDLSAIQERQLWVAFQCCRDYENVPAADPSGSQQQAEKDVPSSNIGHVEDKTDDPGTHVQCVKRTFLASGDYADFQPFTQSEDSQMKHREEMSNEDSSDYENVLTAKLGGRDSEQGPGTQLLPDE

SEQ ID NO: 2343 - protein, 382 aa, unidentified
MRPGTALQAVLLAVLLVGLRAATGRLLSASDLDLRGGQPVCRGGTQRPCYKVIYFHDTSRRLNFEEAKEACRRDGGQLVSIESEDEQKLIEKFIENLLPSDGDFWIGLRRREEKQSNSTACQDLYAWTDGSISQFRNWYVDEPSCGSEVCVVMYHQPSAPAGIGGPYMFQWNDDRCNMKNNFICKYSDEKPAVPSREAEGEETELTTPVLPEETQEEDAKKTFKESREAALNLAYILIPSIPLLLLLVVTTVVCWVWICRKRKREQPDPSTKKQHTIWPSPHQGNSPDLEVYNVIRKQSEADLAETRPDLKNISFRVCSGEATPDDMSCDYDNMAVNPSESGFVTLVSVESGFVTNDIYEFSPDQMGRSKESGWVENEIYGY

SEQ ID NO: 2344 - protein, 615 aa, unidentified
MPSRKFADGEVVRGRWPGSSLYYEVEILSHDSTSQLYTVKYKDGTELELKENDIKPLTSFRQRKGGSTSSSPSRRRGSRSRSRSRSPGRPPKSARRSASASHQADIKEARREVEVKLTPLILKPFGNSISRYNGEPEHIERNDAPHKNTQEKFSLSQESSYIATQYSLRPRREEVKLKEIDSKEEKYVAKELAVRTFEVTPIRAKDLEFGGVPGVFLIMFGLPVFLFLLLLMCKQKDPSLLNFPPPLPALYELWETRVFGVYLLWFLIQVLFYLLPIGKVVEGTPLIDGRRLKYRLNGFYAFILTSAVIGTSLFQGVEFHYVYSHFLQFALAATVFCVVLSVYLYMRSLKAPRNDLSPASSGNAVYDFFIGRELNPRIGTFDLKYFCELRPGLIGWVVINLVMLLAEMKIQDRAVPSLAMILVNSFQLLYVVDALWNEEALLTTMDIIHDGFGFMLAFGDLVWVPFIYSFQAFYLVSHPNEVSWPMASLIIVLKLCGYVIFRGANSQKNAFRKNPSDPKLAHLKTIHTSTGKNLLVSGWWGFVRHPNYLGDLIMALAWSLPCGFNHILPYFYIIYFTMLLVHREARDEYHCKKKYGVAWEKYCQRVPYRIFPYIY

SEQ ID NO: 2345 - protein, 414 aa, unidentified [sequence omitted]

SEQ ID NO: 2346 - protein, 1927 aa, unidentified
MELSWHVVFIALLSFSCWGSDWESDRNFISTAGPLTNDLLHNLSGLLGDQSSNFVAGDKDMYVCHQPLPTFLPEYFSSLHASQITHYKVFLSWAQLLPAGSTQNPDEKTVQCYRRLLKALKTARLQPMVILHHQTLPASTLRRTEAFADLFADYATFAFHSFGDLVGIWFTFSDLEEVIKELPHQESRASQLQTLSDAHRKAYEIYHESYAFQGGKLSVVLRAEDIPELLLEPPISALAQDTVDFLSLDLSYECQNEASLRQKLSKLQTIEPKVKVFIFNLKLPDCPSTMKNPASLLFSLFEAINKDQVLTIGFDINEFLSCSSSSKKSMSCSLTGSLALQPDQQQDHETTDSSPASAYQRIWEAFANQSRAERDAFLQDTFPEGFLWGASTGAFNVEGGWAEGGRGVSIWDPRRPLNTTEGQATLEVASDSYHKVASDVALLCGLRAQVYKFSISWSRIFPMGHGSSPSLPGVAYYNKLIDRLQDAGIEPMATLFHWDLPQALQDHGGWQNESVVDAFLDYAAFCFSTFGDRVKLWVTFHEPWVMSYAGYGTGQHPPGISDPGVASFKVAHLVLKAHARTWHHYNSHHRPQQQGHVGIVLNSDWAEPLSPERPEDLRASERFLHFMLGWFAHPVFVDGDYPATLRTQIQQMNRQCSHPVAQLPEFTEAEKQLLKGSADFLGLSHYTSRLISNAPQNTCIPSYDTIGGFSQHVNHVWPQTSSSWIRVVPWGIRRLLQFVSLEYTRGKVPIYLAGNGMPIGESENLFDDSLRVDYFNQYINEVLKAIKEDSVDVRSYIARSLIDGFEGPSGYSQRFGLHHVNFSDSSKSRTPRKSAYFFTSIIEKNGFLTKGAKRLLPPNTVNLPSKVRAFTFPSEVPSKAKVVWEKFSSQPKFERDLFYHGTFRDDFLWGVSSSAYQIEGAWDADGKGPSIWDNFTHTPGSNVKDNATGDIACDSYHQLDADLNMLRALKVKAYRFSISWSRIFPTGRNSSINSHGVDYYNRLINGLVASNIFPMVTLFHWDLPQALQDIGGWENPALIDLFDSYADFCFQTFGDRVKFWMTFNEPMYLAWLGYGSGEFPPGVKDPGWAPYRIAHAVIKAHARVYHTYDEKYRQEQKGVISLSLSTHWAEPKSPGVPRDVEAADRMLQFSLGWFAHPIFRNGDYPDTMKWKVGNRSELQHLATSRLPSFTEEEKRFIRATADVFCLNTYYSRIVQHKTPRLNPPSYEDDQEMAEEEDPSWPSTAMNRAAPWGTRRLLNWIKEEYGDIPIYITENGVGLTNPNTEDTDRIFYHKTYINEALKAYRLDGIDLRGYVAWSLMDNFEWLNGYTVKFGLYHVDFNNTNRPRTARASARYYTEVITNNGMPLAREDEFLYGRFPEGFIWSAASAAYQIEGAWRADGKGLSIWDTFSHTPLRVENDAIGDVACDSYHKIAEDLVTLQNLGVSHYRFSISWSRILPDGTTRYINEAGLNYYVRLIDTLLAASIQPQVTIYHWDLPQTLQDVGGWENETIVQRFKEYADVLFQRLGDKVKFWITLNEPFVIAYQGYGYGTAAPGVSNRPGTAPYIVGHNLIKAHAEAWHLYNDVYRASQGGVISITISSDWAEPRDPSNQEDVEAARRYVQFMGGWFAHPIFKNGDYNEVMKTRIRDRSLAAGLNKSRLPEFTESEKRRINGTYDFFGFNHYTTVLAYNLNYATAISSFDADRGVASIADRSWPDSGSFWLKMTPFGFRRILNWLKEEYNDPPIYVTENGVSQREETDLNDTARIYYLRTYINEALKAVQDKVDLRGYTVWSAMDNFEWATGFSERFGLHFVNYSDPSLPRIPKASAKFYASVVRCNGFPDPATGPHACLHQPDAGPTISPVRQEEVQFLGLMLGTTEAQTALYVLFSLVLLGVCGLAFLSYKYCKRSKQGKTQRSQQELSPVSSF

SEQ ID NO: 2347 - protein, 567 aa, unidentified
MKPVWVATLLWMLLLVPRLGAARKGSPEEASFYYGTFPLGFSWGVGSSAYQTEGAWDQDGKGPSIWDVFTHSGKGKVLGNETADVACDGYYKVQEDIILLRELHVNHYRFSLSWPRLLPTGIRAEQVNKKGIEFYSDLIDALLSSNITPIVTLHHWDLPQLLQVKYGGWQNVSMANYFRDYANLCFEAFGDRVKHWITFSDPRAMAEKGYETGHHAPGLKLRGTGLYKAAHHIIKAHAKAWHSYNTTWRSKQQGLVGISLNCDWGEPVDISNPKDLEAAERYLQFCLGWFANPIYAGDYPQVMKDYIGRKSAEQGLEMSRLPVFSLQEKSYIKGTSDFLGLGHFTTRYITERNYPSRQGPSYQNDRDLIELVDPNWPDLGSKWLYSVPWGFRRLLNFAQTQYGDPPIYVMENGASQKFHCTQLCDEWRIQYLKGYINEMLKAIKDGANIKGYTSWSLLDKFEWEKGYSDRYGFYYVEFNDRNKPRYPKASVQYYKKIIIANGFPNPREVESWYLKALETCSINNQMLAAEPLLSHMQMVTEIVVPTVCSLCVLITAVLLMLLLRRQS

SEQ ID NO: 2348 - protein, 166 aa, unidentified
MDSELKEEIPVHEEFILCGGAETQVLKCGPWTDLFHDQSVKRPKLLIFIIPGNPGFSAFYVPFAKALYSLTNRRFPVWTISHAGHALAPKDKKILTTSEDSNAQEIKDIYGLNGQIEHKLAFLRTHVPKDMKLVLIGHSIGSYFTLQMLKRVPELPLMLPTLGAKK

SEQ ID NO: 2349 - protein, 860 aa, unidentified [sequence omitted]

SEQ ID NO: 2350 - protein, 205 aa, unidentified
MNKVFPQGENGYTAAESKAHPGGEAGGGHLCCSRRGACLSASLLLLLATVAALIALVTILGLPSCTPGAQACITLTNRTGFLCHDQRSCIPASGVCDGVRTCTHGEDEDESLCRDVPQSLPHFLVAHCGDPASWIYSDQKCDGTNNCGDCSDELSPVTVCPPCGPGWWRCPSTFFKYCDCIPRHLCRDHVQHCSDWSDEYACPGP

SEQ ID NO: 2351 - protein, 345 aa, unidentified
MWLLGPLCLLLSSAAESQLLPGNNFTNECNIPGNFMCSNGRCIPGAWQCDGLPDCFDKSDEKECPKAKSKCGPTFFPCASGIHCIIGRFRCNGFEDCPDGSDEENCTANPLLCSTARYHCKNGLCIDKSFICDGQNNCQDNSDEESCESSQEPGSGQVFVTSENQLVYYPSITYAIIGSSVIFVLVVALLALVLHHQRKRNNLMTLPVHRLQHPVLLSRLVVLDHPHHCNVTYNVNNGIQYVASQAEQNASEVGSPPSYSEALLDQRPAWYDLPPPPYSSDTESLNQADLPPYRSRSGSANSASSQAASSLLSVEDTSHSPGQPGPQEGTAEPRDSEPSQGTEEV

SEQ ID NO: 2352 - protein, 306 aa, unidentified
MPEAGFQATNAFTECKFTCTSGKCLYLGSLVCNQQNDCGDNSDEENCLLVTEHPPPGIFNSELEFAQIIIIVVVVTVMVVVIVCLLNHYKVSTRSFINRPNQSRRREDGLPQEGCLWPSDSAAPRLGASEIMHAPRSRDRFTAPSFIQRDRFSRFQPTYPYVQHEIDLPPTISLSDGEEPPPYQGPCTLQLRDPEQQMELNRESVRAPPNRTIFDSDLIDIAMYSGGPCPPSSNSGISASTCSSNGRMEGPPPTYSEVMGHHPGASFLHHQRSNAHRGSRLQFQQNNAESTIVPIKGKDRKPGNLV

SEQ ID NO: 2353 - protein, 181 aa, unidentified
MVDVKCLSDCKLQNQLEKLGFSPGPILPSTRKLYEKKLVQLLVSPPCAPPVMNGPRELDGAQDSDDSEELNIILQGNIILSTEKSKKLKKWPEASTTKRKAVDTYCLDYKPSKGRRWAARAPSTRITYGTITKERDYCAEDQTIESWREEGFPVGLKLAVLGIFIIVVFVYLTVENKSLFG

SEQ ID NO: 2354 - protein, 503 aa, unidentified
MAGLSDLELRRELQALGFQPGPITDTTRDVYRNKLRRLRGEARLRDEERLREEARPRGEERLREEARLREDAPLRARPAAASPRAEPWLSQPASGSAYATPGAYGDIRPSAASWVGSRGLAYPARPAQLRRRASVRGSSEEDEDARTPDRATQGPGLAARRWWAASPAPARLPSSLLGPDPRPGLRATRAGPAGAARARPEVGRRLERWLSRLLLWASLGLLLVFLGILWVKMGKPSAPQEAEDNMKLLPVDCERKTDEFCQAKQKAALLELLHELYNFLAIQAGNFECGNPENLKSKCIPVMEAQEYIANVTSSSSAKFEAALTWILSSNKDVGIWLKGEDQSELVTTVDKVVCLESAHPRMGVGCRLSRALLTAVTNVLIFFWCLAFLWGLLILLKYRWRKLEEEEQAMYEMVKKIIDVVQDHYVDWEQDMERYPYVGILHVRDSLIPPQSRRRMKRVWDRAVEFLASNESRIQTESHRVAGEDMLVWRWTKPSSFSDSER

SEQ ID NO: 2355 - protein, 911 aa, unidentified
MAAAAASAPQQLSDEELFSQLRRYGLSPGPVTESTRPVYLKKLKKLREEEQQQHRSGGRGNKTRNSNNNNTAAATVAAAGPAAAAAAGMGVRPVSGDLSYLRTPGGLCRISASGPESLLGGPGGASAAPAAGSKVLLGFSSDESDVEASPRDQAGGGGRKDRASLQYRGLKAPPAPLAASEVTNSNSAERRKPHSWWGARRPAGPELQTPPGKDGAVEDEEGEGEDGEERDPETEEPLWASRTVNGSRLVPYSCRENYSDSEEEDDDDVASSRQVLKDDSLSRHRPRRTHSKPLPPLTAKSAGGRLETSVQGGGGLAMNDRAAAAGSLDRSRNLEEAAAAEQGGGCDQVDSSPVPRYRVNAKKLTPLLPPPLTDMDSTLDSSTGSLLKTNNHIGGGAFSVDSPRIYSNSLPPSAAVAASSSLRINHANHTGSNHTYLKNTYNKPKLSEPEEELLQQFKREEVSPTGSFSAHYLSMFLLTAACLFFLILGLTYLGMRGTGVSEDGELSIENPFGETFGKIQESEKTLMMNTLYKLHDRLAQLAGDHECGSSSQRTLSVQEAAAYLKDLGPEYEGIFNTSLQWILENGKDVGIRCVGFGPEEELTNITDVQFLQSTRPLMSFWCRFRRAFVTVTHRLLLLCLGVVMVCVVLRYMKYRWTKEEEETRQMYDMVVKIIDVLRSHNEACQENKDLQPYMPIPHVRDSLIQPHDRKKMKKVWDRAVDFLAANESRVRTETRRIGGADFLVWRWIQPSASCDKILVIPSKVWQGQAFHLDRRNSPPNSLTPCLKIRNMFDPVMEIGDQWHLAIQEAILEKCSDNDGIVHIAVDKNSREGCVYVKCLSPEYAGKAFKALHGSWFDGKLVTVKYLRLDRYHHRFPQALTSNTPLKPSNKHMNSMSHLRLRTGLTNSQGSS

SEQ ID NO: 2356 - protein, 800 aa, unidentified
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAEGQHSGFGPQPNPEKVQNHSGSSARGNLSGKPDDWPQDMKEYVERCFTACESEEDKDRTEKLLKEVLQARLQDGSAYTIDWSREPLPGLTREPVAESPKKKRWEAASSLHPPRGAGSATRGGGAPSQRGTPGAGGAGRARGNSFTKFGNRNVFMKDNSSSSSTDSRSRSSSRSPTRHFRRSDSHSDSDSSYSGNECHPVGRRNPPPKGRGGRGAHMDRGRGRAQRGKRHDLAPTKRSRKKMAALECEDPERELKKQKRAARFQHGHSRRLRLEPLVLQMSSLESSGADPDWQELQIVGTCPDITKHYLRLTCAPDPSTVRPVAVLKKSLCMVKCHWKEKQDYAFACEQMKSIRQDLTVQGIRTEFTVEVYETHARIALEKGDHEEFNQCQTQLKSLYAENLPGNVGEFTAYRILYYIFTKNSGDITTELAYLTRELKADPCVAHALALRTAWALGNYHRFFRLYCHAPCMSGYLVDKFADRERKVALKAMIKTFRPALPVSYLQAELAFEGEAACRAFLEPLGLAYTGPDNSSIDCRLSLAQLSAF

SEQ ID NO: 2357 - protein, 1165 aa, unidentified
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKPETFEHLFIKHTASVTCGPLLLEPETISEDISVDTSWKNKDEMMPTTVVSLLSTTDLEKGSVCISDQFNSVNFSEAEGTEVTYEDESQRQPFVKYATLISNSKPSETGEEQGLINSSVTKCFSSKNSPLKDSFSNSSWEIEAQAFFILSDQHPNIISPHLTFSEGLDELLKLEGNFPEENNDKKSIYYLGVTSIKKRESGVLLTDKSRVSCPFPAPCLFTDIRVLQDSCSHFVENNINLGTSSKKTFASYMPQFQTCSTQTHKIMENKMCDLTV

SEQ ID NO: 2358 - protein, 131 aa, unidentified
MAGVKALVALSFSGAIGLTFLMLGCALEDYGVYWPLFVLIFHAISPIPHFIAKRVTYDSDATSSACRELAYFFTTGIVVSAFGFPVILARVAVIKWGACGLVLAGNAVIFLTIQGFFLIFGRGDDFSWEQW

SEQ ID NO: 2359 - protein, 131 aa, unidentified
MAGIKALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 2360 - protein, 739 aa, unidentified
MASILLRSCRGRAPARLPPPPRYTVPRGSPGDPAHLSCASTLGLRNCLNVPFGCCTPIHPVYTSSRGDHLGCWALRPECLRIVSRAPWTSTSVGFVAVGPQCLPVRGWHSSRPVRDDSVVEKSLKSLKDKNKKLEEGGPVYSPPAEVVVKKSLGQRVLDELKHYYHGFRLLWIDTKIAARMLWRILNGHSLTRRERRQFLRICADLFRLVPFLVFVVVPFMEFLLPVAVKLFPNMLPSTFETQSLKEERLKKELRVKLELAKFLQDTIEEMALKNKAAKGSATKDFSVFFQKIRETGERPSNEEIMRFSKLFEDELTLDNLTRPQLVALCKLLELQSIGTNNFLRFQLTMRLRSIKADDKLIAEEGVDSLNVKELQAACRARGMRALGVTEDRLRGQLKQWLDLHLHQEIPTSLLILSRAMYLPDTLSPADQLKSTLQTLPEIVAKEAQVKVAEVEGEQVDNKAKLEATLQEEAAIQQEHREKELQKRSEVAKDFEPERVVAAPQRPGTEPQPEMPDTVLQSETLKDTAPVLEGLKEEEITKEEIDILSDACSKLQEQKKSLTKEKEELELLKEDVQDYSEDLQEIKKELSKTGEEKYVEESKASKRLTKRVQQMIGQIDGLISQLEMDQQAGKLAPANGMPTGENVISVAELINAMKQVKHIPESKLTSLAAALDENKDGKVNIDDLVKVIELVDKEDVHISTSQVAEIVATLEKEEKVEEKEKAKEKAEKEVAEVKS

SEQ ID NO: 2361 - protein, 491 aa, unidentified
MAFYSYNSVLAIARTRFPSHFVHPTCSSYSPSCAFLHLPDSHLNKTCMKNYESKKYSDPSQPGNTVLHPGTRLIQKLHTSTCWLQEVPGKPQLEQATKHPQVTSPQATKETGMEIKEGKQSYRQKIMDELKYYYNGFYLLWIDAKVAARMVWRLLHGQVLTRRERRRLLRTCVDFFRLVPFMVFLIVPFMEFLLPVFLKLFPEMLPSTFESESKKEEKQKKKMAVKLELAKFLQETMTEMARRNRAKMGDASTQLSSYVKQVQTGHKPSTKEIVRFSKLFEDQLALEHLDRPQLVALCKLLELQTFGTNNLLRFQLLMKLKSIKADDEIIAKEGVTALSVSELQAACRARGMRSLGLTEEQLRQQLTEWQDLHLKENVPPSLLLLSRTFYLIDVKPKPIEIPLSGEAPKTDILVELPTFTESKENMVDLAPQLKGTKDEDFIQPPPVTSSPITPSTPISLPKGPITSSEEPTLQAKSQMTAQNSKASSKGA

SEQ ID NO: 2362 - protein, 360 aa, unidentified
MALSRVCWARSAVWGSAVTPGHFVTRRLQLGRSGLAWGAPRSSKLHLSPKADVKNLMSYVVTKTKAINGKYHRFLGRHFPRFYVLYTIFMKGLQMLWADAKKARRIKTNMWKHNIKFHQLPYREMEHLRQFRQDVTKCLFLGIISIPPFANYLVFLLMYLFPRQLLIRHFWTPKQQTDFLDIYHAFRKQSHPEIISYLEKVIPLISDAGLRWRLTDLCTKIQRGTHPAIHDILALRECFSNHPLGMNQLQALHVKALSRAMLLTSYLPPPLLRHRLKTHTTVIHQLDKALAKLGIGQLTAQEVKSACYLRGLNSTHIGEDRCRTWLGEWLQISCSLKEAELSLLLHNVVLLSTNYLGTRR

SEQ ID NO: 2363 - protein, 951 aa, unidentified
MPGPLGLLCFLALGLLGSAGPSGAAPPLCAAPCSCDGDRRVDCSGKGLTAVPEGLSAFTQALDISMNNITQLPEDAFKNFPFLEELQLAGNDLSFIHPKALSGLKELKVLTLQNNQLKTVPSEAIRGLSALQSLRLDANHITSVPEDSFEGLVQLRHLWLDDNSLTEVPVHPLSNLPTLQALTLALNKISSIPDFAFTNLSSLVVLHLHNNKIRSLSQHCFDGLDNLETLDLNYNNLGEFPQAIKALPSLKELGFHSNSISVIPDGAFDGNPLLRTIHLYDNPLSFVGNSAFHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGLNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALLAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 2364 - protein, 907 aa, unidentified
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 2365 - protein, 967 aa, unidentified
MPSPPGLRALWLCAALCASRRAGGAPQPGPGPTACPAPCHCQEDGIMLSADCSELGLSAVPGDLDPLTAYLDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 2366 - protein, 699 aa, unidentified
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 2367 - protein, 200 aa, unidentified
MASSLTCTGVIWALLSFLCAATSCVGFFMPYWLWGSQLGKPVSFGTFRRCSYPVHDESRQMMVMVEECGRYASFQGIPSAEWRICTIVTGLGCGLLLLVALTALMGCCVSDLISRTVGRVAGGIQFLGGLLIGAGCALYPLGWDSEEVRQTCGYTSGQFDLGKCEIGWAYYCTGAGATAAMLLCTWLACFSGKKQKHYPY

SEQ ID NO: 2368 - protein, 220 aa, unidentified
MRSSLTMVGTLWAFLSLVTAVTSSTSYFLPYWLFGSQMGKPVSFSTFRRCNYPVRGEGHSLIMVEECGRYASFNAIPSLAWQMCTVVTGAGCALLLLVALAAVLGCCMEELISRMMGRCMGAAQFVGGLLISSGCALYPLGWNSPEIMQTCGNVSNQFQLGTCRLGWAYYCAGGGAAAAMLICTWLSCFAGRNPKPVILVESIMRNTNSYAMELDHCLKP

SEQ ID NO: 2369 - protein, 228 aa, unidentified
MCHVIVTCRSMLWTLLSIVVAFAELIAFMSADWLIGKARSRGGVEPAGPGGGSPEPYHPTLGIYARCIRNPGVQHFQRDTLCGPYAESFGEIASGFWQATAIFLAVGIFILCMVALVSVFTMCVQSIMKKSIFNVCGLLQGIAGLFLILGLILYPAGWGCQKAIDYCGHYASAYKPGDCSLGWAFYTAIGGTVLTFICAVFSAQAEIATSSDKVQEEIEEGKNLICLL

SEQ ID NO: 2370 - protein, 236 aa, unidentified
MPGAAAAAAAAAAAMLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKVLLSQYSLE

SEQ ID NO: 2371 - protein, 247 aa, unidentified
MLPSQEASKLYHEHYMRNSRAIGVLWAIFTICFAIINVVVFIQPYWVGDSVSTPKPGYFGLFHYCVGSGLAGRELTCRGSFTDFSTIPSSAFKAAAFFVLLSMVLILGCITCFSLFFFCNTATVYKICAWMQLLAALCLVLGCMIFPDGWDAETIRDMCGAKTGKYSLGDCSVRWAYILAIIGILNALILSFLAFVLGNRQTDLLQEELKPENKDFVGSTVSSVLRPGGDVSGWGVLPCPVAHSQGP

SEQ ID NO: 2372 - protein, 219 aa, unidentified
MVKLLPAQEAAKIYHTNYVRNSRAVGVMWGTLTICFSVLVMALFIQPYWIGDSVNTPQAGYFGLFSYCVGNVLSSELICKGGPLDFSSIPSRAFKTAMFFVALGMFLIIGSIICFSLFFICNTATVYKICAWMQLAAATGLMIGCLVYPDGWDSSEVRRMCGEQTGKYTLGHCTIRWAFMLAILSIGDALILSFLAFVLGYRQDKLLPDDYKADGTEEV

SEQ ID NO: 2373 - protein, 1097 aa, unidentified
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 2374 - protein, 489 aa, unidentified
MTPIVTVLICLRLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGVSKKPSLSVQPGPIVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGAANTLSPSQNKTASHPQDYTVENLIRMGIAGLVLVVLGILLFEAQHSQRSL

SEQ ID NO: 2375 - protein, 483 aa, unidentified
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSEAAETLSPSQNKTDSTTTSLGQHPQDYTVENLIRMGVAGLVLVVLGILLFEAQHSQRSLQDAAGR

SEQ ID NO: 2376 - protein, 499 aa, unidentified
MTLILTSLLFFGLSLGPRTRVQAENLPKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGVSRKPSLLTLQGPVVTPGENLTLQCGSDVGYIRYTLYKEGADGLPQRPGRQPQAGLSQANFTLSPVSRSYGGQYRCYGAHNVSSEWSAPSDPLDILIAGQISDRPSLSVQPGPTVTSGEKVTLLCQSWDPMFTFLLTKEGAAHPPLRLRSMYGAHKYQAEFPMSPVTSAHAGTYRCYGSRSSNPYLLSHPSEPLELVVSGATETLNPAQKKSDSKTAPHLQDYTVENLIRMGVAGLVLLFLGILLFEAQHSQRSPPRCSQEANSRKDNAPFRVVEPWEQI

SEQ ID NO: 2377 - protein, 299 aa, unidentified
MAPWSHPSAQLQPVGGDAVSPALMVLLCLGLSLGPRTHVQAGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGAADNLSPSQNKSDSGTASHLQDYAVENLIRMGMAGLILVVLGILIFQDWHSQRSPQAAAGR

SEQ ID NO: 2378 - protein, 650 aa, unidentified
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 2379 - protein, 598 aa, unidentified
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 2380 - protein, 631 aa, unidentified
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 2381 - protein, 448 aa, unidentified
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEDPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 2382 - protein, 590 aa, unidentified
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 2383 - protein, 173 aa, unidentified
MYSFMGGGLFCAWVGTILLVVAMATDHWMQYRLSGSFAHQGLWRYCLGNKCYLQTDSIAYWNATRAFMILSALCAISGIIMGIMAFAHQPTFSRISRPFSAGIMFFSSTLFVVLALAIYTGVTVSFLGRRFGDWRFSWSYILGWVAVLMTFFAGIFYMCAYRVHECRRLSTPR

SEQ ID NO: 2384 - protein, 620 aa, unidentified
MQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 2385 - protein, 606 aa, unidentified
MLHTAISCWQPFLGLAVVLIFMGSTIGCPARCECSAQNKSVSCHRRRLIAIPEGIPIETKILDLSKNRLKSVNPEEFISYPLLEEIDLSDNIIANVEPGAFNNLFNLRSLRLKGNRLKLVPLGVFTGLSNLTKLDISENKIVILLDYMFQDLHNLKSLEVGDNDLVYISHRAFSGLLSLEQLTLEKCNLTAVPTEALSHLRSLISLHLKHLNINNMPVYAFKRLFHLKHLEIDYWPLLDMMPANSLYGLNLTSLSVTNTNLSTVPFLAFKHLVYLTHLNLSYNPISTIEAGMFSDLIRLQELHIVGAQLRTIEPHSFQGLRFLRVLNVSQNLLETLEENVFSSPRALEVLSINNNPLACDCRLLWILQRQPTLQFGGQQPMCAGPDTIRERSFKDFHSTALSFYFTCKKPKIREKKLQHLLVDEGQTVQLECSADGDPQPVISWVTPRRRFITTKSNGRATVLGDGTLEIRFAQDQDSGMYVCIASNAAGNDTFTASLTVKGFASDRFLYANRTPMYMTDSNDTISNGTNANTFSLDLKTILVSTAMGCFTFLGVVLFCFLLLFVWSRGKGKHKNSIDLEYVPRKNNGAVVEGEVAGPRRFNMKMI

SEQ ID NO: 2386 - protein, 592 aa, unidentified
MTCWLCVLSLPLLLLPAAPPPAGGCPARCECTVQTRAVACTRRRLTAVPDGIPAETRLLELSRNRIRCLNPGDLAALPALEELDLSENAIAHVEPGAFANLPRLRVLRLRGNQLKLIPPGVFTRLDNLTLLDLSENKLVILLDYTFQDLHSLRRLEVGDNDLVFVSRRAFAGLLALEELTLERCNLTALSGESLGHLRSLGALRLRHLAIASLEDQNFRRLPGLLHLEIDNWPLLEEVAAGSLRGLNLTSLSVTHTNITAVPAAALRHQAHLTCLNLSHNPISTVPRGSFRDLVRLRELHLAGALLAVVEPQAFLGLRQIRLLNLSNNLLSTLEESTFHSVNTLETLRVDGNPLACDCRLLWIVQRRKTLNFDGRLPACATPAEVRGDALRNLPDSVLFEYFVCRKPKIRERRLQRVTATAGEDVRFLCRAEGEPAPTVAWVTPQHRPVTATSAGRARVLPGGTLEIQDARPQDSGTYTCVASNAGGNDTYFATLTVRPEPAANRTPGEAHNETLAALRAPLDLTTILVSTAMGCITFLGVVLFCFVLLFVWSRGRGQHKNNFSVEYSFRKVDGPAAAAGQGGARKFNMKMI

SEQ ID NO: 2387 - protein, 593 aa, unidentified
MDAATAPKQAWPPWPPLLFLLLLPGGSGGSCPAVCDCTSQPQAVLCGHRQLEAVPGGLPLDTELLDLSGNRLWGLQQGMLSRLSLLQELDLSYNQLSTLEPGAFHGLQSLLTLRLQGNRLRIMGPGVFSGLSALTLLDLRLNQIVLFLDGAFGELGSLQKLEVGDNHLVFVAPGAFAGLAKLSTLTLERCNLSTVPGLALARLPALVALRLRELDIGRLPAGALRGLGQLKELEIHLWPSLEALDPGSLVGLNLSSLAITRCNLSSVPFQALYHLSFLRVLDLSQNPISAIPARRLSPLVRLQELRLSGACLTSIAAHAFHGLTAFHLLDVADNALQTLEETAFPSPDKLVTLRLSGNPLTCDCRLLWLLRLRRHLDFGMSPPACAGPHHVQGKSLKEFSDILPPGHFTCKPALIRKSGPRWVIAEEGGHAVFSCSGDGDPAPTVSWMRPHGAWLGRAGRVRVLEDGTLEIRSVQLRDRGAYVCVVSNVAGNDSLRTWLEVIQVEPPNGTLSDPNITVPGIPGPFFLDSRGVAMVLAVGFLPFLTSVTLCFGLIALWSKGKGRVKHHMTFDFVAPRPSGDKNSGGNRVTAKLF

SEQ ID NO: 2388 - protein, 161 aa, unidentified
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 2389 - protein, 510 aa, unidentified
MAGSRQRGLRARVRPLFCALLLSLGRFVRGDGVGGDPAVALPHRRFEYKYSFKGPHLVQSDGTVPFWAHAGNAIPSSDQIRVAPSLKSQRGSVWTKTKAAFENWEVEVTFRVTGRGRIGADGLAIWYAENQGLEGPVFGSADLWNGVGIFFDSFDNDGKKNNPAIVIIGNNGQIHYDHQNDGASQALASCQRDFRNKPYPVRAKITYYQNTLTVMINNGFTPDKNDYEFCAKVENMIIPAQGHFGISAATGGLADDHDVLSFLTFQLTEPGKEPPTPDKEISEKEKEKYQEEFEHFQQELDKKKEEFQKGHPDLQGQPAEEIFESVGDRELRQVFEGQNRIHLEIKQLNRQLDMILDEQRRYVSSLTEEISKRGAGMPGQHGQITQQELDTVVKTQHEILRQVNEMKNSMSETVRLVSGMQHPGSAGGVYETTQHFIDIKEHLHIVKRDIDNLVQRNMPSNEKPKCPELPPFPSCLSTVHFIIFVVVQTVLFIGYIMYRSQQEAAAKKFF

SEQ ID NO: 2390 - protein, 526 aa, unidentified
MPAVSGPGPLFCLLLLLLDPHSPETGCPPLRRFEYKLSFKGPRLALPGAGIPFWSHHGDAILGLEEVRLTPSMRNRSGAVWSRASVPFSAWEVEVQMRVTGLGRRGAQGMAVWYTRGRGHVGSVLGGLASWDGIGIFFDSPAEDTQDSPAIRVLASDGHIPSEQPGDGASQGLGSCHWDFRNRPHPFRARITYWGQRLRMSLNSGLTPSDPGEFCVDVGPLLLVPGGFFGVSAATGTLADDHDVLSFLTFSLSEPSPEVPPQPFLEMQQLRLARQLEGLWARLGLGTREDVTPKSDSEAQGEGERLFDLEETLGRHRRILQALRGLSKQLAQAERQWKKQLGPPGQARPDGGWALDASCQIPSTPGRGGHLSMSLNKDSAKVGALLHGQWTLLQALQEMRDAAVRMAAEAQVSYLPVGIEHHFLELDHILGLLQEELRGPAKAAAKAPRPPGQPPRASSCLQPGIFLFYLLIQTVGFFGYVHFRQELNKSLQECLSTGSLPLGPAPHTPRALGILRRQPLPASMPA

SEQ ID NO: 2391 - protein, 356 aa, unidentified
MAAEGWIWRWGWGRRCLGRPGLLGPGPGPTTPLFLLLLLGSVTADITDGNSEHLKREHSLIKPYQGVGSSSMPLWDFQGSTMLTSQYVRLTPDERSKEGSIWNHQPCFLKDWEMHVHFKVHGTGKKNLHGDGIALWYTRDRLVPGPVFGSKDNFHGLAIFLDTYPNDETTERVFPYISVMVNNGSLSYDHSKDGRWTELAGCTADFRNRDHDTFLAVRYSRGRLTVMTDLEDKNEWKNCIDITGVRLPTGYYFGASAGTGDLSDNHDIISMKLFQLMVEHTPDEESIDWTKIEPSVNFLKSPKDNVDDPTGNFRSGPLTGWRVFLLLLCALLGIVVCAVVGAVVFQKRQERNKRFY

SEQ ID NO: 2392 - protein, 348 aa, unidentified
MAATLGPLGSWQQWRRCLSARDGSRMLLLLLLLGSGQGPQQVGAGQTFEYLKREHSLSKPYQGVGTGSSSLWNLMGNAMVMTQYIRLTPDMQSKQGALWNRVPCFLRDWELQVHFKIHGQGKKNLHGDGLAIWYTKDRMQPGPVFGNMDKFVGLGVFVDTYPNEEKQQERVFPYISAMVNNGSLSYDHERDGRPTELGGCTAIVRNLHYDTFLVIRYVKRHLTIMMDIDGKHEWRDCIEVPGVRLPRGYYFGTSSITGDLSDNHDVISLKLFELTVERTPEEEKLHRDVFLPSVDNMKLPEMTAPLPPLSGLALFLIVFFSLVFSVFAIVIGIILYNKWQEQSRKRFY

SEQ ID NO: 2393 - protein, 490 aa, unidentified
MEGQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 2394 - protein, 489 aa, unidentified
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 2395 - protein, 540 aa, unidentified
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDADAPEDQCTVTRTYLFLHKFWFFSAAYYFGNWAFLGVFLIGLIVSCCKGKKSVIEGVDEDSDISDDEPSVYSA

SEQ ID NO: 2396 - protein, 695 aa, unidentified
MSGAALGLEIVFVFFLALFLLHRYGDFKKQHRLVIIGTLLAWYLCFLIVFILPLDVSTTIYNRCKHAAANSSPPENSNITGLYATANPVPSQHPCFKPWSYIPDGIMPIFWRVVYWTSQFLTWILLPFMQSYARSGGFSITGKIKTALIENAIYYGTYLLIFGAFLIYVAVNPHLHLEWNQLQTIGIAAANTWGLFLLVLLLGYGLVEIPRSYWNGAKRGYLLMKTYFKAAKLMTEKADAEENLEDAMEEVRKVNESIKYNHPLRKCVDTILKKCPTEYQEKMGRNMDDYEDFDEKHSIYPSEKSLVKLHKQVIYSVQRHRRTQVQWQILLEQAFYLEDVAKNETSATHQFVHTFQSPEPENRFIQYFYNPTFEWYWECLLRPWFYKILAVVLSIFSVIVVWSECTFFSTTPVLSLFAVFIQLAEKTYNYIYIEIACFLSIFFLSICVYSTVFRIRVFNYYYLASHHQTDAYSLLFSGMLFCRLTPPLCLNFLGLTHMDSSISHKNTQPTAYTSIMGSMKVLSFIADGFYIYYPMLVVILCIATYFSLGTRCLNLLGFQQFMGDDDMTSDLVNEGKELIRKEKRKRQRQEEGENRRREWKERYGHNREDSTRNRNIHTDPKESNFSDVNTNRSAFKYTRANNRTERDRIELLQDAEPLDFNAETFTDDPLESESGRYQPGGRYLSMSRSDIFNDV

SEQ ID NO: 2397 - protein, 567 aa, unidentified
MRPDSPTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFGWESQLLETGFLGIFLCPLWTLSRLPQHTPTSRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 2398 - protein, 707 aa, unidentified
MAGSRLPRQLFLQGVAAVFMFAFASLYTQIPGLYGPEGILPARRTLRPQGKGRWQQLWETPTLLWEAPRLGLDTAQGLELLSLLGALVALGALLLSPLRHPVIYLLLWAAYLSACQVGQVFLYFQWDSLLLETGFLAVLVAPLRPASHRKEAPQGRQAGALPHEDLPFWLVRWLLFRLMFASGVVKLTSRCPAWWGLTALTYHYETQCLPTPAAWFAHHLPVWLHKLSVVATFLIEIAVPPLFFAPIRRLRLAAFYSQVLLQVLIIITGNYNFFNLMTLVLTTALLDDQHLAAEPGHGSRKKTATSWPKALLATLSLLLELAVYGLLAYGTVHYFGLEVDWQQRTIHSRTTFTFHQFSQWLKTLTLPTVWLGVASLVWELLSALWRWTQVRGWLRKLSAVVQLSLVGTATVALFLISLVPYSYVEPGTHGRLWTGAHRLFGAVEHLQLANSYGLFRRMTGLGGRPEVVLEGSYDGHHWTEIEFMYKPGNLSRPPPVVVPHQPRLDWQMWFAALGPHTHSPWFTSLVLRLLQGKEPVIRLVQSQVARYPFHKQPPTYVRAQRYKYWFSQPGEQGQWWRRQWVEEFFPSVSLGDPTLETLLRQFGLQEKSPPRTRSANSTLAQALHWTRSQLSPLEAPALLWGLLMAVGAVRFVQALLAPCSLRSSPLAPVSGEKRRPASQKDSGAASEQATAAPNPCSSSSRTTRRKK

SEQ ID NO: 2399 - protein, 655 aa, unidentified
MVTTLGPKMAAEWGGGVGYSGSGPGRSRWRWSGSVWVRSVLLLLGGLRASATSTPVSLGSSPPCRHHVPSDTEVINKVHLKANHVVKRDVDEHLRIKTVYDKSVEELLPEKKNLVKNKLFPQAISYLEKTFQVRRPAGTILLSRQCATNQYLRKENDPHRYCTGECAAHTKCGPVIVPEEHLQQCRVYRGGKWPHGAVGVPDQEGISDADFVLYVGALATERCSHENIISYAAYCQQEANMDRPIAGYANLCPNMISTQPQEFVGMLSTVKHEVIHALGFSAGLFAFYHDKDGNPLTSRFADGLPPFNYSLGLYQWSDKVVRKVERLWDVRDNKIVRHTVYLLVTPRVVEEARKHFDCPVLEGMELENQGGVGTELNHWEKRLLENEAMTGSHTQNRVLSRITLALMEDTGRQMLSPYCDTLRSNPLQLTCRQDQRAVAVCNLQKFPKPLPQEYQYFDELSGIPAEDLPYYGGSVEIADYCPFSQEFSWHLSGEYQRSSDCRILENQPEIFKNYGAEKYGPHSVCLIQKSAFVMEKCERKLSYPDWGSGCYQVSCSPQGLKVWVQDTSYLCSRAGQVLPVSIQMNGWIHDGNLLCPSCWDFCELCPPETDPPATNLTRALPLDLCSCSSSLVVTLWLLLGNLFPLLAGFLLCIWH

SEQ ID NO: 2400 - protein, 1683 aa, unidentified
MKKIRICHIFTFYSWMSYDVLFQRTELGALEIWRQLICAHVCICVGWLYLRDRVCSKKDIILRTEQNSGRTILIKAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGFSQFLLLQALQTYSDDILSSETHTKIDPTSGPRLITRRKNLSYAPGYRRDDLEMAALDPDLENDDFFVRKTGVFHANPYVLRAFEDFRKFSEQDDSVERDIILQCREGELVLPDLEKDDMIVRRIPAQKKEVPLSGAPDRYHPVPFPEPWTLPPEIQAKFLCVFERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 2401 - protein, 1503 aa, unidentified
MPGPPALRRRLLLLLLVLLIAGSAGAAPLPQTGAGEAPPAAEVSSSFVILCVCSLIILIVLIANCVSCCKDPEIDFKEFEDNFDDEIDFTPPAEDTPSVQSPAEVFTLSVPNISLPAPSQFQPSVEGLKSQVARHSLNYIQEIGNGWFGKVLLGEIYTGTSVARVIVKELKASANPKEQDTFLKNGEPYYILQHPNILQCVGQCVEAIPYLLVFEFCDLGDLKAYLRSEQEHMRGDSQTMLLQRMACEVAAGLAAMHKLHFLHSDLALRNCFLTSDLNVKVGDYGIGFSRYKEDYIETDDKKVFPLRWTAPELVTSFQDRLLTADQTKYSNIWSLGVTLWELFDNAAQPYSNLSNLDVLNQVIRERDTKLPKPQLEQPYSDRWYEVLQFCWLSPEKRPAAEDVHRLLTYLRLQSQRDSEVDFEQQWNALKPNTNSRDSSNNAAFPILDHFARDRLGREMEEVLTVTETSQGLSFEYVWEAAKHDHFDERSRGHLDEGLSYTSIFYPVEVFESSLSDPGPGKQDDSGQDVPLRVPGVVPVFDAHNLSVGSDYYIQLEEKSGSNLELDYPPALLTTDMDNPERTGPELSQLTALRSVELEESSTDEDFFQSSTDPKDSSLPGDLHVTSGPESPFNNIFNDVDKSEDLPSHQKIFDLMELNGVQADFKPATLSSSLDNPKESVITGHFEKEKPRKIFDSEPLCLSDNLMHQDNFDPLNVQELSENFLFLQEKNLLKGSLSSKEHINDLQTELKNAGFTEAMLETSCRNSLDTELQFAENKPGLSLLQENVSTKGDDTDVMLTGDTLSTSLQSSPEVQVPPTSFETEETPRRVPPDSLPTQGETQPTCLDVIVPEDCLHQDISPDAVTVPVEILSTDARTHSLDNRSQDSPGESEETLRLTESDSVLADDILASRVSVGSSLPELGQELHNKPFSEDHHSHRRLEKNLEAVETLNQLNSKDAAKEAGLVSALSSDSTSQDSLLEDSLSAPFPASEPSLETPDSLESVDVHEALLDSLGSHTPQKLVPPDKPADSGYETENLESPEWTLHPAPEGTADSEPATTGDGGHSGLPPNPVIVISDAGDGHRGTEVTPETFTAGSQGSYRDSAYFSDNDSEPEKRSEEVPGTSPSALVLVQEQPLPEPVLPEQSPAAQDSCLEARKSQPDESCLSALHNSSDLELRATPEPAQTGVPQQVHPTEDEASSPWSVLNAELSSGDDFETQDDRPCTLASTGTNTNELLAYTNSALDKSLSSHSEGPKLKEPDIEGKYLGKLGVSGMLDLSEDGMDADEEDENSDDSDEDLRAFNLHSLSSESEDETEHPVPIILSNEDGRHLRSLLKPTAANAPDPLPEDWKKEKKAVTFFDDVTVYLFDQETPTKELGPCGGEACGPDLSGPAPASGSPYLSRCINSESSTDEEGGGFEWDDDFSPDPFMSKTTSNLLSSKPSLQTSKYFSPPPPARSTEQSWPHSAPYSRFSISPANIASFSLTHLTDSDIEQGGSSEDGEKD

SEQ ID NO: 2402 - protein, 1025 aa, unidentified
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPEKIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 2403 - protein, 428 aa, unidentified
MGGLFSRWRTKPSTVEVLESIDKEIQALEEFREKNQRLQKLWVGRLILYSSVLYLFTCLIVYLWYLPDEFTARLAMTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 2404 - protein, 364 aa, unidentified
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 2405 - protein, 351 aa, unidentified
MVIMGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMDSTL

SEQ ID NO: 2406 - protein, 353 aa, unidentified
MNECHYDKHMDFFYNRSNTDTVDDWTGTKLVIVLCVGTFFCLFIFFSNSLVIAAVIKNRKFHFPFYYLLANLAAADFFAGIAYVFLMFNTGPVSKTLTVNRWFLRQGLLDSSLTASLTNLLVIAVERHMSIMRMRVHSNLTKKRVTLLILLVWAIAIFMGAVPTLGWNCLCNISACSSLAPIYSRSYLVFWTVSNLMAFLIMVVVYLRIYVYVKRKTNVLSPHTSGSISRRRTPMKLMKTVMTVLGAFVVCWTPGLVVLLLDGLNCRQCGVQHVKRWFLLLALLNSVVNPIIYSYKDEDMYGTMKKMICCFSQENPERRPSRIPSTVLSRSDTGSQYIEDSISQGAVCNKSTS

SEQ ID NO: 2407 - protein, 370 aa, unidentified
MGDRRFIDFQFQDSNSSLRPRLGNATANNTCIVDDSFKYNLNGAVYSVVFILGLITNSVSLFVFCFRMKMRSETAIFITNLAVSDLLFVCTLPFKIFYNFNRHWPFGDTLCKISGTAFLTNIYGSMLFLTCISVDRFLAIVYPFRSRTIRTRRNSAIVCAGVWILVLSGGISASLFSTTNVNNATTTCFEGFSKRVWKTYLSKITIFIEVVGFIIPLILNVSCSSVVLRTLRKPATLSQIGTNKKKVLKMITVHMAVFVVCFVPYNSVLFLYALVRSQAITNCFLERFAKIMYPITLCLATLNCCFDPFIYYFTLESFQKSFYINAHIRMESLFKTETPLTTKPSLPAIQEEVSDQTTNNGGELMLESTF

SEQ ID NO: 2408 - protein, 372 aa, unidentified [sequence omitted]

SEQ ID NO: 2409 - protein, 344 aa, unidentified
MVSVNSSHCFYNDSFKYTLYGCMFSMVFVLGLISNCVAIYIFICVLKVRNETTTYMINLAMSDLLFVFTLPFRIFYFTTRNWPFGDLLCKISVMLFYTNMYGSILFLTCISVDRFLAIVYPFKSKTLRTKRNAKIVCTGVWLTVIGGSAPAVFVQSTHSQGNNASEACFENFPEATWKTYLSRIVIFIEIVGFFIPLILNVTCSSMVLKTLTKPVTLSRSKINKTKVLKMIFVHLIIFCFCFVPYNINLILYSLVRTQTFVNCSVVAAVRTMYPITLCIAVSNCCFDPIVYYFTSDTIQNSIKMKNWSVRRSDFRFSEVHGAENFIQHNLQTLKSKIFDNESAA

SEQ ID NO: 2410 - protein, 534 aa, unidentified
MRLRGCGPRAAPASSAGASDARLLAPPGRNPFVHELRLSALQKAQVALMTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRTCLITFKPGAFIPGAPVQPVVLRYPNKLDTITWTWQGPGALEILWLTLCQFHNQVEIEFLPVYSPSEEEKRNPALYASNVRRVMAEALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 2411 - protein, 544 aa, unidentified
MSRCAQAAEVAATVPGAGVGNVGLRPPMVPRQASFFPPPVPNPFVQQTQIGSARRVQIVLLGIILLPIRVLLVALILLLAWPFAAISTVCCPEKLTHPITGWRRKITQTALKFLGRAMFFSMGFIVAVKGKIASPLEAPVFVAAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLDTVTWTWQGYTFIQLCMLTFCQLFTKVEVEFMPVQVPNDEEKNDPVLFANKVRNLMAEALGIPVTDHTYEDCRLMISAGQLTLPMEAGLVEFTKISRKLKLDWDGVRKHLDEYASIASSSKGGRIGIEEFAKYLKLPVSDVLRQLFALFDRNHDGSIDFREYVIGLAVLCNPSNTEEIIQVAFKLFDVDEDGYITEEEFSTILQASLGVPDLDVSGLFKEIAQGDSISYEEFKSFALKHPEYAKIFTTYLDLQTCHVFSLPKEVQTTPSTASNKVSPEKHEESTSDKKDD

SEQ ID NO: 2412 - protein, 487 aa, unidentified
MASSAEGDEGTVVALAGVLQSGFQELSLNKLATSLGASEQALRLIISIFLGYPFALFYRHYLFYKETYLIHLFHTFTGLSIAYFNFGNQLYHSLLCIVLQFLILRLMGRTITAVLTTFCFQMAYLLAGYYYTATGNYDIKWTMPHCVLTLKLIGLAVDYFDGGKDQNSLSSEQQKYAIRGVPSLLEVAGFSYFYGAFLVGPQFSMNHYMKLVQGELIDIPGKIPNSIIPALKRLSLGLFYLVGYTLLSPHITEDYLLTEDYDNHPFWFRCMYMLIWGKFVLYKYVTCWLVTEGVCILTGLGFNGFEEKGKAKWDACANMKVWLFETNPRFTGTIASFNINTNAWVARYIFKRLKFLGNKELSQGLSLLFLALWHGLHSGYLVCFQMEFLIVIVERQAARLIQESPTLSKLAAITVLQPFYYLVQQTIHWLFMGYSMTAFCLFTWDKWLKVYKSIYFLGHIFFLSLLFILPYIHKAMVPRKEKLKKME

SEQ ID NO: 2413 - protein, 524 aa, unidentified
MSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFELFAEEQAEGPNRLLYKDGFSTILHLLLGSPHPAATALHAELCQAGSSQGLSLCQFQNFSLHDPLYGKLFSTYLRPPHTSRGTSQTPNASSPGNPTALANGTVQAPKQKGD

SEQ ID NO: 2414 - protein, 370 aa, unidentified
MAITLEEAPWLGWLLVKALMRFAFMVVNNLVAIPSYICYVIILQPLRVLDSKRFWYIEGIMYKWLLGMVASWGWYAGYTVMEWGEDIKAVSKDEAVMLVNHQATGDVCTLMMCLQDKGLVVAQMMWLMDHIFKYTNFGIVSLVHGDFFIRQGRSYRDQQLLLLKKHLENNYRSRDRKWIVLFPEGGFLRKRRETSQAFAKKNNLPFLTNVTLPRSGATKIILNALVAQQKNGSPAGGDAKELDSKSKGLQWIIDTTIAYPKAEPIDIQTWILGYRKPTVTHVHYRIFPIKDVPLETDDLTTWLYQRFVEKEDLLSHFYETGAFPPSKGHKEAVSREMTLSNLWIFLIQSFAFLSGYMWYNIIQYFYHCLF

SEQ ID NO: 2415 - protein, 230 aa, unidentified
MKNPMLEVVSLLLEKLLLISNFTLFSSGAAGEDKGRNSFYETSSFHRGDVLEVPRTHLTHYGIYLGDNRVAHMMPDILLALTDDMGRTQKVVSNKRLILGVIVKVASIRVDTVEDFAYGANILVNHLDESLQKKALLNEEVARRAEKLLGFTPYSLLWNNCEHFVTYCRYGTPISPQSDKFCETVKIIIRDQRSVLASAVLGLASIVCTGLVSYTTLPAIFIPFFLWMAG

SEQ ID NO: 2416 - protein, 2863 aa, unidentified
MASEDNRVPSPPPTGDDGGGGGREETPTEGGALSLKPGLPIRGIRMKFAVLTGLVEVGEVSNRDIVETVFNLLVGGQFDLEMNFIIQEGESINCMVDLLEKCDITCQAEVWSMFTAILKKSIRNLQVCTEVGLVEKVLGKIEKVDNMIADLLVDMLGVLASYNLTVRELKLFFSKLQGDKGRWPPHAGKLLSVLKHMPQKYGPDAFFNFPGKSAAAIALPPIAKWPYQNGFTFHTWLRMDPVNNINVDKDKPYLYCFRTSKGLGYSAHFVGGCLIVTSIKSKGKGFQHCVKFDFKPQKWYMVTIVHIYNRWKNSELRCYVNGELASYGEITWFVNTSDTFDKCFLGSSETADANRVFCGQMTAVYLFSEALNAAQIFAIYQLGLGYKGTFKFKAESDLFLAEHHKLLLYDGKLSSAIAFTYNPRATDAQLCLESSPKDNPSIFVHSPHALMLQDVKAVLTHSIQSAMHSIGGVQVLFPLFAQLDYRQYLSDEIDLTICSTLLAFIMELLKNSIAMQEQMLACKGFLVIGYSLEKSSKSHVSRAVLELCLAFSKYLSNLQNGMPLLKQLCDHVLLNPAIWIHTPAKVQLMLYTYLSTEFIGTVNIYNTIRRVGTVLLIMHTLKYYYWAVNPQDRSGITPKGLDGPRPNQKEMLSLRAFLLMFIKQLVMKDSGVKEDELQAILNYLLTMHEDDNLMDVLQLLVALMSEHPNSMIPAFDQRNGLRVIYKLLASKSEGIRVQALKAMGYFLKHLAPKRKAEVMLGHGLFSLLAERLMLQTNLITMTTYNVLFEILIEQIGTQVIHKQHPDPDSSVKIQNPQILKVIATLLRNSPQCPESMEVRRAFLSDMIKLFNNSRENRRSLLQCSVWQEWMLSLCYFNPKNSDEQKITEMVYAIFRILLYHAVKYEWGGWRVWVDTLSITHSKVTFEIHKENLANIFREQQGKVDEEIGLCSSTSVQAASGIRRDINVSVGSQQPDTKDSPVCPHFTTNGNENSSIEKTSSLESASNIELQTTNTSYEEMKAEQENQELPDEGTLEETLTNETRNADDLEVSSDIIEAVAISSNSFITTGKDSMTVSEVTASISSPSEEDASEMPEFLDKSIVEEEEDDDYVELKVEGSPTEEANLPTELQDNSLSPAASEAGEKLDMFGNDDKLIFQEGKPVTEKQTDTETQDSKDSGIQTMTASGSSAMSPETTVSQIAVESDLGQMLEEGKKATNLTRETKLINDCHGSVSEASSEQKIAKLDVSNVATDTERLELKASPNVEAPQPHRHVLEISRQHEQPGQGIAPDAVNGQRRDSRSTVFRIPEFNWSQMHQRLLTDLLFSIETDIQMWRSHSTKTVMDFVNSSDNVIFVHNTIHLISQVMDNMVMACGGILPLLSAATSATHELENIEPTQGLSIEASVTFLQRLISLVDVLIFASSLGFTEIEAEKSMSSGGILRQCLRLVCAVAVRNCLECQQHSQLKTRGDKALKPMHSLIPLGKSAAKSPVDIVTGGISPVRDLDRLLQDMDINRLRAVVFRDIEDSKQAQFLALAVVYFISVLMVSKYRDILEPQNERHSQSCTETGSENENVSLSEITPAAFSTLTTASVEESESTSSARRRDSGIGEETATGLGSHVEVTPHTAPPGVSAGPDAISEVLSTLSLEVNKSPETKNDRGNDLDTKATPSVSVSKNVNVKDILRSLVNIPADGVTVDPALLPPACLGALGDLSVEQPVQFRSFDRSVIVAAKKSAVSPSTFNTSIPTNAVSVVSSVDSAQASDMGGESPGSRSSNAKLPSVPTVDSVSQDPVSNMSITERLEHALEKAAPLLREIFVDFAPFLSRTLLGSHGQELLIEGTSLVCMKSSSSVVELVMLLCSQEWQNSIQKNAGLAFIELVNEGRLLSQTMKDHLVRVANEAEFILSRQRAEDIHRHAEFESLCAQYSADKREDEKMCDHLIRAAKYRDHVTATQLIQKIINILTDKHGAWGNSAVSRPLEFWRLDYWEDDLRRRRRFVRNPLGSTHPEATLKTAVEHVCIFKLRENSKATDEDILAKGKQSIRSQALGNQNSENEILLEGDDDTLSSVDEKDLENLAGPVSLSTPAQLVAPSVVVKGTLSVTSSELYFEVDEEDPNFKKIDPKILAYTEGLHGKWLFTEIRSIFSRRYLLQNTALEIFMANRVAVMFNFPDPATVKKVVNYLPRVGVGTSFGLPQTRRISLASPRQLFKASNMTQRWQHREISNFEYLMFLNTIAGRSYNDLNQYPVFPWVITNYESEELDLTLPTNFRDLSKPIGALNPKRAAFFAERYESWEDDQVPKFHYGTHYSTASFVLAWLLRIEPFTTYFLNLQGGKFDHADRTFSSISRAWRNSQRDTSDIKELIPEFYYLPEMFVNFNNYNLGVMDDGTVVSDVELPPWAKTSEEFVHINRLALESEFVSCQLHQWIDLIFGYKQQGPEAVRALNVFYYLTYEGAVNLNSITDPVLREAVEAQIRSFGQTPSQLLIEPHPPRGSAMQVSPLMFTDKAQQDVIMVLKFPSNSPVTHVAANTQPGLATPAVITVTANRLFAVNKWHNLPAHQGAVQDQPYQLPVEIDPLIASNTGMHRRQITDLLDQSIQVHSQCFVITSDNRYILVCGFWDKSFRVYSTDTGRLIQVVFGHWDVVTCLARSESYIGGNCYILSGSRDATLLLWYWNGKCSGIGDNPGSETAAPRAILTGHDYEVTCAAVCAELGLVLSGSQEGPCLIHSMNGDLLRTLEGPENCLKPKLIQASREGHCVIFYENGLFCTFSVNGKLQATMETDDNIRAIQLSRDGQYLLTGGDRGVVVVRQVSDLKQLFAYPGCDAGIRAMALSYDQRCIISGMASGSIVLFYNDFNRWHHEYQTRY

SEQ ID NO: 2417 - protein, 728 aa, unidentified
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLSLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEADLCSPCDILQLDFRHIRKTVDTLLALGEKAPPPTSALRSRDLIGFCLVHILFIVLVYITYHWNALSA

SEQ ID NO: 2418 - protein, 777 aa, unidentified
MAAAGLVAVAAAAEYSGTVASGGNLPGVHCGPSSGAGPGFGPGSWSRSLDRALEEAAVTGVLSLSGRKLREFPRGAANHDLTDTTRADLSRNRLSEIPIEACHFVSLENLNLYQNCIRYIPEAILNLQALTFLNISRNQLSTLPVHLCNLPLKVLIASNNKLVSLPEEIGHLRHLMELDVSCNEIQTIPSQIGNLEALRDLNVRRNHLVHLPEELAELPLIRLDFSCNKITTIPVCYRNLRHLQTITLDNNPLQSPPAQICIKGKVHIFKYLNIQACKIAPDLPDYDRRPLGFGSCHEELYSSRPYGALDSGFNSVDSGDKRWSGNEPTDEFSDLPLRVAEITKEQRLRRESQYQENRGSLVVTNGGVEHDLDQIDYIDSCTAEEEEAEVRQPKGPDPDSLSSQFMAYIEQRRISHEGSPVKPVAIREFQKTEDMRRYLHQNRVPAEPSSLLSLSASHNQLSHTDLELHQRREQLVERTRREAQLAALQYEEEKIRTKQIQRDAVLDFVKQKASQSPQKQHPLLDGVDGECPFPSRRSQHTDDSALCMSLSGLNQVGCAATLPHSSAFTPLKSDDRPNALLSSPATETVHHSPAYSFPAAIQRNQPQRPESFLFRAGVRAETNKGHASPLPPSAAPTTDSTDSITGQNSRQREEELELIDQLRKHIEYRLKVSLPCDLGAALTDGVVLCHLANHVRPRSVPSIHVPSPAVPKLTMAKCRRNVENFLEACRKIGVPQEQLCLPLHILEEKGLSQVAVTVQALLELAPPKQQQHQLSAV

SEQ ID NO: 2419 - protein, 683 aa, unidentified
MAAAVAAPLAAGGEEAAATTSVPGSPGLPGRRSAERALEEAVATGTLNLSNRRLKHFPRGAARSYDLSDITQADLSRNRFPEVPEAACQLVSLEGLSLYHNCLRCLNPALGNLTALTYLNLSRNQLSLLPPYICQLPLRVLIVSNNKLGALPPDIGTLGSLRQLDVSSNELQSLPSELCGLSSLRDLNVRRNQLSTLPEELGDLPLVRLDFSCNRVSRIPVSFCRLRHLQVILLDSNPLQSPPAQVCLKGKLHIFKYLSTEAGQRGSALGDLAPSRPPSFSPCPAEDLFPGHRYDGGLDSGFHSVDSGSKRWSGNESTDEFSELSFRISELAREPRGPRERKEDGSADGDPVQIDFIDSHVPGEDEERGTVEEQRPPELSPGAGDRERAPSSRREEPAGEERRRPDTLQLWQERERRQQQQSGAWGAPRKDSLLKPGLRAVVGGAAAVSTQAMHNGSPKSSASQAGAAAGQGAPAPAPASQEPLPIAGPATAPAPRPLGSIQRPNSFLFRSSSQSGSGPSSPDSVLRPRRYPQVPDEKDLMTQLRQVLESRLQRPLPEDLAEALASGVILCQLANQLRPRSVPFIHVPSPAVPKLSALKARKNVESFLEACRKMGVPEADLCSPSDLLQGTARGLRTALEAVKRVGGKALPPLWPPSGLGGFVVFYVVLMLLLYVTYTRLLGS

SEQ ID NO: 2420 - protein, 771 aa, unidentified
MAPGPFSSALLSPPPAALPFLLLLWAGASRGQPCPGRCICQNVAPTLTMLCAKTGLLFVPPAIDRRVVELRLTDNFIAAVRRRDFANMTSLVHLTLSRNTIGQVAAGAFADLRALRALHLDSNRLAEVRGDQLRGLGNLRHLILGNNQIRRVESAAFDAFLSTVEDLDLSYNNLEALPWEAVGQMVNLNTLTLDHNLIDHIAEGTFVQLHKLVRLDMTSNRLHKLPPDGLFLRSQGTGPKPPTPLTVSFGGNPLHCNCELLWLRRLTREDDLETCATPEHLTDRYFWSIPEEEFLCEPPLITRQAGGRALVVEGQAVSLRCRAVGDPEPVVHWVAPDGRLLGNSSRTRVRGDGTLDVTITTLRDSGTFTCIASNAAGEATAPVEVCVVPLPLMAPPPAAPPPLTEPGSSDIATPGRPGANDSAAERRLVAAELTSNSVLIRWPAQRPVPGIRMYQVQYNSSVDDSLVYRMIPSTSQTFLVNDLAAGRAYDLCVLAVYDDGATALPATRVVGCVQFTTAGDPAPCRPLRAHFLGGTMIIAIGGVIVASVLVFIVLLMIRYKVYGDGDSRRVKGSRSLPRVSHVCSQTNGAGTGAAQAPALPAQDHYEALREVESQAAPAVAVEAKAMEAETASAEPEVVLGRSLGGSATSLCLLPSEETSGEESRAAVGPRRSRSGALEPPTSAPPTLALVPGGAAARPRPQQRYSFDGDYGALFQSHSYPRRARRTKRHRSTPHLDGAGGGAAGEDGDLGLGSARACLAFTSTEWMLESTV

SEQ ID NO: 2421 - protein, 789 aa, unidentified
METLLGGLLAFGMAFAVVDACPKYCVCQNLSESLGTLCPSKGLLFVPPDIDRRTVELRLGGNFIIHISRQDFANMTGLVDLTLSRNTISHIQPFSFLDLESLRSLHLDSNRLPSLGEDTLRGLVNLQHLIVNNNQLGGIADEAFEDFLLTLEDLDLSYNNLHGLPWDSVRRMVNLHQLSLDHNLLDHIAEGTFADLQKLARLDLTSNRLQKLPPDPIFARSQASALTATPFAPPLSFSFGGNPLHCNCELLWLRRLERDDDLETCGSPGGLKGRYFWHVREEEFVCEPPLITQHTHKLLVLEGQAATLKCKAIGDPSPLIHWVAPDDRLVGNSSRTAVYDNGTLDIFITTSQDSGAFTCIAANAAGEATAMVEVSIVQLPHLSNSTSRTAPPKSRLSDITGSSKTSRGGGGSGGGEPPKSPPERAVLVSEVTTTSALVKWSVSKSAPRVKMYQLQYNCSDDEVLIYRMIPASNKAFVVNNLVSGTGYDLCVLAMWDDTATTLTATNIVGCAQFFTKADYPQCQSMHSQILGGTMILVIGGIIVATLLVFIVILMVRYKVCNHEAPSKMAAAVSNVYSQTNGAQPPPPSSAPAGAPPQGPPKVVVRNELLDFTASLARASDSSSSSSLGSGEAAGLGRAPWRIPPSAPRPKPSLDRLMGAFASLDLKSQRKEELLDSRTPAGRGAGTSARGHHSDREPLLGPPAARARSLLPLPLEGKAKRSHSFDMGDFAAAAAGGVVPGGYSPPRKVSNIWTKRSLSVNGMLLPFEESDLVGARGTFGSSEWVMESTV

SEQ ID NO: 2422 - protein, 628 aa, unidentified
MAILPLLLCLLPLAPASSPPQSATPSPCPRRCRCQTQSLPLSVLCPGAGLLFVPPSLDRRAAELRLADNFIASVRRRDLANMTGLLHLSLSRNTIRHVAAGAFADLRALRALHLDGNRLTSLGEGQLRGLVNLRHLILSNNQLAALAAGALDDCAETLEDLDLSYNNLEQLPWEALGRLGNVNTLGLDHNLLASVPAGAFSRLHKLARLDMTSNRLTTIPPDPLFSRLPLLARPRGSPASALVLAFGGNPLHCNCELVWLRRLAREDDLEACASPPALGGRYFWAVGEEEFVCEPPVVTHRSPPLAVPAGRPAALRCRAVGDPEPRVRWVSPQGRLLGNSSRARAFPNGTLELLVTEPGDGGIFTCIAANAAGEATAAVELTVGPPPPPQLANSTSCDPPRDGDPDALTPPSAASASAKVADTGPPTDRGVQVTEHGATAALVQWPDQRPIPGIRMYQIQYNSSADDILVYRMIPAESRSFLLTDLASGRTYDLCVLAVYEDSATGLTATRPVGCARFSTEPALRPCGAPHAPFLGGTMIIALGGVIVASVLVFIFVLLMRYKVHGGQPPGKAKIPAPVSSVCSQTNGALGPTPTPAPPAPEPAALRAHTVVQLDCEPWGPGHEPVGP

SEQ ID NO: 2423 - protein, 635 aa, unidentified
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSSAEGGRPGPSDIAASARTAAEGEGTLESEPAVQVTEVTATSGLVSWGPGRPADPVWMFQIQYNSSEDETLIYRIVPASSHHFLLKHLVPGADYDLCLLALSPAAGPSDLTATRLLGCAHFSTLPASPLCHALQAHVLGGTLTVAVGGVLVAALLVFTVALLVRGRGAGNGRLPLKLSHVQSQTNGGPSPTPKAHPPRSPPPRPQRSCSLDLGDAGCYGYARRLGGAWARRSHSVHGGLLGAGCRGVGGSAERLEESVV

SEQ ID NO: 2424 - protein, 719 aa, unidentified
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRMIPPTSKTFLVNNLAAGTMYDLCVLAIYDDGITSLTATRVVGCIQFTTEQDYVRCHFMQSQFLGGTMIIIIGGIIVASVLVFIIILMIRYKVCNNNGQHKVTKVSNVYSQTNGAQIQGCSVTLPQSVSKQAVGHEENAQCCKATSDNVIQSSETCSSQDSSTTTSALPPSWTSSTSVSQKQKRKTGTKPSTEPQNEAVTNVESQNTNRNNSTALQLASRPPDSVTEGPTSKRAHIKPNALLTNVDQIVQETQRLELI

SEQ ID NO: 2425 - protein, 1093 aa, unidentified
MARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 2426 - protein, 1065 aa, unidentified
MAPAPLGVPEEQLLGCRSRVLSRLLFIAQTALLLLPAAGAGLCPAPCSCRIPLLDCSRRKLPAPSWRALSGLLPPDTAILDFSHNRLSNWNISLESQTLQEVKMNYNELTEIPYFGEPTSNITLLSLVHNIIPEINAQALQFYPALESLDLSSNIISEIKTSSFPRMQLKYLNLSNNRITTLEAGCFDNLSSSLLVVKLNRNRMSMIPPKIFKLPHLQFLELKRNRIKIVEGLTFQGLDSLRSLKMQRNGISKLKDGAFFGLNNMEELELEHNNLTRVNKGWLYGLRMLQQLYVSQNAIERISPDAWEFCQRLSELDLSYNQLTRLDESAFVGLSLLERLNLGDNRVTHIADGVFRFLSNLQTLDLRNNEISWAIEDASEAFAGLTSLTKLILQGNQIKSITKKAFIGLESLEHLDLNNNAIMSIQENAFSQTHLKELILNTSSLLCDCHLKWLLQWLVDNNFQHSVNVSCAHPEWLAGQSILNVDLKDFVCDDFLKPQIRTHPETIIALRGMNVTLTCTAVSSSDSPMSTVWRKDSEILYDVDTENFVRYWQQAGEALEYTSILHLFNVNFTDEGKYQCIVTNHFGSNYSQKAKLTVNEMPSFLKTPMDLTIRTGAMARLECAAEGHPAPQISWQKDGGTDFPAARERRMHVMPEDDVFFIANVKIEDMGIYSCMAQNTAGGLSANASLTVLETPSFIRPLEDKTVTRGETAVLQCIAGGSPAPRLNWTKDDGPLLVTERHFFAAANQLLIIVDAGLEDAGKYTCIMSNTLGTERGHIYLNVISSPNCDSSQSSIGHEDDGWTTVGIVIIVVVCCVVGTSLIWVIVIYHMRRKNEDYSITNTEELNLPADIPSYLSSQGTLSEPQEGYSNSEAGSHQQLMPPANGYIHKGTDGGTGTRVICSDCYDNANIYSRTREYCPYTYIAEEDVLDQTLSSLMVQMPKETYLVHPPQDTTALESLIPSANREPSAFPTNHERISEKKLPSTQMSGETLQRPVWNINRELGLPHPPFSQQPVHESPQLHQNEGLAGREPDCSASSMSCHRLQDHAFDFSRTRNIQDGSEGT

SEQ ID NO: 2427 - protein, 1119 aa, unidentified
MSAPSLRARAAGLGLLLCAVLGRAGRSDSGGRGELGQPSGVAAERPCPTTCRCLGDLLDCSRKRLARLPEPLPSWVARLDLSHNRLSFIKASSMSHLQSLREVKLNNNELETIPNLGPVSANITLLSLAGNRIVEILPEHLKEFQSLETLDLSSNNISELQTAFPALQLKYLYLNSNRVTSMEPGYFDNLANTLLVLKLNRNRISAIPPKMFKLPQLQHLELNRNKIKNVDGLTFQGLGALKSLKMQRNGVTKLMDGAFWGLSNMEILQLDHNNLTEITKGWLYGLLMLQELHLSQNAINRISPDAWEFCQKLSELDLTFNHLSRLDDSSFLGLSLLNTLHIGNNRVSYIADCAFRGLSSLKTLDLKNNEISWTIEDMNGAFSGLDKLRRLILQGNRIRSITKKAFTGLDALEHLDLSDNAIMSLQGNAFSQMKKLQQLHLNTSSLLCDCQLKWLPQWVAENNFQSFVNASCAHPQLLKGRSIFAVSPDGFVCDDFPKPQITVQPETQSAIKGSNLSFICSAASSSDSPMTFAWKKDNELLHDAEMENYAHLRAQGGEVMEYTTILRLREVEFASEGKYQCVISNHFGSSYSVKAKLTVNMLPSFTKTPMDLTIRAGAMARLECAAVGHPAPQIAWQKDGGTDFPAARERRMHVMPEDDVFFIVDVKIEDIGVYSCTAQNSAGSISANATLTVLETPSFLRPLLDRTVTKGETAVLQCIAGGSPPPKLNWTKDDSPLVVTERHFFAAGNQLLIIVDSDVSDAGKYTCEMSNTLGTERGNVRLSVIPTPTCDSPQMTAPSLDDDGWATVGVVIIAVVCCVVGTSLVWVVIIYHTRRRNEDCSITNTDETNLPADIPSYLSSQGTLADRQDGYVSSESGSHHQFVTSSGAGFFLPQHDSSGTCHIDNSSEADVEAATDLFLCPFLGSTGPMYLKGNVYGSDPFETYHTGCSPDPRTVLMDHYEPSYIKKKECYPCSHPSEESCERSFSNISWPSHVRKLLNTSYSHNEGPGMKNLCLNKSSLDFSANPEPASVASSNSFMGTFGKALRRPHLDAYSSFGQPSDCQPRAFYLKAHSSPDLDSGSEEDGKERTDFQEENHICTFKQTLENYRTPNFQSYDLDT

SEQ ID NO: 2428 - protein, 623 aa, unidentified
MRVALGMLWLLALAWPPQARGFCPSQCSCSLHIMGDGSKARTVVCNDPDMTLPPASIPPDTSRLRLERTAIRRVPGEAFRPLGRLEQLWLPYNALSELNALMLRGLRRLRELRLPGNRLAAFPWAALRDAPKLRLLDLQANRLSAVPAEAARFLENLTFLDLSSNQLMRLPQELIVSWAHLETGIFPPGHHPRRVLGLQDNPWACDCRLYDLVHLLDGWAPNLAFIETELRCASPRSLAGVAFSQLELRKCQGPELHPGVASIRSLLGGTALLRCGATGVPGPEMSWRRANGRPLNGTVHQEVSSDGTSWTLLGLPAVSHLDSGDYICQAKNFLGASETVISLIVTEPPTSTEHSGSPGALWARTGGGGEAAAYNNKLVARHVPQIPKPAVLATGPSVPSTKEELTLEHFQMDALGELSDGRAGPSEARMVRSVKVVGDTYHSVSLVWKAPQAKNTTAFSVLYAVFGQHSMRRVIVQPGKTRVTITGLLPKTKYVACVCVQGLVPRKEQCVIFSTNEVVDAENTQQLINVVVISVAIVIALPLTLLVCCSALQKRCRKCFNKDSTEATVTYVNLERLGYSEDGLEELSRHSVSEADRLLSARSSVDFQAFGVKGGRRINEYFC

SEQ ID NO: 2429 - protein, 550 aa, unidentified
MASVFHYFLLVLVFLDTHAAQPFCLPGCTCSEESFGRTLQCTSVSLGKIPGNLSEEFKQVRIENSPLFEMPQGSFINMSTLEYLWLNFNNISVIHLGALEHLPELRELRLEGNKLCSVPWTAFRATPLLRVLDLKRNKIDALPELALQFLVSLTYLDLSSNRLTVVSKSVFLNWPAYQKCRQPDCGAEILSSLVVALHDNPWVCDCRLRGLVQFVKSITLPVILVNSYLICQGPLSKAGQLFHETELSACMKPQISTPSANITIRAGQNVTLRCLAQASPSPSIAWTYPLSMWREFDVLTSSTGEDTALSELAIPAAHLVDSGNYTCMASNSIGKSNLVISLHVQPAQALHAPDSLSIPSEGNAYIDLRVVKQTVHGILLEWLAVADTSKEEWFTLYIASDEAFRKEVVHIGPGINTYAVDDLLPGTKYEACLSLEGQPPHQGQCVAFVTGRDAGGLEAREHLLHVTVVLCVVLLAVPVGAYAWAAQGPCSCSKWVLRGCLHRRKAPSCTPAAPQSKDGSFREHPAVCDDGEGHIDTEGDKEKGGTEDNS

SEQ ID NO: 2430 - protein, 679 aa, unidentified
MHLFACLCIVLSFLEGVGCLCPSQCTCDYHGRNDGSGSRLVLCNDMDMNELPTNLPVDTVKLRIEKTVIRRISAEAFYYLVELQYLWVTYNSVASIDPSSFYNLKQLHELRLDGNSLAAFPWASLLDMPLLRTLDLHNNKITSVPNEALRYLKNLAYLDLSSNRLTTLPPDFLESWTHLVSTPSGVLDLSPSRIILGLQDNPWFCDCHISKMIELSKVVDPAIVLLDPLMTCSEPERLTGILFQRAELEHCLKPSVMTSATKIMSALGSNVLLRCDATGFPTPQITWTRSDSSPVNYTVIQESPEEGVRWSIMSLTGISSKDAGDYKCKAKNLAGMSEAVVTVTVLGITTTPIPPDTSERTGDHPEWDVQPGSGRSTSVSSASSYLWSSSFSPTSSFSASTLSPPSTASFSLSPFSSSTVSSTTTLSTSISASTTMANKRSFQLHQGGKRNLKVAKNGSKLPPASTSKKEELALLDQTMLTETNAAIENLRVVSETKESVTLTWNMINTTHNSAVTVLYSKYGGKDLLLLNADSSKNQVTIDGLEPGGQYMACVCPKGVPPQKDQCITFSTERVEGDDSQWSLLLVVTSTACVVILPLICFLLYKVCKLQCKSEPFWEDDLAKETYIQFETLFPRSQSVGELWTRSHRDDSEKLLLCSRSSVESQVTFKSEGSRPEYYC

SEQ ID NO: 2431 - protein, 555 aa, unidentified
MESTPFSGVANQIHTLCERPTYGEVKDGALDVKRQHKCPGPTSGPSPGTNLSGCIRMNDDPSMEENGVERVCPESLLQSREYSSLPLPRHTSSTDGTITSSDPGLEILNMASCDLDRNSLCKKEEDTRSASPTIEAQGTSPAHDNIAFQDSTSKDKTILNLEAKEEPETIEEHKKEHASGDSVVSPLPVTTVKSVNLRQSENTSANEKEVEAEFLRLSLGFKCDWFTLEKRVKLEERSRDLAEENLKKEITNCLKLLESLTPLCEDDNQAQEIIKKLEKSIKFLSQCAARVASRAEMLGAINQESRVSKAVEVMIQHVENLKRMYAKEHAELEELKQVLLQNERSFNPLEDDDDCQIKKRSASLNSKPSSLRRVTIASLPRNIGNAGMVAGMENNDRFSRRSSSWRILGSKQSEHRPSLPRFISTYSWADAEEEKCELKTKDDSEPSGEETVERTRKPSLSEKKNNPSKWDVSSVYDTIASWATNLKSSIRKANKALWLSIAFIVLFAALMSFLTGQLFQKSVDAAPTQQEDSWTSLEHILWPFTRLRHNGPPPV

SEQ ID NO: 2432 - protein, 4544 aa, unidentified
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSQEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 2433 - protein, 713 aa, unidentified
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 2434 - protein, 500 aa, unidentified
MASVAQESAGSQRRLPPRHGALRGLLLLCLWLPSGRAALPPAAPLSELHAQLSGVEQLLEEFRRQLQQERPQEELELELRAGGGPQEDCPGPGSGGYSAMPDAIIRTKDSLAAGASFLRAPAAVRGWRQCVAACCSEPRCSVAVVELPRRPAPPAAVLGCYLFNCTARGRNVCKFALHSGYSSYSLSRAPDGAALATARASPRQEKDAPPLSKAGQDVVLHLPTDGVVLDGRESTDDHAIVQYEWALLQGDPSVDMKVPQSGTLKLSHLQEGTYTFQLTVTDTAGQRSSDNVSVTVLRAAYSTGGCLHTCSRYHFFCDDGCCIDITLACDGVQQCPDGSDEDFCQNLGLDRKMVTHTAASPALPRTTGPSEDAGGDSLVEKSQKATAPNKPPALSNTEKRNHSAFWGPESQIIPVMPDSSSSGKNRKEESYIFESKGDGGGGEHPAPETGAVLPLALGLAITALLLLMVACRLRLVKQKLKKARPITSEESDYLINGMYL

SEQ ID NO: 2435 - protein, 859 aa, unidentified
MACRWSTKESPRWRSALLLLFLAGVYGNGALAEHSENVHISGVSTACGETPEQIRAPSGIITSPGWPSEYPAKINCSWFIRANPGEIITISFQDFDIQGSRRCNLDWLTIETYKNIESYRACGSTIPPPYISSQDHIWIRFHSDDNISRKGFRLAYFSGKSEEPNCACDQFRCGNGKCIPEAWKCNNMDECGDSSDEEICAKEANPPTAAAFQPCAYNQFQCLSRFTKVYTCLPESLKCDGNIDCLDLGDEIDCDVPTCGQWLKYFYGTFNSPNYPDFYPPGSNCTWLIDTGDHRKVILRFTDFKLDGTGYGDYVKIYDGLEENPHKLLRVLTAFDSHAPLTVVSSSGQIRVHFCADKVNAARGFNATYQVDGFCLPWEIPCGGNWGCYTEQQRCDGYWHCPNGRDETNCTMCQKEEFPCSRNGVCYPRSDRCNYQNHCPNGSDEKNCFFCQPGNFHCKNNRCVFESWVCDSQDDCGDGSDEENCPVIVPTRVITAAVIGSLICGLLLVIALGCTCKLYSLRMFERRSFETQLSRVEAELLRREAPPSYGQLIAQGLIPPVEDFPVCSPNQASVLENLRLAVRSQLGFTSVRLPMAGRSSNIWNRIFNFARSRHSGSLALVSADGDEVVPSQSTSREPERNHTHRSLFSVESDDTDTENERRDMAGASGGVAAPLPQKVPPTTAVEATVGACASSSTQSTRGGHADNGRDVTSVEPPSVSPARHQLTSALSRMTQGLRWVRFTLGRSSSLSQNQSPLRQLDNGVSGREDDDDVEMLIPISDGSSDFDVNDCSRPLLDLASDQGQGLRQPYNATNPGVRPSNRDGPCERCGIVHTAQIPDTCLEVTLKNETSDDEALLLC

SEQ ID NO: 2436 - protein, 4599 aa, unidentified
MSEFLLALLTLSGLLPIARVLTVGADRDQQLCDPGEFLCHDHVTCVSQSWLCDGDPDCPDDSDESLDTCPEEVEIKCPLNHIACLGTNKCVHLSQLCNGVLDCPDGYDEGVHCQELLSNCQQLNCQYKCTMVRNSTRCYCEDGFEITEDGRSCKDQDECAVYGTCSQTCRNTHGSYTCSCVEGYLMQPDNRSCKAKIEPTDRPPILLIANFETIEVFYLNGSKMATLSSVNGNEIHTLDFIYNEDMICWIESRESSNQLKCIQITKAGGLTDEWTINILQSFHNVQQMAIDWLTRNLYFVDHVGDRIFVCNSNGSVCVTLIDLELHNPKAIAVDPIAGKLFFTDYGNVAKVERCDMDGMNRTRIIDSKTEQPAALALDLVNKLVYWVDLYLDYVGVVDYQGKNRHTVIQGRQVRHLYGITVFEDYLYATNSDNYNIVRINRFNGTDIHSLIKIENAWGIRIYQKRTQPTVRSHACEVDPYGMPGGCSHICLLSSSYKTRTCRCRTGFNLGSDGRSCKRPKNELFLFYGKGRPGIVRGMDLNTKIADEYMIPIENLVNPRALDFHAETNYIYFADTTSFLIGRQKIDGTERETILKDDLDNVEGIAVDWIGNNLYWTNDGHRKTINVARLEKASQSRKTLLEGEMSHPRGIVVDPVNGWMYWTDWEEDEIDDSVGRIEKAWMDGFNRQIFVTSKMLWPNGLTLDFHTNTLYWCDAYYDHIEKVFLNGTHRKIVYSGRELNHPFGLSHHGNYVFWTDYMNGSIFQLDLITSEVTLLRHERPPLFGLQIYDPRKQQGDNMCRVNNGGCSTLCLAIPGGRVCACADNQLLDENGTTCTFNPGEALPHICKAGEFRCKNRHCIQARWKCDGDDDCLDGSDEDSVNCFNHSCPDDQFKCQNNRCIPKRWLCDGANDCGSNEDESNQTCTARTCQVDQFSCGNGRCIPRAWLCDREDDCGDQTDEMASCEFPTCEPLTQFVCKSGRCISSKWHCDSDDDCGDGSDEVGCVHSCFDNQFRCSSGRCIPGHWACDGDNDCGDFSDEAQINCTKEEIHSPAGCNGNEFQCHPDGNCVPDLWRCDGEKDCEDGSDEKGCNGTIRLCDHKTKFSCWSTGRCINKAWVCDGDIDCEDQSDEDDCDSFLCGPPKHPCANDTSVCLQPEKLCNGKKDCPDGSDEGYLCDECSLNNGGCSNHCSVVPGRGIVCSCPEGLQLNKDNKTCEIVDYCSNHLKCSQVCEQHKHTVKCSCYEGWKLDVDGESCTSVDPFEAFIIFSIRHEIRRIDLHKRDYSLLVPGLRNTIALDFHFNQSLLYWTDVVEDRIYRGKLSESGGVSAIEVVVEHGLATPEGLTVDWIAGNIYWIDSNLDQIEVAKLDGSLRTTLIAGAMEHPRAIALDPRYGILFWTDWDANFPRIESASMSGAGRKTIYKDMKTGAWPNGLTVDHFEKRIVWTDARSDAIYSALYDGTNMIEIIRGHEYLSHPFAVSLYGSEVYWTDWRTNTLSKANKWTGQNVSVIQKTSAQPFDLQIYHPSRQPQAPNPCAANDGKGPCSHMCLINHNRSAACACPHLMKLSSDKKTCYEMKKFLLYARRSEIRGVDIDNPYFNFITAFTVPDIDDVTVIDFDASEERLYWTDIKTQTIKRAFINGTGLETVISRDIQSIRGLAVDWVSRNLYWISSEFDETQINVARLDGSLKTSIIHGIDKPQCLAAHPVRGKLYWTDGNTINMANMDGSNSKILFQNQKEPVGLSIDYVENKLYWISSGNGTINRCNLDGGNLEVIESMKEELTKATALTIMDKKLWWADQNLAQLGTCSKRDGRNPTILRNKTSGVVHMKVYDKEAQQGSNSCQLNNGGCSQLCLPTSETTRTCMCTVGYYLQKNRMSCQGIESFLMYSVHEGIRGIPLEPSDKMDALMPISGTSFAVGIDFHAENDTIYWTDMGFNKISRAKRDQTWKEDIITNGLGRVEGIAVDWIAGNIYWTDHGFNLIEVARLNGSFRYVIISQGLDQPRSIAVHPEKGLLFWTEWGQMPCIGKARLDGSEKVVLVSMGIAWPNGISIDYEENKLYWCDARTDKIERIDLETGGNREMVLSGSNVDMFSVAVFGAYIYWSDRAHANGSVRRGHKNDATETITMRTGLGVNLKEVKIFNRVREKGTNVCARDNGGCKQLCLYRGNSRRTCACAHGYLAEDGVTCLRHEGYLLYSGRTILKSIHLSDETNLNSPIRPYENPRYFKNVIALAFDYNQRRKGTNRIFYSDAHFGNIQLIKDNWEDRQVIVENVGSVEGLAYHRAWDTLYWTSSTTSSITRHTVDQTRPGAFDREAVITMSEDDHPHVLALDECQNLMFWTNWNEQHPSIMRSTLTGKNAQVVVSTDILTPNGLTIDYRAEKLYFSDGSLGKIERCEYDGSQRHVIVKSGPGTFLSLAVYDNYIFWSDWGRRAILRSNKYTGGDTKILRSDIPHQPMGIIAVANDTNSCELSPCALLNGGCHDLCLLTPNGRVNCSCRGDRILLEDNRCVTKNSSCNAYSEFECGNGECIDYQLTCDGIPHCKDKSDEKLLYCENRSCRRGFKPCYNRRCIPHGKLCDGENDCGDNSDELDCKVSTCATVEFRCADGTCIPRSARCNQNIDCADASDEKNCNNTDCTHFYKLGVKTTGFIRCNSTSLCVLPTWICDGSNDCGDYSDELKCPVQNKHKCEENYFSCPSGRCILNTWICDGQKDCEDGRDEFHCDSSCSWNQFACSAQKCISKHWICDGEDDCGDGLDESDSICGAITCAADMFSCQGSRACVPRHWLCDGERDCPDGSDELSTAGCAPNNTCDENAFMCHNKVCIPKQFVCDHDDDCGDGSDESPQCGYRQCGTEEFSCADGRCLLNTQWQCDGDFDCPDHSDEAPLNPKCKSAEQSCNSSFFMCKNGRCIPSGGLCDNKDDCGDGSDERNCHINECLSKKVSGCSQDCQDLPVSYKCKCWPGFQLKDDGKTCVDIDECSSGFPCSQQCINTYGTYKCLCTDGYEIQPDNPNGCKSLSDEEPFLILADHHEIRKISTDGSNYTLLKQGLNNVIAIDFDYREEFIYWIDSSRPNGSRINRMCLNGSDIKVVHNTAVPNALAVDWIGKNLYWSDTEKRIIEVSKLNGLYPTILVSKRLKFPRDLSLDPQAGYLYWIDCCEYPHIGRVGMDGTNQSVVIETKISRPMALTIDYVNRRLYWADENHIEFSNMDGSHRHKVPNQDIPGVIALTLFEDYIYWTDGKTKSLSRAHKTSGADRLSLIYSWHAITDIQVYHSYRQPDVSKHLCMINNGGCSHLCLLAPGKTHTCACPTNFYLAADNRTCLSNCTASQFRCKTDKCIPFWWKCDTVDDCGDGSDEPDDCPEFRCQPGRFQCGTGLCALPAFICDGENDCGDNSDELNCDTHVCLSGQFKCTKNQKCIPVNLRCNGQDDCGDEEDERDCPENSCSPDYFQCKTTKHCISKLWVCDEDPDCADASDEANCDKKTCGPHEFQCKNNNCIPDHWRCDSQNDCSDNSDEENCKPQTCTLKDFLCANGDCVSSRFWCDGDFDCADGSDERNCETSCSKDQFRCSNGQCIPAKWKCDGHEDCKYGEDEKSCEPASPTCSSREYICASDGCISASLKCNGEYDCADGSDEMDCVTECKEDQFRCKNKAHCIPIRWLCDGIHDCVDGSDEENCERGGNICRADEFLCNNSLCKLHFWVCDGEDDCGDNSDEAPDMCVKFLCPSTRPHRCRNNRICLQSEQMCNGIDECGDNSDEDHCGGKLTYKARPCKKDEFACSNKKCIPMDLQCDRLDDCGDGSDEQGCRIAPTEYTCEDNVNPCGDDAYCNQIKTSVFCRCKPGFQRNMKNRQCEDLNECLVFGTCSHQCINVEGSYKCVCDQNFQERNNTCIAEGSEDQVLYIANDTDILGFIYPFNYSGDHQQISHIEHNSRITGMDVYYQRDMIIWSTQFNPGGIFYKRIHGREKRQANSGLICPEFKRPRDIAVDWVAGNIYWTDHSRMHWFSYYTTHWTSLRYSINVGQLNGPNCTRLLTNMAGEPYAIAVNPKRGMMYWTVVGDHSHIEEAAMDGTLRRILVQKNLQRPTGLAVDYFSERIYWADFELSIIGSVLYDGSNSVVSVSSKQGLLHPHRIDIFEDYIYGAGPKNGVFRVQKFGHGSVEYLALNIDKTKGVLISHRYKQLDLPNPCLDLACEFLCLLNPSGATCVCPEGKYLINGTCNDDSLLDDSCKLTCENGGRCILNEKGDLRCHCWPSYSGERCEVNHCSNYCQNGGTCVPSVLGRPTCSCALGFTGPNCGKTVCEDFCQNGGTCIVTAGNQPYCHCQPEYTGDRCQYYVCHHYCVNSESCTIGDDGSVECVCPTRYEGPKCEVDKCVRCHGGHCIINKDSEDIFCNCTNGKIASSCQLCDGYCYNGGTCQLDPETNVPVCLCSTNWSGTQCERPAPKSSKSDHISTRSIAIIVPLVLLVTLITTLVIGLVLCKRKRRTKTIRRQPIINGGINVEIGNPSYNMYEVDHDHNDGGLLDPGFMIDPTKARYIGGGPSAFKLPHTAPPIYLNSDLKGPLTAGPTNYSNPVYAKLYMDGQNCRNSLGSVDERKELLPKKIEIGIRETVA

SEQ ID NO: 2437 - protein, 4655 aa, unidentified
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTTAVAVLLTILLIVVIGALAIAGFFHYRRTGSLLPALPKLPSLSSLVKPSENGNGVTFRSGADLNMDIGVSGFGPETAIDRSMAMSEDFVMEMGKQPIIFENPMYSARDSAVKVVQPIQVTVSENVDNKNYGSPINPSEIVPETNPTSPAADGTQVTKWNLFKRKSKQTTNFENPIYAQMENEQKESVAATPPPSPSLPAKPKPPSRRDPTPTYSATEDTFKDTANLVKEDSEV

SEQ ID NO: 2438 - protein, 770 aa, unidentified
MEKRAAAGLEGAPGARAQLAVVCLVNIFLTGRLSSAVPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARPSQTVLGDGFLQPAPGAAPDPPAPLMDTGSTRAAGDRPPSAPGRAPEVGPSGPPLPSGLRDPECRPVDKDRKVCREPLVDGPAPADAPREPCSAQDPHPQVSTASSTLGPHSPEPLGVCRNPPPPCSPMLEASDDEALLVC

SEQ ID NO: 2439 - protein, 1905 aa, unidentified
MRRQWGALLLGALLCAHGLASSPECACGRSHFTCAVSALGECTCIPAQWQCDGDNDCGDHSDEDGCILPTCSPLDFHCDNGKCIRRSWVCDGDNDCEDDSDEQDCPPRECEEDEFPCQNGYCIRSLWHCDGDNDCGDNSDEQCDMRKCSDKEFRCSDGSCIAEHWYCDGDTDCKDGSDEENCPSAVPAPPCNLEEFQCAYGRCILDIYHCDGDDDCGDWSDESDCSSHQPCRSGEFMCDSGLCINAGWRCDGDADCDDQSDERNCTTSMCTAEQFRCHSGRCVRLSWRCDGEDDCADNSDEENCENTGSPQCALDQFLCWNGRCIGQRKLCNGVNDCGDNSDESPQQNCRPRTGEENCNVNNGGCAQKCQMVRGAVQCTCHTGYRLTEDGHTCQDVNECAEEGYCSQGCTNSEGAFQCWCETGYELRPDRRSCKALGPEPVLLFANRIDIRQVLPHRSEYTLLLNNLENAIALDFHHRRELVFWSDVTLDRILRANLNGSNVEEVVSTGLESPGGLAVDWVHDKLYWTDSGTSRIEVANLDGAHRKVLLWQNLEKPRAIALHPMEGTIYWTDWGNTPRIEASSMDGSGRRIIADTHLFWPNGLTIDYAGRRMYWVDAKHHVIERANLDGSHRKAVISQGLPHPFAITVFEDSLYWTDWHTKSINSANKFTGKNQEIIRNKLHFPMDIHTLHPQRQPAGKNRCGDNNGGCTHLCLPSGQNYTCACPTGFRKISSHACAQSLDKFLLFARRMDIRRISFDTEDLSDDVIPLADVRSAVALDWDSRDDHVYWTDVSTDTISRAKWDGTGQEVVVDTSLESPAGLAIDWVTNKLYWTDAGTDRIEVANTDGSMRTVLIWENLDRPRDIVVEPMGGYMYWTDWGASPKIERAGMDASGRQVIISSNLTWPNGLAIDYGSQRLYWADAGMKTIEFAGLDGSKRKVLIGSQLPHPFGLTLYGERIYWTDWQTKSIQSADRLTGLDRETLQENLENLMDIHVFHRRRPPVSTPCAMENGGCSHLCLRSPNPSGFSCTCPTGINLLSDGKTCSPGMNSFLIFARRIDIRMVSLDIPYFADVVVPINITMKNTIAIGVDPQEGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRAVLINNNLGWPNGLTVDKASSQLLWADAHTERIEAADLNGANRHTLVSPVQHPYGLTLLDSYIYWTDWQTRSIHRADKGTGSNVILVRSNLPGLMDMQAVDRAQPLGFNKCGSRNGGCSHLCLPRPSGFSCACPTGIQLKGDGKTCDPSPETYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVSHVSHPFALTQQDRWIYWTDWQTKSIQRVDKYSGRNKETVLANVEGLMDIIVVSPQRQTGTNACGVNNGGCTHLCFARASDFVCACPDEPDSRPCSLVPGLVPPAPRATGMSEKSPVLPNTPPTTLYSSTTRTRTSLEEVEGRCSERDARLGLCARSNDAVPAAPGEGLHISYAIGGLLSILLILVVIAALMLYRHKKSKFTDPGMGNLTYSNPSYRTSTQEVKIEAIPKPAMYNQLCYKKEGGPDHNYTKEKIKIVEGICLLSGDDAEWDDLKQLRSSRGGLLRDHVCMKTDTVSIQASSGSLDDTETEQLLQEEQSECSSVHTAATPERRGSLPDTGWKHERKLSSESQV

SEQ ID NO: 2440 - protein, 1615 aa, unidentified
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 2441 - protein, 1613 aa, unidentified
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAVVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 2442 - protein, 963 aa, unidentified
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATASQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 2443 - protein, 581 aa, unidentified
MPLKHYLLLLVGCQAWGAGLAYHGCPSECTCSRASQVECTGARIVAVPTPLPWNAMSLQILNTHITELNESPFLNISALIALRIEKNELSRITPGAFRNLGSLRYLSLANNKLQVLPIGLFQGLDSLESLLLSSNQLLQIQPAHFSQCSNLKELQLHGNHLEYIPDGAFDHLVGLTKLNLGKNSLTHISPRVFQHLGNLQVLRLYENRLTDIPMGTFDGLVNLQELALQQNQIGLLSPGLFHNNHNLQRLYLSNNHISQLPPSVFMQLPQLNRLTLFGNSLKELSPGIFGPMPNLRELWLYDNHISSLPDNVFSNLRQLQVLILSRNQISFISPGAFNGLTELRELSLHTNALQDLDGNVFRMLANLQNISLQNNRLRQLPGNIFANVNGLMAIQLQNNQLENLPLGIFDHLGKLCELRLYDNPWRCDSDILPLRNWLLLNQPRLGTDTVPVCFSPANVRGQSLIIINVNVAVPSVHVPEVPSYPETPWYPDTPSYPDTTSVSSTTELTSPVEDYTDLTTIQVTDDRSVWGMTQAQSGLAIAAIVIGIVALACSLAACVGCCCCKKRSQAVLMQMKAPNEC

SEQ ID NO: 2444 - protein, 370 aa, unidentified
MKVTGITILFWPLSMILLSDKIQSSKREVQCNFTEKNYTLIPADIKKDVTILDLSYNQITLNGTDTRVLQTYFLLTELYLIENKVTILHNNGFGNLSSLEILNICRNSIYVIQQGAFLGLNKLKQLYLCQNKIEQLNADVFVPLRSLKLLNLQGNLISYLDVPPLFHLELITLYGNLWNCSCSLFNLQNWLNTSNVTLENENITMCSYPNSLQSYNIKTVPHKAECHSKFPSSVTEDLYIHFQPISNSIFNSSSNNLTRNSEHEPLGKSWAFLVGVVVTVLTTSLLIFIAIKCPIWYNILLSYNHHRLEEHEAETYEDGFTGNPSSLSQIPETNSEETTVIFEQLHSFVVDDDGFIEDKYIDIHELCEEN

SEQ ID NO: 2445 - protein, 513 aa, unidentified
MALRAPALLPLLLLLLPLRAAGCPAACRCYSATVECGALRLRVVPLGIPPGTQTLFLQDNNIARLEPGALAPLAALRRLYLHNNSLRALEAGAFRAQPRLLELALTSNRLRGLRSGAFVGLAQLRVLYLAGNQLARLLDFTFLHLPRLQELHLQENSIELLEDQALAGLSSLALLDLSRNQLGTISREALQPLASLQVLRLTENPWRCDCALHWLGAWIKEGGQRLLTSRDRKIMCAEPPRLALQSLLDVSHSSLICIPPSVHVQPLELTANLGEDLRVACQASGYPQPLVTWRKVPQPREGRPRAQAQLEGGLLGLGGHSASDTGSGMLFLSNITLAHAGKYECEASNAGGAARVPFRLLVNASRQQPQQPAQPPPPAARPAGSEPRPEAGSMAFRALGVATQTAIAAAIALLALTALLLVAMICRRRRRRKKARGPPGEGALFVNDYLDGPCTFAQLEELRDERGHEMFVINRSKPLFAEGPAEAPADCGPEQGAGPGLRVPPPVAYEIHC

SEQ ID NO: 2446 - protein, 305 aa, unidentified
MGGTLAWTLLLPLLLRESDSLEPSCTVSSADVDWNAEFSATCLNFSGLSLSLPHNQSLRASNVILLDLSGNGLRELPVTFFAHLQKLEVLNVLRNPLSRVDGALAARCDLDLQADCNCALESWHDIRRDNCSGQKPLLCWDTTSSQHNLSAFLEVSCAPGLASATIGAVVVSGCLLLGLAIAGPVLAWRLWRCRVARSRELNKPWAAQDGPKPGLGLQPRYGSRSAPKPQVAVPSCPSTPDYENMFVGQPAAEHQWDEQGAHPSEDNDFYINYKDIDLASQPVYCNLQSLGQAPMDEEEYVIPGH

SEQ ID NO: 2447 - protein, 334 aa, unidentified
MRGPSWSRPRPLLLLLLLLSPWPVWAQVSATASPSGSLGAPDCPEVCTCVPGGLASCSALSLPAVPPGLSLRLRALLLDHNRVRALPPGAFAGAGALQRLDLRENGLHSVHVRAFWGLGALQLLDLSANQLEALAPGTFAPLRALRNLSLAGNRLARLEPAALGALPLLRSLSLQDNELAALAPGLLGRLPALDALHLRGNPWGCGCALRPLCAWLRRHPLPASEAETVLCVWPGRLTLSPLTAFSDAAFSHCAQPLALRDLAVVYTLGPASFLVSLASCLALGSGLTACRARRRRLRTAALRPPRPPDPNPDPDPHGCASPADPGSPAAAAQA

SEQ ID NO: 2448 - protein, 257 aa, unidentified
MGTVRPPRPSLLLVSTRESCLFLLFCLHLGAACPQPCRCPDHAGAVAVFCSLRGLQEVPEDIPANTVLLKLDANKISHLPDGAFQHLHRLRELDLSHNAIEAIGSATFAGLAGGLRLLDLSYNRIQRIPKDALGKLSAKIRLSHNPLHCECALQEALWELKLDPDSVDEIACHTSVQEEFVGKPLVQALDAGASLCSVPHRTTDVAMLVTMFGWFAMVIAYVVYYVRHNQEDARRHLEYLKSLPSAPASKDPIGPGP

SEQ ID NO: 2449 - protein, 662 aa, unidentified
MRPQILLLLALLTLGLAAQHQDKVPCKMVDKKVSCQVLGLLQVPSVLPPDTETLDLSGNQLRSILASPLGFYTALRHLDLSTNEISFLQPGAFQALTHLEHLSLAHNRLAMATALSAGGLGPLPRVTSLDLSGNSLYSGLLERLLGEAPSLHTLSLAENSLTRLTRHTFRDMPALEQLDLHSNVLMDIEDGAFEGLPRLTHLNLSRNSLTCISDFSLQQLRVLDLSCNSIEAFQTASQPQAEFQLTWLDLRENKLLHFPDLAALPRLIYLNLSNNLIRLPTGPPQDSKGIHAPSEGWSALPLSAPSGNASGRPLSQLLNLDLSYNEIELIPDSFLEHLTSLCFLNLSRNCLRTFEARRLGSLPCLMLLDLSHNALETLELGARALGSLRTLLLQGNALRDLPPYTFANLASLQRLNLQGNRVSPCGGPDEPGPSGCVAFSGITSLRSLSLVDNEIELLRAGAFLHTPLTELDLSSNPGLEVATGALGGLEASLEVLALQGNGLMVLQVDLPCFICLKRLNLAENRLSHLPAWTQAVSLEVLDLRNNSFSLLPGSAMGGLETSLRRLYLQGNPLSCCGNGWLAAQLHQGRVDVDATQDLICRFSSQEEVSLSHVRPEDCEKGGLKNINLIIILTFILVSAILLTTLAACCCVRRQKFNQQYKA

SEQ ID NO: 2450 - protein, 1700 aa, unidentified
MSSAQCPALVCVMSRLRFWGPWPLLMWQLLWLLVKEAQPLEWVKDPLQLTSNPLGPPESWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLTSPAPREVEQPHTQQGPEKLAGNAVYTKPSFTQEHKAAVSVLKPFSKGTPSTSSPAKALPQVRDRSKDLTHAISILESAKARVTNTKTSKPIVHARKKYRFHKTRSHVTHRTTKVKKSPKVRKKSYLSRLMLANRLPFSAAKSLINSPSQGAFSSLGDLSPQENPFLEVSALSEHFIEKNNTKHTTARNAFEENDFMENTNMPEGTISENTNYNHPPEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPWRGCSSRRESQDGLSSFGQPLWFKDLYKPLSATRINNHAWKLHKKSSNEDKILNRDPGDSEAPTEEEESEALP

SEQ ID NO: 2451 - protein, 1700 aa, unidentified
MSSAQCPALVCVMSRLRFWGPWPLLMWQLLWLLVKEAQPLEWVKDPLQLTSNPLGPPDSWSSHSSHFPRESPHAPTLPADPWDFDHLGPSASSEMPAPPQESTENLVPFLDTWDSAGEQPLEPEQFLASQQDLKDKLSPQERLPVSPKKLKKDPAQRWSLAEIIGITRQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESPREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESKTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQPPDLGLAIIPEPTTETRHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLILPSHMACCLCQFKNSIEAVCKTVKLHCNSACLTNTTHCPEEASVGNPEGAFMKVLQARKNYTSTELIVEPEEPSDSSGINLSGFGSEQLDTNDESDFISTLSYILPYFSAVNLDVKSLLLPFIKLPTTGNSLAKIQTVGQNRQRVKRVLMGPRSIQKRHFKEVGRQSIRREQGAQASVENAAEEKRLGSPAPREVEQPHTQQGPEKLAGNAVYTKPSFTQEHKAAVSVLKPFSKGAPSTSSPAKALPQVRDRWKDLTHAISILESAKARVTNTKTSKPIVHARKKYRFHKTRSHVTHRTPKVKKSPKVRKKSYLSRLMLANRLPFSAAKSLINSPSQGAFSSLGDLSPQENPFLEVSAPSEHFIENNNTKHTTARNAFEENDFMENTNMPEGTISENTNYNHPHEADSAGTAFNLGPTVKQTETKWEYNNVGTDLSPEPKSFNYPLLSSPGDQFEIQLTQQLQSLIPNNNVRRLIAHVIRTLKMDCSGAHVQVTCAKLISRTGHLMKLLSGQQEVKASKIEWDTDQWKIENYINESTEAQSEQKEKSLELKKEVPGYGYTDKLILALIVTGILTILIILFCLIVICCHRRSLQEDEEGFSRGIFRFLPWRGCSSRRESQDGLSSFGQPLWFKDMYKPLSATRINNHAWKLHKKSSNEDKILNRDPGDSEAPTEEEESEALP

SEQ ID NO: 2452 - protein, 1634 aa, unidentified
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIHQLSTPQSQKQTLQNEYSSTDTPYPGSLPPELRVKSDEPPGPSEQVGPSQFHLEPETQNPETLEDIQSSSLQQEAPAQLPQLLEEEPSSMQQEAPALPPESSMESLTLPNHEVSVQPPGEDQAYYHLPNITVKPADVEVTITSEPTNETESSQAQQETPIQFPEEVEPSATQQEAPIEPPVPPMEHELSISEQQQPVQPSESSREVESSPTQQETPGQPPEHHEVTVSPPGHHQTHHLASPSVSVKPPDVQLTIAAEPSAEVGTSLVHQEATTRLSGSGNDVEPPAIQHGGPPLLPESSEEAGPLAVQQETSFQSPEPINNENPSPTQQEAAAEHPQTAEEGESSLTHQEAPAQTPEFPNVVVAQPPEHSHLTQATVQPLDLGFTITPESMTEVELSPTMKETPTQPPKKVVPQLRVYQGVTNPTPGQDQAQHPVSPSVTVQLLDLGLTITPEPTTEVGHSTPPKRTIVSPKHPEVTLPHPDQVQTQHSHLTRATVQPLDLGFTITPKSMTEVEPSTALMTTAPPPGHPEVTLPPSDKGQAQHSHLTQATVQPLDLELTITTKPTTEVKPSPTTEETSTQLPDLGLAIIPEPTTETGHSTALEKTTAPRPDRVQTLHRSLTEVTGPPTELEPAQDSLVQSESYTQNKALTAPEEHKASTSTNICELCTCGDEMLSCIDLNPEQRLRQVPVPEPNTHNGTFTILNFQGNYISYIDGNVWKAYSWTEKLILRENNLTELHKDSFEGLLSLQYLDLSCNKIQSIERHTFEPLPFLKFINLSCNVITELSFGTFQAWHGMQFLHKLILNHNPLTTVEDPYLFKLPALKYLDMGTTLVPLTTLKNILMMTVELEKLIVPSHMACCLCQFKNSIEAVCKTVKLHCNSACLTNTTHCPEEASVGNPEGAFMKVLQARKNYTSTELIIEPEEPSDSSGINLSGFGSEQLDTNDESDVTSTLSYILPYFSAVNLDVKSLLLPFIKLPTTGNSLAKIQTVGKNRQRLNRVLMGPRSIQKRHFKEVGRQSIRREQGAQASVENTAEEKRLGSPAPRELKQPHTQQGPEKLAGNAVYTKPSFTQEHKAAVSVLKPFSKGAPSTSSPAKALPQVRDRWKDLTHAISILESAKARVTNMKTSKPIVHSRKKYRFHKTRSRMTHRTPKVKKSPKVRKKSYLSRLMLSNRLPFSAAKSLINSPSQGAFSSLRDLSPQENPFLEVSAPSEHFIENNNTKDTTARNAFEENVFMENTNMPEGTISENTNYNHPPEADSAGTAFNLGPTVKQTETKWEYNNVGTDLSPEPKSFNYPLLSSPGDQFEIQLTQQLQSVIPNNNVRRLIAHVIRTLKMDCSGAHVQVTCAKLVSRTGHLMKLLSGQQEVKASKIEWDTDQWKTENYINESTEAQSEQKEKSLEFTKELPGYGYTKKLILALIVTGILTILIILLCLIEICCHRRSLQEDEEGFSRDSEAPTEEESEALP

SEQ ID NO: 2453 - protein, 947 aa, unidentified
MSWLRFWGPWPLLTWQLLSLLVKEAQPLVWVKDPLQLTSNPLGPPEPWSSRSSHLPWESPHAPAPPAAPGDFDYLGPSASSQMSALPQEPTENLAPFLKELDSAGELPLGPEPFLAAHQDLNDKRTPEERLPEVVPLLNRDQNQALVQLPRLKWVQTTDLDRAAGHQADEILVPLDSKVSRPTKFVVSPKNLKKDLAERWSLPEIVGIPHQLSKPQRQKQTLPDDYLSMDTLYPGSLPPELRVNADEPPGPPEQVGLSQFHLEPKSQNPETLEDIQSSSLQEEAPAQLLQLPQEVEPSTQQEAPALPPESSMESLAQTPLNHEVTVQPPGEDQAHYNLPKFTVKPADVEVTMTSEPKNETESTQAQQEAPIQPPEEAEPSSTALRTTDPPPEHPEVTLPPSDKGQAQHSHLTEATVQPLDLELSITTEPTTEVKPSPTTEETSAQPPDPGLAITPEPTTEIGHSTALEKTRAPHPDQVQTLHRSLTEVTGPPTKLESSQDSLVQSETAPEEQKASTSTNICELCTCGDETLSCVGLSPKQRLRQVPVPEPDTYNGIFTTLNFQGNYISYLDGNVWKAYSWTEKLILSENYLTELPKDSFEGLLYLQYLDLSCNKIRYIERQTFESLPFLQYINLGCNLITKLSLGTFQAWHGMQFLHNLILNRNPLTTVEDPYLFELPALKYLDMGTTHITLTTLKNILTMTVELEKLILPSHMACCLCQFKNSIEAVCKTVKLHCNTACLTNSIHCPEEASVGNPEGAFMKMLQARKQHMSTQLTIESEAPSDSSGINLSGFGGDQLEIQLTEQLRSLIPNEDVRKFMSHVIRTLKMECSETHVQGSCAKLMLRTGLLMKLLSEQQEAKALNVEWDTDQQKTNYINENMEQNEQKEQKSSELMKEVPGDDYKNKLIFAISVTVILIILIIIFCLIEVNSHKRASEKYKDNPSISGA

SEQ ID NO: 2454 - protein, 294 aa, unidentified
MRPRAPACAAAALGLCSLLLLLAPGHACPAGCACTDPHTVDCRDRGLPSVPDPFPLDVRKLLVAGNRIQRIPEDFFIFYGDLVYLDFRNNSLRSLEEGTFSGSAKLVFLDLSYNNLTQLGAGAFRSAGRLVKLSLANNNLVGVHEDAFETLESLQVLELNDNNLRSLSVAALAALPALRSLRLDGNPWLCDCDFAHLFSWIQENASKLPKGLDEIQCSLPMESRRISLRELSEASFSECRFSLSLTDLCIIIFSGVAVSIAAIISSFFLATVVQCLQRCAPNKDAEDEDEDKDD

SEQ ID NO: 2455 - protein, 259 aa, unidentified
MNLVDLWLTRSLSMCLLLQSFVLMILCFHSASMCPKGCLCSSSGGLNVTCSNANLKEIPRDLPPETVLLYLDSNQITSIPNEIFKDLHQLRVLNLSKNGIEFIDEHAFKGVAETLQTLDLSDNRIQSVHKNAFNNLKARARIANNPWHCDCTLQQVLRSMASNHETAHNVICKTSVLDEHAGRPFLNAANDADLCNLPKKTTDYAMLVTMFGWFTMVISYVVYYVRQNQEDARRHLEYLKSLPSRQKKADEPDDISTVV

SEQ ID NO: 2456 - protein, 275 aa, unidentified
MRMTSSSFVSYCTPGLCQFMAMLPTAGHLLPLLLVIGTGGTVPSPQVPPRGCYVAKEAGERTFRCSQAGLSAVPSGIPNDTRKLYLDANQLASVPAGAFQHLPVLEELDLSHNALAHLSGAAFQGLEGTLRHLDLSANQLASVPVEAFVGLQIQVNLSANPWHCDCALQEVLRQVRLVPGTGTGIVCGSGARPDLVGQEFLLLAGEEELCGSGWGGARRSTDVALLVTMGGWLTLMVAYLVHYVWQNRDETRRSLKRAPVLPVRSEDSSILSTVV

SEQ ID NO: 2457 - protein, 653 aa, unidentified
MKLLWQVTVHHHTWNAILLPFVYLTAQVWILCAAIAAAASAGPQNCPSVCSCSNQFSKVVCTRRGLSEVPQGIPSNTRYLNLMENNIQMIQADTFRHLHHLEVLQLGRNSIRQIEVGAFNGLASLNTLELFDNWLTVIPSGAFEYLSKLRELWLRNNPIESIPSYAFNRVPSLMRLDLGELKKLEYISEGAFEGLFNLKYLNLGMCNIKDMPNLTPLVGLEELEMSGNHFPEIRPGSFHGLSSLKKLWVMNSQVSLIERNAFDGLASLVELNLAHNNLSSLPHDLFTPLRYLVELHLHHNPWNCDCDILWLAWWLREYIPTNSTCCGRCHAPMHMRGRYLVEVDQASFQCSAPFIMDAPRDLNISEGRMAELKCRTPPMSSVKWLLPNGTVLSHASRHPRISVLNDGTLNFSHVLLSDTGVYTCMVTNVAGNSNASAYLNVSTAELNTSNYSFFTTVTVETTEISPEDTTRKYKPVPTTSTGYQPAYTTSTTVLIQTTRVPKQVAVPATDTTDKMQTSLDEVMKTTKIIIGCFVAVTLLAAAMLIVFYKLRKRHQQRSTVTAARTVEIIQVDEDIPAATSAAATAAPSGVSGEGAVVLPTIHDHINYNTYKPAHGAHWTENSLGNSLHPTVTTISEPYIIQTHTKDKVQETQI

SEQ ID NO: 2458 - protein, 713 aa, unidentified
MARARGSPCPPLPPGRMSWPHGALLFLWLFSPPLGAGGGGVAVTSAAGGGSPPATSCPVACSCSNQASRVICTRRDLAEVPASIPVNTRYLNLQENGIQVIRTDTFKHLRHLEILQLSKNLVRKIEVGAFNGLPSLNTLELFDNRLTTVPTQAFEYLSKLRELWLRNNPIESIPSYAFNRVPSLRRLDLGELKRLEYISEAAFEGLVNLRYLNLGMCNLKDIPNLTALVRLEELELSGNRLDLIRPGSFQGLTSLRKLWLMHAQVATIERNAFDDLKSLEELNLSHNNLMSLPHDLFTPLHRLERVHLNHNPWHCNCDVLWLSWWLKETVPSNTTCCARCHAPAGLKGRYIGELDQSHFTCYAPVIVEPPTDLNVTEGMAAELKCRTGTSMTSVNWLTPNGTLMTHGSYRVRISVLHDGTLNFTNVTVQDTGQYTCMVTNSAGNTTASATLNVSAVDPVAAGGTGSGGGGPGGSGGVGGGSGGYTYFTTVTVETLETQPGEEALQPRGTEKEPPGPTTDGVWGGGRPGDAAGPASSSTTAPAPRSSRPTEKAFTVPITDVTENALKDLDDVMKTTKIIIGCFVAITFMAAVMLVAFYKLRKQHQLHKHHGPTRTVEIINVEDELPAASAVSVAAAAAVASGGGVGGDSHLALPALERDHLNHHHYVAAAFKAHYSSNPSGGGCGGKGPPGLNSIHEPLLFKSGSKENVQETQI

SEQ ID NO: 2459 - protein, 640 aa, unidentified
MLNKMTLHPQQIMIGPRFNRALFDPLLVVLLALQLLVVAGLVRAQTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIKDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVVDWETTNVTTSLTPQSTRSTEKTFTIPVTDINSGIPGIDEVMKTTKIIIGCFVAITLMAAVMLVIFYKMRKQHHRQNHHAPTRTVEIINVDDEITGDTPMESHLPMPAIEHEHLNHYNSYKSPFNHTTTVNTINSIHSSVHEPLLIRMNSKDNVQETQI

SEQ ID NO: 2460 - protein, 313 aa, unidentified
MSLASGPGPGWLLFSFGMGLVSGSKCPNNCLCQAQEVICTGKQLTEYPLDIPLNTRRLFLNENRITSLPAMHLGLLSDLVYLDCQNNRIREVMDYTFIGVFKLIYLDLSSNNLTSISPFTFSVLSNLVQLNIANNPHLLSLHKFTFANTTSLRYLDLRNTGLQTLDSAALYHLTTLETLFLSGNPWKCNCSFLDFAIFLIVFHMDPSDDLNATCVEPTELTGWPITRVGNPLRYMCITHLDHKDYIFLLLIGFCIFAAGTVAAWLTGVCAVLYQNTRHKSSEEDEDEAGTRVEVSRRIFQTQTSSVQEFPQLI

SEQ ID NO: 2461 - protein, 298 aa, unidentified
MGDTWAQLPWPGPPHPAMLLISLLLAAGLMHSDAGTSCPVLCTCRNQVVDCSSQRLFSVPPDLPMDTRNLSLAHNRITAVPPGYLTCYMELQVLDLHNNSLMELPRGLFLHAKRLAHLDLSYNNFSHVPADMFQEAHGLVHIDLSHNPWLRRVHPQAFQGLMQLRDLDLSYGGLAFLSLEALEGLPGLVTLQIGGNPWVCGCTMEPLLKWLRNRIQRCTADSQLAECRGPPEVEGAPLFSLTEESFKACHLTLTLDDYLFIAFVGFVVSIASVATNFLLGITANCCHRWSKASEEEEI

SEQ ID NO: 2462 - protein, 307 aa, unidentified
MTKAGSKGGNLRDKLDGNELDLSLSDLNEVPVKELAALPKATILDLSCNKLTTLPSDFCGLTHLVKLDLSKNKLQQLPADFGRLVNLQHLDLLNNKLVTLPVSFAQLKNLKWLDLKDNPLDPVLAKVAGDCLDEKQCKQCANKVLQHMKAVQADQERERQRRLEVEREAEKKREAKQRAKEAQERELRKREKAEEKERRRKEYDALKAAKREQEKKPKKEANQAPKSKSGSRPRKPPPRKHTRSWAVLKLLLLLLLFGVAGGLVACRVTELQQQPLCTSVNTIYDNAVQGLRRHEILQWVLQTDSQQ

SEQ ID NO: 2463 - protein, 880 aa, unidentified
MKNLYFRVITIVIGLYFTGIMTNASRKSNILFNSECQWNEYILTNCSFTGKCDIPVDISQTAATVDVSFNFFRVLLQSHTKKEEWKIKHLDLSNNLISKITLSPFAYLHALEVLNLSNNAIHSLSLDLLSPKSSWVKRHRSSFRNRFPLLKVLILQRNKLSDTPKGLWKLKSLQSLDLSFNGILQIGWSDFHNCLQLENLCLKSNKIFKIPPQAFKDLKKLQVIDLSNNALITILPMMIIALEFPHLVVDLADNNWQCDDSVAVFQNFISESWRKKWNVICNRSIGSEEANGGTPQSRISRETRLPPIHLHRMKSLIRSKAERPQGGRHTGISTLGKKAKAGSGLRKKQRRLPRSVRSTRDVQAAGKKEDAPQDLALAVCLSVFITFLVAFSLGAFTRPYVDRLWQKKCQSKSPGLDNAYSNEGFYDDMEAAGHTPHPETHLRQVFPHLSLYENQTPFWVTQPHPHATVIPDRTLGRSRKDPGSSQSPGQCGDNTGAGSGNDGAVYSILQRHPHAGNRELMSAAQDHIHRNDILGEWTYETVAQEEPLSAHSVGVSSVAGTSHAVSGSSRYDSNELDPSLSGEITASLCKMLTHAEAQRTGDSKERGGTEQSLWDSQMEFSKERQVSSSIDLLSIQQPRLSGARAEEALSAHYSEVPYGDPRDTGPSVFPPRWDSGLDVTPANKEPVQKSTPSDTCCELESDCDSDEGSLFTLSSISSESARSKTEEAVPDEESLQDESSGASKDNVTAVDSLEENVTFQTIPGKCKNQEDPFEKPLISAPDSGMYKTHLENASDTDRSEGLSPWPRSPGNSPLGDEFPGMFTYDYDTALQSKAAEWHCSLRDLEFSNVDVLQQTPPCSAEVPSDPDKAAFHERDSDILK

SEQ ID NO: 2464 - protein, 622 aa, unidentified
MCGLQFSLPCLRLFLVVTCYLLLLLHKEILGCSSVCQLCTGRQINCRNLGLSSIPKNFPESTVFLYLTGNNISYINESELTGLHSLVALYLDNSNILYVYPKAFVQLRHLYFLFLNNNFIKRLDPGIFKGLLNLRNLYLQYNQVSFVPRGVFNDLVSVQYLNLQRNRLTVLGSGTFVGMVALRILDLSNNNILRISESGFQHLENLACLYLGSNNLTKVPSNAFEVLKSLRRLSLSHNPIEAIQPFAFKGLANLEYLLLKNSRIRNVTRDGFSGINNLKHLILSHNDLENLNSDTFSLLKNLIYLKLDRNRIISIDNDTFENMGASLKILNLSFNNLTALHPRVLKPLSSLIHLQANSNPWECNCKLLGLRDWLASSAITLNIYCQNPPSMRGRALRYINITNCVTSSINVSRAWAVVKSPHIHHKTTALMMAWHKVTTNGSPLENTETENITFWERIPTSPAGRFFQENAFGNPLETTAVLPVQIQLTTSVTLNLEKNSALPNDAASMSGKTSLICTQEVEKLNEAFDILLAFFILACVLIIFLIYKVVQFKQKLKASENSRENRLEYYSFYQSARYNVTASICNTSPNSLESPGLEQIRLHKQIVPENEAQVILFEHSAL

SEQ ID NO: 2465 - protein, 810 aa, unidentified
MIPVTELRYFADTQPAYRILKPWWDVFTDYISIVMLMIAVFGGTLQVTQDKMICLPCKWVTKDSCNDSFRGWAAPGPEPTYPNSTILPTPDTGPTGIKYDLDRHQYNYVDAVCYENRLHWFAKYFPYLVLLHTLIFLACSNFWFKFPRTSSKLEHFVSILLKCFDSPWTTRALSETVVEESDPKPAFSKMNGSMDKKSSTVSEDVEATVPMLQRTKSRIEQGIVDRSETGVLDKKEGEQAKALFEKVKKFRTHVEEGDIVYRLYMRQTIIKVIKFILIICYTVYYVHNIKFDVDCTVDIESLTGYRTYRCAHPLATLFKILASFYISLVIFYGLICMYTLWWMLRRSLKKYSFESIREESSYSDIPDVKNDFAFMLHLIDQYDPLYSKRFAVFLSEVSENKLRQLNLNNEWTLDKLRQRLTKNAQDKLELHLFMLSGIPDTVFDLVELEVLKLELIPDVTIPPSIAQLTGLKELWLYHTAAKIEAPALAFLRENLRALHIKFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSHNNLTFLPADIGLLQNLQNLAITANRIETLPPELFQCRKLRALHLGNNVLQSLPSRVGELTNLTQIELRGNRLECLPVELGECPLLKRSGLVVEEDLFNTLPPEVKERLWRADKEQA

SEQ ID NO: 2466 - protein, 803 aa, unidentified
MITLTELKCLADAQSSYHILKPWWDVFWYYITLIMLLVAVLAGALQLTQSRVLCCLPCKVEFDNHCAVPWDILKASMNTSSNPGTPLPLPLRIQNDLHRQQYSYIDAVCYEKQLHWFAKFFPYLVLLHTLIFAACSNFWLHYPSTSSRLEHFVAILHKCFDSPWTTRALSETVAEQSVRPLKLSKSKILLSSSGCSADIDSGKQSLPYPQPGLESAGIESPTSSVLDKKEGEQAKAIFEKVKRFRMHVEQKDIIYRVYLKQIIVKVILFVLIITYVPYFLTHITLEIDCSVDVQAFTGYKRYQCVYSLAEIFKVLASFYVILVILYGLTSSYSLWWMLRSSLKQYSFEALREKSNYSDIPDVKNDFAFILHLADQYDPLYSKRFSIFLSEVSENKLKQINLNNEWTVEKLKSKLVKNAQDKIELHLFMLNGLPDNVFELTEMEVLSLELIPEVKLPSAVSQLVNLKELRVYHSSLVVDHPALAFLEENLKILRLKFTEMGKIPRWVFHLKNLKELYLSGCVLPEQLSTMQLEGFQDLKNLRTLYLKSSLSRIPQVVTDLLPSLQKLSLDNEGSKLVVLNNLKKMVNLKSLELISCDLERIPHSIFSLNNLHELDLRENNLKTVEEIISFQHLQNLSCLKLWHNNIAYIPAQIGALSNLEQLSLDHNNIENLPLQLFLCTKLHYLDLSYNHLTFIPEEIQYLSNLQYFAVTNNNIEMLPDGLFQCKKLQCLLLGKNSLMNLSPHVGELSNLTHLELIGNYLETLPPELEGCQSLKRNCLIVEENLLNTLPLPVTERLQTCLDKC

SEQ ID NO: 2467 - protein, 803 aa, unidentified
MIPVTEFRQFSEQQPAFRVLKPWWDVFTDYLSVAMLMIGVFGCTLQVMQDKIICLPKRVQPAQNHSSLSNVSQAVASTTPLPPPKPSPANPITVEMKGLKTDLDLQQYSFINQMCYERALHWYAKYFPYLVLIHTLVFMLCSNFWFKFPGSSSKIEHFISILGKCFDSPWTTRALSEVSGEDSEEKDNRKNNMNRSNTIQSGPEDSLVNSQSLKSIPEKFVVDKSTAGALDKKEGEQAKALFEKVKKFRLHVEEGDILYAMYVRQTVLKVIKFLIIIAYNSALVSKVQFTVDCNVDIQDMTGYKNFSCNHTMAHLFSKLSFCYLCFVSIYGLTCLYTLYWLFYRSLREYSFEYVRQETGIDDIPDVKNDFAFMLHMIDQYDPLYSKRFAVFLSEVSENKLKQLNLNNEWTPDKLRQKLQTNAHNRLELPLIMLSGLPDTVFEITELQSLKLEIIKNVMIPATIAQLDNLQELSLHQCSVKIHSAALSFLKENLKVLSVKFDDMRELPPWMYGLRNLEELYLVGSLSHDISRNVTLESLRDLKSLKILSIKSNVSKIPQAVVDVSSHLQKMCIHNDGTKLVMLNNLKKMTNLTELELVHCDLERIPHAVFSLLSLQELDLKENNLKSIEEIVSFQHLRKLTVLKLWHNSITYIPEHIKKLTSLERLSFSHNKIEVLPSHLFLCNKIRYLDLSYNDIRFIPPEIGVLQSLQYFSITCNKVESLPDELYFCKKLKTLKIGKNSLSVLSPKIGNLLFLSYLDVKGNHFEILPPELGDCRALKRAGLVVEDALFETLPSDVREQMKTE

SEQ ID NO: 2468 - protein, 858 aa, unidentified
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTVIKTAKFIFILCYTANFVNAISFEHVCKPKVEHLIGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHISRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVAPHLTKLVIHNDGTKLLVLNSLKKMMNVAELELQNCELERIPHAIFSLSNLQELDLKSNNIRTIEEIISFQHLKRLTCLKLWHNKIVTIPPSITHVKNLESLYFSNNKLESLPVAVFSLQKLRCLDVSYNNISMIPIEIGLLQNLQHLHITGNKVDILPKQLFKCIKLRTLNLGQNCITSLPEKVGQLSQLTQLELKGNCLDRLPAQLGQCRMLKKSGLVVEDHLFDTLPLEVKEALNQDINIPFANGI

SEQ ID NO: 2469 - protein, 796 aa, unidentified
MIPVAEFKQFTEQQPAFKVLKPWWDVLAEYLTVAMLMIGVFGCTLQVTQDKIICLPNHELQENLSEAPCQQLLPRGIPEQIGALQEVKGLKNNLDLQQYSFINQLCYETALHWYAKYFPYLVVIHTLIFMVCTSFWFKFPGTSSKIEHFISILGKCFDSPWTTRALSEVSGENQKGPAATERAAATIVAMAGTGPGKAGEGEKEKVLAEPEKVVTEPPVVTLLDKKEGEQAKALFEKVKKFRMHVEEGDILYTMYIRQTVLKVCKFLAILVYNLVYVEKISFLVACRVETSEVTGYASFCCNHTKAHLFSKLAFCYISFVCIYGLTCIYTLYWLFHRPLKEYSFRSVREETGMGDIPDVKNDFAFMLHLIDQYDSLYSKRFAVFLSEVSESRLKQLNLNHEWTPEKLRQKLQRNAAGRLELALCMLPGLPDTVFELSEVESLRLEAICDITFPPGLSQLVHLQELSLLHSPARLPFSLQVFLRDHLKVMRVKCEELREVPLWVFGLRGLEELHLEGLFPQELARAATLESLRELKQLKVLSLRSNAGKVPASVTDVAGHLQRLSLHNDGARLVALNSLKKLAALRELELVACGLERIPHAVFSLGALQELDLKDNHLRSIEEILSFQHCRKLVTLRLWHNQIAYVPEHVRKLRSLEQLYLSYNKLETLPSQLGLCSGLRLLDVSHNGLHSLPPEVGLLQNLQHLALSYNALEALPEELFFCRKLRTLLLGDNQLSQLSPHVGALRALSRLELKGNRLEALPEELGNCGGLKKAGLLVEDTLYQGLPAEVRDKMEEE

SEQ ID NO: 2470 - protein, 716 aa, unidentified
MARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVPQLALQKVPNLKFLDLNKNPIHKIQEGDFKNMLRLKELGINNMGELVSVDRYALDNLPELTKLEATNNPKLSYIHRLAFRSVPALESLMLNNNALNAIYQKTVESLPNLREISIHSNPLRCDCVIHWINSNKTNIRFMEPLSMFCAMPPEYKGHQVKEVLIQDSSEQCLPMISHDSFPNRLNVDIGTTVFLDCRAMAEPEPEIYWVTPIGNKITVETLSDKYKLSSEGTLEISNIQIEDSGRYTCVAQNVQGADTRVATIKVNGTLLDGTQVLKIYVKQTESHSILVSWKVNSNVMTSNLKWSSATMKIDNPHITYTARVPVDVHEYNLTHLQPSTDYEVCLTVSNIHQQTQKSCVNVTTKNAAFAVDISDQETSTALAAVMGSMFAVISLASIAVYFAKRFKRKNYHHSLKKYMQKTSSIPLNELYPPLINLWEGDSEKDKDGSADTKPTQVDTSRSYYMW

SEQ ID NO: 2471 - protein, 713 aa, unidentified
MRLLVAPLLLAWVAGATAAVPVVPWHVPCPPQCACQIRPWYTPRSSYREATTVDCNDLFLTAVPPALPAGTQTLLLQSNSIVRVDQSELGYLANLTELDLSQNSFSDARDCDFHALPQLLSLHLEENQLTRLEDHSFAGLASLQELYLNHNQLYRIAPRAFSGLSNLLRLHLNSNLLRAIDSRWFEMLPNLEILMIGGNKVDAILDMNFRPLANLRSLVLAGMNLREISDYALEGLQSLESLSFYDNQLARVPRRALEQVPGLKFLDLNKNPLQRVGPGDFANMLHLKELGLNNMEELVSIDKFALVNLPELTKLDITNNPRLSFIHPRAFHHLPQMETLMLNNNALSALHQQTVESLPNLQEVGLHGNPIRCDCVIRWANATGTRVRFIEPQSTLCAEPPDLQRLPVREVPFREMTDHCLPLISPRSFPPSLQVASGESMVLHCRALAEPEPEIYWVTPAGLRLTPAHAGRRYRVYPEGTLELRRVTAEEAGLYTCVAQNLVGADTKTVSVVVGRALLQPGRDEGQGLELRVQETHPYHILLSWVTPPNTVSTNLTWSSASSLRGQGATALARLPRGTHSYNITRLLQATEYWACLQVAFADAHTQLACVWARTKEATSCHRALGDRPGLIAILALAVLLLAAGLAAHLGTGQPRKGVGGRRPLPPAWAFWGWSAPSVRVVSAPLVLPWNPGRKLPRSSEGETLLPPLSQNS

SEQ ID NO: 2472 - protein, 708 aa, unidentified
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVALQKVVNLKFLDLNKNPINRIRRGDFSNMLHLKELGINNMPELISIDSLAVDNLPDLRKIEATNNPRLSYIHPNAFFRLPKLESLMLNSNALSALYHGTIESLPNLKEISIHSNPIRCDCVIRWMNMNKTNIRFMEPDSLFCVDPPEFQGQNVRQVHFRDMMEICLPLIAPESFPSNLNVEAGSYVSFHCRATAEPQPEIYWITPSGQKLLPNTLTDKFYVHSEGTLDINGVTPKEGGLYTCIATNLVGADLKSVMIKVDGSFPQDNNGSLNIKIRDIQANSVLVSWKASSKILKSSVKWTAFVKTENSHAAQSARIPSDVKVYNLTHLNPSTEYKICIDIPTIYQKNRKKCVNVTTKGLHPDQKEYEKNNTTTLMACLGGLLGIIGVICLISCLSPEMNCDGGHSYVRNYLQKPTFALGELYPPLINLWEAGKEKSTSLKVKATVIGLPTNMS

SEQ ID NO: 2473 - protein, 740 aa, unidentified
MRQTLPLLLLTVLRPSWADPPQEKVPLFRVTQQGPWGSSGSNATDSPCEGLPAADATALTLANRNLERLPGCLPRTLRSLDASHNLLRALSTSELGHLEQLQVLTLRHNRIAALRWGPGGPAGLHTLDLSYNQLAALPPCTGPALSSLRALALAGNPLRALQPRAFACFPALQLLNLSCTALGRGAQGGIAEAAFAGEDGAPLVTLEVLDLSGTFLERVESGWIRDLPKLTSLYLRKMPRLTTLEGDIFKMTPNLQQLDCQDSPALASVATHIFQDTPHLQVLLFQNCNLSSFPPWTLDSSQVLSINLFGNPLTCSCDLSWLLTDAKRTVLSRAADTMCAPAAGSSGPFSASLSLSQLPGVCQSDQSTTLGASHPPCFNRSTYAQGTTVAPSAAPATRPAGDQQSVSKAPNVGSRTIAAWPHSDAREGTAPSTTNSVAGHSNSSVFPRAASTTRTQHRGEHAPELVLEPDISAASTPLASKLLGPFPTSWDRSISSPQPGQRTHATPQAPNPSLSEGEIPVLLLDDYSEEEEGRKEEVGTPHQDVPCDYHPCKHLQTPCAELQRRWRCRCPGLSGEDTIPDPPRLQGVTETTDTSALVHWCAPNSVVHGYQIRYSAEGWAGNQSVVGVIYATARQHPLYGLSPGTTYRVCVLAANRAGLSQPRSSGWRSPCAAFTTKPSFALLLSGLCAASGLLLASTVVLSACLCRRGQTLGLQRCDTHLVAYKNPAFDDYPLGLQTVS

SEQ ID NO: 2474 - protein, 238 aa, unidentified
MLGSPCLLWLLAVTFLVPRAQPLAPQDFEEEEADETETAWPPLPAVPCDYDHCRHLQVPCKELQRVGPAACLCPGLSSPAQPPDPPRMGEVRIAAEEGRAVVHWCAPFSPVLHYWLLLWDGSEAAQKGPPLNATVRRAELKGLKPGGIYVVCVVAANEAGASRVPQAGGEGLEGADIPAFGPCSRLAVPPNPRTLVHAAVGVGTALALLSCAALVWHFCLRDRWGCPRRAAARAAGAL

SEQ ID NO: 2475 - protein, 522 aa, unidentified
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLNNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 2476 - protein, 516 aa, unidentified
MGLHFKWPLGAPMLAAIYAMSMVLKMLPALGMACPPKCRCEKLLFYCDSQGFHSVPNATDKGSLGLSLRHNHITELERDQFASFSQLTWLHLDHNQISTVKEDAFQGLYKLKELILSSNKIFYLPNTTFTQLINLQNLDLSFNQLSSLHPELFYGLRKLQTLHLRSNSLRTIPVRLFWDCRSLEFLDLSTNRLRSLARNGFAGLIKLRELHLEHNQLTKINFAHFLRLSSLHTLFLQWNKISNLTCGMEWTWGTLEKLDLTGNEIKAIDLTVFETMPNLKILLMDNNKLNSLDSKILNSLRSLTTVGLSGNLWECSARICALASWLGSFQGRWEHSILCHSPDHTQGEDILDAVHGFQLCWNLSTTVTVMATTYRDPTTEYTKRISSSSYHVGDKEIPTTAGIAVTTEEHFPEPDNAIFTQRVITGTMALLFSFFFIIFIVFISRKCCPPTLRRIRQCSMVQNHRQLRSQTRLHMSNMSDQGPYNEYEPTHEGPFIIINGYGQCKCQQLPYKECEV

SEQ ID NO: 2477 - protein, 581 aa, unidentified
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEIPLSMNVSTFLAYDQPTISYCGVHHELLSHKSFETNAQEDTMETHLETELDLSTITTAGRISDHKQQLA

SEQ ID NO: 2478 - protein, 590 aa, unidentified
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 2479 - protein, 345 aa, unidentified
MKGELLLFSSVIVLLQVVCSCPDKCYCQSSTNFVDCSQQGLAEIPSHLPPQTRTLHLQDNQIHHLPAFAFRSVPWLMTLNLSNNSLSNLAPGAFHGLQHLQVLNLTQNSLLSLESRLFHSLPQLRELDLSSNNISHLPTSLGETWENLTILAVQQNQLQQLDRALLESMPSVRLLLLKDNLWKCNCHLLGLKLWLEKFVYKGGLTDGIICESPDTWKGKDLLRIPHELYQPCPLPAPDPVSSQAQWPGSAHGVVLRPPENHNAGERELLECELKPKPRPANLRHAIATVIITGVVCGIVCLMMLAAAIYGCTYAAITAQYHGGPLAQTNDPGKVEEKERFDSSPA

SEQ ID NO: 2480 - protein, 370 aa, unidentified
MLAPGSSPGQRGRLALQWRQVSWITCWIALYAVEALPTCPFSCKCDSRSLEVDCSGLGLTTVPPDVPAATRTLLLLNNKLSALPSWAFANLSSLQRLDLSNNFLDRLPRSIFGDLTNLTELQLRNNSIRTLDRDLLRHSPLLRHLDLSINGLAQLPPGLFDGLLALRSLSLRSNRLQNLDRLTFEPLANLQLLQVGDNPWECDCNLREFKHWMEWFSYRGGRLDQLACTLPKELRGKDMRMVPMEMFNYCSQLEDENSSAGLDIPGPPCTKASPEPAKPKPGAEPEPEPSTACPQKQRHRPASVRRAMGTVIIAGVVCGVVCIMMVVAAAYGCIYASLMAKYHRELKKRQPLMGDPEGEHEDQKQISSVA

SEQ ID NO: 2481 - protein, 192 aa, unidentified
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRQYVLCTLSRITTFDFSGVTKADRTTAEVWKRMNIKPKKAWTKQNTL

SEQ ID NO: 2482 - protein, 338 aa, unidentified
MVRRVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 2483 - protein, 131 aa, unidentified
MTHSSQDTGSCGIQEDGKLYVVDSINDLNKLNLCPAGSQHLFPLEDKIPVLGTNSGNGSRSLFFVGLLIVLIVSLALVFFVIFLIVQTGNKMDDVSRRLTAEGKDIDDLKRINNMIVKRLNQLNQLDSEQN

SEQ ID NO: 2484 - protein, 164 aa, unidentified
MPSLAPDCPLLAMPEETQEDSVAPMMPSQRSRGPLAPNHVHEVCLHQVESISDLHSGAGTLRPYLTEEARPWDELLGVLPPSLCAQAGCSPVYRRGGFLLLLALLVLTCLVLALLAVYLSVLQSESLRILAHTLRTQEETLLKLRLASLSQLRRLNSSEAQAPS

SEQ ID NO: 2485 - protein, 649 aa, unidentified
MQQDGLGVGTRNGSGKGRSVHPSWPWCAPRPLRYFGRDARARRAQTAAMALLAGGLSRGLGSHPAAAGRDAVVFVWLLLSTWCTAPARAIQVTVSNPYHVVILFQPVTLPCTYQMTSTPTQPIVIWKYKSFCRDRIADAFSPASVDNQLNAQLAAGNPGYNPYVECQDSVRTVRVVATKQGNAVTLGDYYQGRRITITGNADLTFDQTAWGDSGVYYCSVVSAQDLQGNNEAYAELIVLGRTSGVAELLPGFQAGPIEDWLFVVVVCLAAFLIFLLLGICWCQCCPHTCCCYVRCPCCPDKCCCPEALYAAGKAATSGVPSIYAPSTYAHLSPAKTPPPPAMIPMGPAYNGYPGGYPGDVDRSSSAGGQGSYVPLLRDTDSSVASEVRSGYRIQASQQDDSMRVLYYMEKELANFDPSRPGPPSGRVERAMSEVTSLHEDDWRSRPSRGPALTPIRDEEWGGHSPRSPRGWDQEPAREQAGGGWRARRPRARSVDALDDLTPPSTAESGSRSPTSNGGRSRAYMPPRSRSRDDLYDQDDSRDFPRSRDPHYDDFRSRERPPADPRSHHHRTRDPRDNGSRSGDLPYDGRLLEEAVRKKGSEERRRPHKEEEEEAYYPPAPPPYSETDSQASRERRLKKNLALSRESLVV

SEQ ID NO: 2486 - protein, 97 aa, unidentified
MLSRNDDICIYGGLGLGGLLLLAVVLLSACLCWLHRRVKRLERSWAQGSSEQELHYASLQRLPVPSSEGPDLRGRDKRGTKEDPRADYACIAENKPT

SEQ ID NO: 2487 - protein, 352 aa, unidentified
MNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 2488 - protein, 358 aa, unidentified
MSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPEWDL

SEQ ID NO: 2489 - protein, 435 aa, unidentified
MLLPWATSAPGLAWGPLVLGLFGLLAASQPQAVPPYASENQTCRDQEKEYYEPQHRICCSRCPPGTYVSAKCSRIRDTVCATCAENSYNEHWNYLTICQLCRPCDPVMGLEEIAPCTSKRKTQCRCQPGMFCAAWALECTHCELLSDCPPGTEAELKDEVGKGNNHCVPCKAGHFQNTSSPSARCQPHTRCENQGLVEAAPGTAQSDTTCKNPLEPLPPEMSGTMLMLAVLLPLAFFLLLATVFSCIWKSHPSLCRKLGSLLKRRPQGEGPNPVAGSWEPPKAHPYFPDLVQPLLPISGDVSPVSTGLPAAPVLEAGVPQQQSPLDLTREPQLEPGEQSQVAHGTNGIHVTGGSMTITGNIYIYNGPVLGGPPGPGDLPATPEPPYPIPEEGDPGPPGLSTPHQEDGKAWHLAETEHCGATPSNRGPRNQFITHD

SEQ ID NO: 2490 - protein, 150 aa, unidentified
MKDEVALLAAVTLLGVLLQAYFSLQVISARRAFRVSPPLTTGPPEFERVYRAQVNCSEYFPLFLATLWVAGIFFHEGAAALCGLVYLFARLRYFQGYARSAQLRLAPLYASARALWLLVALAALGLLAHFLPAALRAALLGRLRTLLPWA

SEQ ID NO: 2491 - protein, 864 aa, unidentified
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 2492 - protein, 1766 aa, unidentified
MGGKNKQRTKGNLRPSNSGRAAELLAKEQGTVPGFIGFGTSQSDLGYVPAIQGAEEIDSLVDSDFRMVLRKLSKKDVTTKLKAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSLESSAVISAFFECLRFIMQQNLGEEEIEQMLVNDQLIPFIDAVLKDPGLQHGQLFNHLAETLSSWEAKADTEKDEKTAHNLENVLIHFWERLSEICVAKISEPEADVESVLGVSNLLQVLQKPKSSLKSSKKKNGKVRFADEILESNKENEKCVSSEGEKIEGWELTTEPSLTHNSSGLLSPLRKKPLEDLVCKLADISINYVNERKSEQHLRFLSTLLDSFSSSRVFKMLLGDEKQSIVQAKPLEIAKLVQKNPAVQFLYQKLIGWLNEDQRKDFGFLVDILYSALRCCDNDMERKKVLDDLTKVDLKWNSLLKIIEKACPSSDKHALVTPWLKGDILGEKLVNLADCLCNEDLESRVSSESHFSERWTLLSLVLSQHVKNDYLIGDVYVERIIVRLHETLFKTKKLSEAESSDSSVSFICDVAYNYFSSAKGCLLMPSSEDLLLTLFQLCAQSKEKTHLPDFLICKLKNTWLSGVNLLVHQTDSSYKESTFLHLSALWLKNQVQASSLDINSLQVLLSAVDDLLNTLLESEDSYLMGVYIGSVMPNDSEWEKMRQSLPMQWLHRPLLEGRLSLNYECFKTDFKEQDIKTLPSHLCTSALLSKMVLIALRKETVLENNELEKIIAELLYSLQWCEELDNPPIFLIGFCEILQKMNITYDNLRVLGNTSGLLQLLFNRSREHGTLWSLIIAKLILSRSISSDEVKPHYKRKESFFPLTEGNLHTIQSLCPFLSKEEKKEFSAQCIPALLGWTKKDLCSTNGGFGHLAIFNSCLQTKSIDDGELLHGILKIIISWKKEHEDIFLFSCNLSEASPEVLGVNIEIIRFLSLFLKYCSSPLAESEWDFIMCSMLAWLETTSENQALYSIPLVQLFACVSCDLACDLSAFFDSTTLDTIGNLPVNLISEWKEFFSQGIHSLLLPILVTVTGENKDVSETSFQNAMLKPMCETLTYISKEQLLSHKLPARLVADQKTNLPEYLQTLLNTLAPLLLFRARPVQIAVYHMLYKLMPELPQYDQDNLKSYGDEEEEPALSPPAALMSLLSIQEDLLENVLGCIPVGQIVTIKPLSEDFCYVLGYLLTWKLILTFFKAASSQLRALYSMYLRKTKSLNKLLYHLFRLMPENPTYAETAVEVPNKDPKTFFTEELQLSIRETTMLPYHIPHLACSVYHMTLKDLPAMVRLWWNSSEKRVFNIVDRFTSKYVSSVLSFQEISSVQTSTQLFNGMTVKARATTREVMATYTIEDIVIELIIQLPSNYPLGSIIVESGKRVGVAVQQWRNWMLQLSTYLTHQNGSIMEGLALWKNNVDKRFEGVEDCMICFSVIHGFNYSLPKKACRTCKKKFHSACLYKWFTSSNKSTCPLCRETFF

SEQ ID NO: 2493 - protein, 128 aa, unidentified
MRTALLLLAALAVATGPALTLRCHVCTSSSNCKHSVVCPASSRFCKTTNTVEPLRGNLVKKDCAESCTPSYTLQGQVSSGTSSTQCCQEDLCNEKLHNAAPTRTALAHSALSLGLALSLLAVILAPSL

SEQ ID NO: 2494 - protein, 131 aa, unidentified
MKIFLPVLLAALLGVERASSLMCFSCLNQKSNLYCLKPTICSDQDNYCVTVSASAGIGNLVTFGHSLSKTCSPACPIPEGVNVGVASMGISCCQSFLCNFSAADGGLRASVTLLGAGLLLSLLPALLRFGP

SEQ ID NO: 2495 - protein, 150 aa, unidentified
MRFMAGPAGSQSLGPLCFHSSPQALYTVLLIVLVMMSLVFGKFVPVNWEPPQPLPFPKYLRCYRCLLETKELGCLLGSDICLTPAGSSCITLHKKNSSGSDVMVSDCRSKEQMSDCSNTRTSPVSGFWIFSQYCFLDFCNDPQNRGLYTP

SEQ ID NO: 2496 - protein, 125 aa, unidentified
MKALMLLTLSVLLCWVSADIRCHSCYKVPVLGCVDRQSCRLEPGQQCLTTHAYLGKMWVFSNLRCGTPEEPCQEAFNQTNRKLGLTYNTTCCNKDNCNSAGPRPTPALGLVFLTSLAGLGLWLLH

SEQ ID NO: 2497 - protein, 133 aa, unidentified
MKPQFVGILLSSLLGAALGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 2498 - protein, 297 aa, unidentified
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRDASIPQFKPEIQVYENIHLARLGPPAHKPR

SEQ ID NO: 2499 - protein, 165 aa, unidentified
MALLALLLVVALPRVWTDANLTARQRDPEDSQRTDEGDNRVWCHVCERENTFECQNPRRCKWTEPYCVIAAVKIFPRFFMVAKQCSAGCAAMERPKPEEKRFLLEEPMPFFYLKCCKIRYCNLEGPPINSSVFKEYAGSMGESCGGLWLAILLLLASIAAGLSLS

SEQ ID NO: 2500 - protein, 1722 aa, unidentified
MRTGWATPRRPAGLLMLLFWFFDLAEPSGRAANDPFTIVHGNTGKCIKPVYGWIVADDCDETEDKLWKWVSQHRLFHLHSQKCLGLDITKSVNELRMFSCDSSAMLWWKCEHHSLYGAARYRLALKDGHGTAISNASDVWKKGGSEESLCDQPYHEIYTRDGNSYGRPCEFPFLIDGTWHHDCILDEDHSGPWCATTLNYEYDRKWGICLKPENGCEDNWEKNEQFGSCYQFNTQTALSWKEAYVSCQNQGADLLSINSAAELTYLKEKEGIAKIFWIGLNQLYSARGWEWSDHKPLNFLNWDPDRPSAPTIGGSSCARMDAESGLWQSFSCEAQLPYVCRKPLNNTVELTDVWTYSDTRCDAGWLPNNGFCYLLVNESNSWDKAHAKCKAFSSDLISIHSLADVEVVVTKLHNEDIKEEVWIGLKNINIPTLFQWSDGTEVTLTYWDENEPNVPYNKTPNCVSYLGELGQWKVQSCEEKLKYVCKRKGEKLNDASSDKMCPPDEGWKRHGETCYKIYEDEVPFGTNCNLTITSRFEQEYLNDLMKKYDKSLRKYFWTGLRDVDSCGEYNWATVGGRRRAVTFSNWNFLEPASPGGCVAMSTGKSVGKWEVKDCRSFKALSICKKMSGPLGPEEASPKPDDPCPEGWQSFPASLSCYKVFHAERIVRKRNWEEAERFCQALGAHLSSFSHVDEIKEFLHFLTDQFSGQHWLWIGLNKRSPDLQGSWQWSDRTPVSTIIMPNEFQQDYDIRDCAAVKVFHRPWRRGWHFYDDREFIYLRPFACDTKLEWVCQIPKGRTPKTPDWYNPDRAGIHGPPLIIEGSEYWFVADLHLNYEEAVLYCASNHSFLATITSFVGLKAIKNKIANISGDGQKWWIRISEWPIDDHFTYSRYPWHRFPVTFGEECLYMSAKTWLIDLGKPTDCSTKLPFICEKYNVSSLEKYSPDSAAKVQCSEQWIPFQNKCFLKIKPVSLTFSQASDTCHSYGGTLPSVLSQIEQDFITSLLPDMEATLWIGLRWTAYEKINKWTDNRELTYSNFHPLLVSGRLRIPENFFEEESRYHCALILNLQKSPFTGTWNFTSCSERHFVSLCQKYSEVKSRQTLQNASETVKYLNNLYKIIPKTLTWHSAKRECLKSNMQLVSITDPYQQAFLSVQALLHNSSLWIGLFSQDDELNFGWSDGKRLHFSRWAETNGQLEDCVVLDTDGFWKTVDCNDNQPGAICYYSGNETEKEVKPVDSVKCPSPVLNTPWIPFQNCCYNFIITKNRHMATTQDEVHTKCQKLNPKSHILSIRDEKENNFVLEQLLYFNYMASWVMLGITYRNKSLMWFDKTPLSYTHWRAGRPTIKNEKFLAGLSTDGFWDIQTFKVIEEAVYFHQHSILACKIEMVDYKEEYNTTLPQFMPYEDGIYSVIQKKVTWYEALNMCSQSGGHLASVHNQNGQLFLEDIVKRDGFPLWVGLSSHDGSESSFEWSDGSTFDYIPWKGQTSPGNCVLLDPKGTWKHEKCNSVKDGAICYKPTKSKKLSRLTYSSRCPAAKENGSRWIQYKGHCYKSDQALHSFSEAKKLCSKHDHSATIVSIKDEDENKFVSRLMRENNNITMRVWLGLSQHSVDQSWSWLDGSEVTFVKWENKSKSGVGRCSMLIASNETWKKVECEHGFGRVVCKVPLGPDYTAIAIIVATLSILVLMGGLIWFLFQRHRLHLAGFSSVRYAQGVNEDEIMLPSFHD

SEQ ID NO: 2501 - protein, 655 aa, unidentified
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 2502 - protein, 346 aa, unidentified [sequence omitted]

SEQ ID NO: 2503 - protein, 251 aa, unidentified
MAMGVPRVILLCLFGAALCLTGSQALQCYSFEHTYFGPFDLRAMKLPSISCPHECFEAILSLDTGYRAPVTLVRKGCWTGPPAGQTQSNADALPPDYSVVRGCTTDKCNAHLMTHDALPNLSQAPDPPTLSGAECYACIGVHQDDCAIGRSRRVQCHQDQTACFQGNGRMTVGNFSVPVYIRTCHRPSCTTEGTTSPWTAIDLQGSCCEGYLCNRKSMTQPFTSASATTPPRALQVLALLLPVLLLVGLSA

SEQ ID NO: 2504 - protein, 230 aa, unidentified
MCGNNMSTPLPAIVPAARKATAAVIFLHGLGDTGHGWAEAFAGIRSSHIKYICPHAPVRPVTLNMNVAMPSWFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQEMMDVKQFIDKLLPPID

SEQ ID NO: 2505 - protein, 306 aa, unidentified
MAGRHQNRSFPLPGVQSSGQVHAFGNCSDSDILEEDAEVYELRSRGKEKVRRSTSRDRLDDIIVLTKDIQEGDTLNAIALQYCCTVADIKRVNNLISDQDFFALRSIKIPVKKFSSLTETLCPPKGRQTSRHSSVQYSSEQQEILPANDSLAYSDSAGSFLKEVDRDIEQIVKCTDNKRENLNEVVSALTAQQMRFEPDNKNTQRKDPYYGADWGIGWWTAVVIMLIVGIITPVFYLLYYEILAKVDVSHHSTVDSSHLHSKITPPSQQREMENGIVPTKGIHFSQQDDHKLYSQDSQSPAAQQET

SEQ ID NO: 2506 - protein, 170 aa, unidentified
METHKELKPLLSPSSETTVTVELPEADRAGAGTGAQAGQLMGFFKGIDQDIERAVQSEIFLHESYCMDTSHQPLLPAPPKTPMDGADCGIQWWNAVFIMLLIGIVLPVFYLVYFKIQASGETPNSLNTTVIPNGSMAMGTVPGQAPRLAVAVPAVTSADSQFSQTTQAGS

SEQ ID NO: 2507 - protein, 322 aa, unidentified
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 2508 - protein, 148 aa, unidentified
MKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALITDDLTDAIICARKIVKETQGMNYWQGWKKHCEGRDLSEWKKGCEVS

SEQ ID NO: 2509 - protein, 148 aa, unidentified
MKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALVTDDLTDAIICAKKIVKETQGMNYWQGWKKHCEGRDLSDWKKDCEVS

SEQ ID NO: 2510 - protein, 277 aa, unidentified
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 2511 - protein, 7388 aa, unidentified
MSSSDEETLSERSCRSERSCRSERSYRSERSGSLSPCPPGDTLPWNLPLHEQKKRKSQDSVLDPAERAVVRVADERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKECRAVAGVIDLGTVEIFPIFKAMQKGLLDQDTGLVLLESQVIMSGLIAPETGENLSLEEGIARNLINPQMYQQLRELQDALALISRLTESRGPLSVVEAIEKRIISETVGLKILEAHLATGGFSLSPSENCINLEEAFHQGLISAWLHSVLESYLRTSKNLIDPNTAEKIGLLDLMQRCIVHQESGFKLLPVKQLAGGMVSLKSGRKVSIFRAVQEGLIDRQVTVRLLEAQLFAGGIVDPRTGHRLTVEEAVRHNLIDQDMACAILIRQLQTGGIIDTVTGQRLTIDEAVSNDLVAAKIALVILESLWSFMGLLWPESGEILPITDALEQGIVSTELAHKILSNRQHIKALFLPATTEILSWKKAIESGILDRDLANNLKSICIPDVMPHMQLADSAEQNINPGAAVLPCSKSHPKATASQSENLLFQLMTHSYINVQNGQRLLLLDKELMETLTSRDEYQTSPPKVVEIGHQRQKTPEGLQESANVKISGTFSSGWTVRLPEFQFSSQNKEYPDREDCTTEKGKKTTVETEDSSVENPEQDLFVEQKERNPNIDALKVINKVKLEVQRQLIGTQREDQTAVSVRENASRGHLLTIPPAEAEGVPLVVDKDVFSVETPKKEHQPLRNTSFTCQNEQAHTLETEYIHDETGGSHIKPQSKKLQVQVKKTLGIKLELKSETDGNVHPLDKKEMLKKTFLAKDDHKESQEAQNIAGGSMMMSEKTDEEDSGREIFLSCSHPLELLEEATLNVLSAQLLDGGIFHEQTGQKLLLNEAISRGIVPSHTAVKLMEKLNMFQGFFDSQTCESLTTEEVINEGLMDEKLLHNVLMADKAISGVLDPRTQTLCSVKDAVTVGLLDKETATRILERQVVTGGIIDLKRGKKVSVTLASTLGLVDVADQPELINLEKASKGRDAEKTVRERLISLQMETTGLIDPDSKAPLTVVQSIDRGLLEREEAVRLLTKQVVDGGIIHHISGMRLSVDNAFRHGLIGEDLAEKLKRVENLNIHQIFNPETKENISLPKAIKLDLITSDLKREIQEVQAFTGNFVDLISGQRLTLAEAKKEGLLTNEAVLSPGMMHGIVDPENCRIVPYSELVKKCKIDIESGQRYLEVIPFSDIKDGVSDKVLTLSQAIQLGKVDFASTLKVLEAQANTGGIIDTATGKRLTLASALEEKLVDENMVRIIASHQVLNGGIVDIFSDQRVTLVEAIEKRLISPELANMIQIDSSEFSDHRAQIEKQEGIEVCALQNEFLGKDMLIACNQTAEMSCNKVEESERLFQVENQSAQEKVKVRVSDGEQAKKSREISLKEFGCKDQRKPRMSSDAKEFISIINPHNLKGKSLGQVSLTHPYSECDFKLKEVARNNMGNDTNEEQEKAVTKIEIISHMKQSTSCLDSEEIRENQGEVILEVQETYCETSGKLPSEQVLQQPMNARVKSKREKREVIVEESIRTCKPAFLSEEKLYQETAIRDEHDSHIKSQPREMTSSEKGKEADTEMGFSITFKIEESSSQVVPQGISVKHLDALTLFSSKQANEGKVNNLSLCLTLKPEENLSREIACGAQSEPFPCMTPRPEGLHYQESDGKAQVTGPSQISKTDKSFQGTTRQETNYQDSWVTSKTKETKHQISSSNECKEKSYQEVSFDPARGLKLEEITVSRPDSKEVRYLEFSDRKDLHHQGSKSDDKLCGTLKSEIATQELTGEKFLEMANPNVAGLEAGSIEDIVTQRGSRVLGSFLPEKLFKGVSQKENTGQQNAIISPTVLETSEEKTVSLTVCSAVKTEKTPQEKLRESPGSEQTPFMTAPEGKGNGGVNPEPFRATQNVFTRQLCLEHDEKLVSYLSLLRNIEMRTKQIQPLELNLAELQDLLCQAKVLERELKDLTTLVSQELECVNQIIISQPQEVPAQLLKALEKDAKNLQKSLSSVSDTWNSRLLHFQNAVEIEKTKVLNQHTQLEGRLQDLRAWVGNKNLILNSKGSNSEIDVDSLNLCLQQYEDLKQPMAERKAQLDALAFDIQFFISEHAQDLSPQQNRQMLRLLNELQRSFQDILEQTAAQVDALQGHLQQMEQEALVKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 2512 - protein, 382 aa, unidentified
MDFGLALLLAGLLGLLLGQSLQVKPLQVEPPEPVVAVALGASRQLTCRLACADRGASVQWRGLDTSLGAVQSDTGRSVLTVRNASLSAAGTRVCVGSCGGRTFQHTVQLLVYAFPDQLTVSPAALVPGDPEVACTAHKVTPVDPNALSFSLLVGGQELEGAQALGPEVQEEEEEPQGDEDVLFRVTERWRLPPLGTPVPPALYCQATMRLPGLELSHRQAIPVLHSPTSPEPPDTTSPESPDTTSPESPDTTSQEPPDTTSPEPPDKTSPEPAPQQGSTHTPRSPGSTRTRRPEISQAGPTQGEVIPTGSSKPAGDQLPAALWTSSAVLGLLLLALPTYHLWKRCRHLAEDDTHPPASLRLLPQVSAWAGLRGTGQVGISPS

SEQ ID NO: 2513 - protein, 1647 aa, unidentified
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIELWNKHQEVKKQKALEKQRPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 2514 - protein, 626 aa, unidentified
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 2515 - protein, 317 aa, unidentified
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 2516 - protein, 741 aa, unidentified
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQHR

SEQ ID NO: 2517 - protein, 741 aa, unidentified; identical to SEQ ID NO: 2516

SEQ ID NO: 2518 - protein, 219 aa, unidentified
MPRGRKSRRRRNARAAEENRNNRKIQASEASETPMAASVVASTPEDDLSGPEEDPSTPEEASTTPEEASSTAQAQKPSVPRSNFQGTKKSLLMSILALIFIMGNSAKEALVWKVLGKLGMQPGRQHSIFGDPKKIVTEEFVRRGYLIYKPVPRSSPVEYEFFWGPRAHVESSKLKVMHFVARVRNRCSKDWPCNYDWDSDDDAEVEAILNSGARGYSAP

SEQ ID NO: 2519 - protein, 335 aa, unidentified
MAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 2520 - protein, 153 aa, unidentified
MAPAAATGGSTLPSGFSVFTTLPDLLFIFEFIFGGLVWILVASSLVPWPLVQGWVMFVSVFCFVATTTLIILYIIGAHGGETSWVTLDAAYHCTAALFYLSASVLEALATITMQDGFTYRHYHENIAAVVFSYIATLLYVVHAVFSLIRWKSS

SEQ ID NO: 2521 - protein, 176 aa, unidentified
MSAGGASVPPPPNPAVSFPPPRVTLPAGPDILRTYSGAFVCLEILFGGLVWILVASSNVPLPLLQGWVMFVSVTAFFFSLLFLGMFLSGMVAQIDANWNFLDFAYHFTVFVFYFGAFLLEAAATSLHDLHCNTTITGQPLLSDNQYNINVAASIFAFMTTACYGCSLGLALRRWRP

SEQ ID NO: 2522 - protein, 153 aa, unidentified
MASPDPPATSYAPSDVPSGVALFLTIPFAFFLPELIFGFLVWTMVAATHIVYPLLQGWVMYVSLTSFLISLMFLLSYLFGFYKRFESWRVLDSLYHGTTGILYMSAAVLQVHATIVSEKLLDPRIYYINSAASFFAFIATLLYILHAFSIYYH

SEQ ID NO: 2523 - protein, 1216 aa, unidentified
MPLSSHLLPALVLFLAGSSGWAWVPNHCRSPGQAVCNFVCDCRDCSDEAQCGYHGASPTLGAPFACDFEQDPCGWRDISTSGYSWLRDRAGAALEGPGPHSDHTLGTDLGWYMAVGTHRGKEASTAALRSPTLREAASSCKLRLWYHAASGDVAELRVELTHGAETLTLWQSTGPWGPGWQELAVTTGRIRGDFRVTFSATRNATHRGAVALDDLEFWDCGLPTPQANCPPGHHHCQNKVCVEPQQLCDGEDNCGDLSDENPLTCGRHIATDFETGLGPWNRSEGWSRNHRAGGPERPSWPRRDHSRNSAQGSFLVSVAEPGTPAILSSPEFQASGTSNCSLVFYQYLSGSEAGCLQLFLQTLGPGAPRAPVLLRRRRGELGTAWVRDRVDIQSAYPFQILLAGQTGPGGVVGLDDLILSDHCRPVSEVSTLQPLPPGPRAPAPQPLPPSSRLQDSCKQGHLACGDLCVPPEQLCDFEEQCAGGEDEQACGTTDFESPEAGGWEDASVGRLQWRRVSAQESQGSSAAAAGHFLSLQRAWGQLGAEARVLTPLLGPSGPSCELHLAYYLQSQPRGFLALVVVDNGSRELAWQALSSSAGIWKVDKVLLGARRRPFRLEFVGLVDLDGPDQQGAGVDNVTLRDCSPTVTTERDREVSCNFERDTCSWYPGHLSDTHWRWVESRGPDHDHTTGQGHFVLLDPTDPLAWGHSAHLLSRPQVPAAPTECLSFWYHLHGPQIGTLRLAMRREGEETHLWSRSGTQGNRWHEAWATLSHQPGSHAQYQLLFEGLRDGYHGTMALDDVAVRPGPCWAPNYCSFEDSDCGFSPGGQGLWRRQANASGHAAWGPPTDHTTETAQGHYMVVDTSPDALPRGQTASLTSKEHRPLAQPACLTFWYHGSLRSPGTLRVYLEERGRHQVLSLSAHGGLAWRLGSMDVQAERAWRVVFEAVAAGVAHSYVALDDLLLQDGPCPQPGSCDFESGLCGWSHLAWPGLGGYSWDWGGGATPSRYPQPPVDHTLGTEAGHFAFFETGVLGPGGRAAWLRSEPLPATPASCLRFWYHMGFPEHFYKGELKVLLHSAQGQLAVWGAGGHRRHQWLEAQVEVASAKEFQIVFEATLGGQPALGPIALDDVEYLAGQHCQQPAPSPGNTAAPGSVPAVVGSALLLLMLLVLLGLGGRRWLQKKGSCPFQSNTEATAPGFDNILFNADGVTLPASVTSDP

SEQ ID NO: 2524 - protein, 653 aa, unidentified
MPVGGLLPLFSSPAGGVLGGGLGGGGGRKGSGPAALRLTEKFVLLLVFSAFITLCFGAIFFLPDSSKLLSGVLFHSSPALQPAADHKPGPGARAEDAAEGRARRREEGAPGDPEAALEDNLARIRENHERALREAKETLQKLPEEIQRDILLEKKKVAQDQLRDKAPFRGLPPVDFVPPIGVESREPADAAIREKRAKIKEMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 2525 - protein, 641 aa, unidentified
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVVQEMKIKENKPLPPVPIPNLVGIRGGDPEDNDIREKREKIKEMMKHAWDNYRTYGWGHNELRPIARKGHSPNIFGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSGNPAVR

SEQ ID NO: 2526 - protein, 699 aa, unidentified
MAACEGRRSGALGSSQSDFLTPPVGGAPWAVATTVVMYPPPPPPPHRDFISVTLSFGENYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 2527 - protein, 630 aa, unidentified
MLMRKVPGFVPASPWGLRLPQKFLFLLFLSGLVTLCFGALFLLPHSSRLKRLFLAPRTQQPGLEVVAEIAGHAPAREQEPPPNPAPAAPAPGEDDPSSWASPRRRKGGLRRTRPTGPREEATAARGNSIPASRPGDEGVPFRFDFNAFRSRLRHPVLGTRADESQEPQSQVRAQREKIKEMMQFAWQSYKRYAMGKNELRPLTKDGYEGNMFGGLSGATVIDSLDTLYLMELKEEFQEAKAWVGESFHLNVSGEASLFEVNIRYIGGLLSAFYLTGEEVFRIKAIRLGEKLLPAFNTPTGIPKGVVSFKSGNWGWATAGSSSILAEFGSLHLEFLHLTELSGNQVFAEKVRNIRKVLRKIEKPFGLYPNFLSPVSGNWVQHHVSVGGLGDSFYEYLIKSWLMSGKTDMEAKNMYYEALEAIETYLLNVSPGGLTYIAEWRGGILDHKMGHLACFSGGMIALGAEDAKEEKRAHYRELAAQITKTCHESYARSDTKLGPEAFWFNSGREAVATQLSESYYILRPEVVESYMYLWRQTHNPIYREWGWEVVLALEKYCRTEAGFSGIQDVYSSTPNHDNKQQSFFLAETLKYLYLLFSEDDLLSLEDWVFNTEAHPLPVNHSDSSGRAWGRH

SEQ ID NO: 2528 - protein, 1144 aa, unidentified
MKLSRQFTVFGSAIFCVVIFSLYLMLDRGHLDYPRNPRREGSFPQGQLSMLQEKIDHLERLLAENNEIISNIRDSVINLSESVEDGPKSSQSNFSQGAGSHLLPSQLSLSVDTADCLFASQSGSHNSDVQMLDVYSLISFDNPDGGVWKQGFDITYESNEWDTEPLQVFVVPHSHNDPGWLKTFNDYFRDKTQYIFNNMVLKLKEDSRRKFIWSEISYLSKWWDIIDIQKKDAVKSLIENGQLEIVTGGWVMPDEATPHYFALIDQLIEGHQWLENNIGVKPRSGWAIDPFGHSPTMAYLLNRAGLSHMLIQRVHYAVKKHFALHKTLEFFWRQNWDLGSVTDILCHMMPFYSYDIPHTCGPDPKICCQFDFKRLPGGRFGCPWGVPPETIHPGNVQSRARMLLDQYRKKSKLFRTKVLLAPLGDDFRYCEYTEWDLQFKNYQQLFDYMNSQSKFKVKIQFGTLSDFFDALDKADETQRDKGQSMFPVLSGDFFTYADRDDHYWSGYFTSRPFYKRMDRIMESHLRAAEILYYFALRQAHKYKINKFLSSSLYTALTEARRNLGLFQHHDAITGTAKDWVVVDYGTRLFHSLMVLEKIIGNSAFLLILKDKLTYDSYSPDTFLEMDLKQKSQDSLPQKNIIRLSAEPRYLVVYNPLEQDRISLVSVYVSSPTVQVFSASGKPVEVQVSAVWDTANTISETAYEISFRAHIPPLGLKVYKILESASSNSHLADYVLYKNKVEDSGIFTIKNMINTEEGITLENSFVLLRFDQTGLMKQMMTKEDGKHHEVNVQFSWYGTTIKRDKSGAYLFLPDGNAKPYVYTTPPFVRVTHGRIYSEVTCFFDHVTHRVRLYHIQGIEGQSVEVSNIVDIRKVYNREIAMKISSDIKSQNRFYTDLNGYQIQPRMTLSKLPLQANVYPMTTMAYIQDAKHRLTLLSAQSLGVSSLNSGQIEVIMDRRLMQDDNRGLEQGIQDNKITANLFRILLEKRSAVNTEEEKKSVSYPSLLSHITSSLMNHPVIPMANKFSSPTLELQGEFSPLQSSLPCDIHLVNLRTIQSKVGNGHSNEAALILHRKGFDCRFSSKGTGLFCSTTQGKILVQKLLNKFIVESLTPSSLSLMHSPPGTQNISEINLSPMEISTFRIQLR

SEQ ID NO: 2529 - protein, 1150 aa, unidentified
MKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFALGGRGQKPELQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 2530 - protein, 85 aa, unidentified
MASDLDFSPPEVPEPTFLENLLRYGLFLGAIFQLICVLAIIVPIPKSHEAEAEPSEPRSAEVTRKPKAAVPSVNKRPKKETKKKR

SEQ ID NO: 2531 - protein, 462 aa, unidentified
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGVLALSWYPPDVNDENGEPTDNLVPTILDKAHKYNLKVTFHIEPYSNRDDQNMYKNVKYIIDKYGNHPAFYRYKTKTGNALPMFYVYDSYITKPEKWANLLTTSGSRSIRNSPYDGLFIALLVEEKHKYDILQSGFDGIYTYFATNGFTYGSSHQNWASLKLFCDKYNLIFIPSVGPGYIDTSIRPWNTQNTRNRINGKYYEIGLSAALQTRPSLISITSFNEWHEGTQIEKAVPKRTSNTVYLDYRPHKPGLYLELTRKWSEKYSKERATYALDRQLPVS

SEQ ID NO: 2532 - protein, 431 aa, unidentified
MFFGGEGSLTYTLVIICFLTLRLSASQNCLKKSLEDVVIDIQSSLSKGIRGNEPVYTSTQEDCINSCCSTKNISGDKACNLMIFDTRKTARQPNCYLFFCPNEEACPLKPAKGLMSYRIITDFPSLTRNLPSQELPQEDSLLHGQFSQAVTPLAHHHTDYSKPTDISWRDTLSQKFGSSDHLEKLFKMDEASAQLLAYKEKGHSQSSQFSSDQEIAHLLPENVSALPATVAVASPHTTSATPKPATLLPTNASVTPSGTSQPQLATTAPPVTTVTSQPPTTLISTVFTRAAATLQAMATTAVLTTTFQAPTDSKGSLETIPFTEISNLTLNTGNVYNPTALSMSNVESSTMNKTASWEGREASPGSSSQGSVPENQYGLPFEKWLLIGSLLFGVLFLVIGLVLLGRILSESLRRKRYSRLDYLINGIYVDI

SEQ ID NO: 2533 - protein, 340 aa, unidentified
MHVAEVAVNVILLLSMGWTSDSLCSPTIFYRDCWIRRFPGLLINLEESQKLGAQFLKYYSESTGQKCSRSCCLRKDVSCNLAVFYHSPIHDNINCLHVHCPTLESCILEPGTSAILYNITDGIDPDLLVFEQSPTYLNTRSSSNRWDRLRILKAMNLDKQTTTINGMLPSTEAPSSTTHQDLVVNTNSTSYSKELTTDFWARFTSLNESITTKINKVSPSTDFISNPDNKTISPFFEPIDTKLSHMPVPPGLNSSKQLLNKTKGYNSRNHTSANEDEVSVTSKTWLVSVALCTSVIFLGCCIVILASGCCGKQQGQYKPGQRKSGSLQIKNRNHMKENSS

SEQ ID NO: 2534 - protein, 527 aa, unidentified
MENQEKASIAGHMFDVVVIGGGISGLSAAKLLTEYGVSVLVLEARDRVGGRTYTIRNEHVDYVDVGGAYVGPTQNRILRLSKELGIETYKVNVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 2535 - protein, 520 aa, unidentified
MSNKCDVVVVGGGISGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRV

SEQ ID NO: 2536 - protein, 1512 aa, unidentified
MAAAAGNRASSSGFPGARATSPEAGGGGGALKASSAPAAAAGLLREAGSGGRERADWRRRQLRKVRSVELDQLPEQPLFLAASPPASSTSPSPEPADAAGSGTGFQPVAVPPPHGAASRGGAHLTESVAAPDSGASSPAAAEPGEKRAPAAEPSPAAAPAGREMENKETLKGLHKMDDRPEERMIREKLKATCMPAWKHEWLERRNRRGPVVVKPIPVKGDGSEMNHLAAESPGEVQASAASPASKGRRSPSPGNSPSGRTVKSESPGVRRKRVSPVPFQSGRITPPRRAPSPDGFSPYSPEETNRRVNKVMRARLYLLQQIGPNSFLIGGDSPDNKYRVFIGPQNCSCARGTFCIHLLFVMLRVFQLEPSDPMLWRKTLKNFEVESLFQKYHSRRSSRIKAPSRNTIQKFVSRMSNSHTLSSSSTSTSSSENSIKDEEEQMCPICLLGMLDEESLTVCEDGCRNKLHHHCMSIWAEECRRNREPLICPLCRSKWRSHDFYSHELSSPVDSPSSLRAAQQQTVQQQPLAGSRRNQESNFNLTHYGTQQIPPAYKDLAEPWIQVFGMELVGCLFSRNWNVREMALRRLSHDVSGALLLANGESTGNSGGSSGSSPSGGATSGSSQTSISGDVVEACCSVLSMVCADPVYKVYVAALKTLRAMLVYTPCHSLAERIKLQRLLQPVVDTILVKCADANSRTSQLSISTLLELCKGQAGELAVGREILKAGSIGIGGVDYVLNCILGNQTESNNWQELLGRLCLIDRLLLEFPAEFYPHIVSTDVSQAEPVEIRYKKLLSLLTFALQSIDNSHSMVGKLSRRIYLSSARMVTTVPHVFSKLLEMLSVSSSTHFTRMRRRLMAIADEVEIAEAIQLGVEDTLDGQQDSFLQASVPNNYLETTENSSPECTVHLEKTGKGLCATKLSASSEDISERLASISVGPSSSTTTTTTTTEQPKPMVQTKGRPHSQCLNSSPLSHHSQLMFPALSTPSSSTPSVPAGTATDVSKHRLQGFIPCRIPSASPQTQRKFSLQFHRNCPENKDSDKLSPVFTQSRPLPSSNIHRPKPSRPTPGNTSKQGDPSKNSMTLDLNSSSKCDDSFGCSSNSSNAVIPSDETVFTPVEEKCRLDVNTELNSSIEDLLEASMPSSDTTVTFKSEVAVLSPEKAENDDTYKDDVNHNQKCKEKMEAEEEEALAIAMAMSASQDALPIVPQLQVENGEDIIIIQQDTPETLPGHTKAKQPYREDTEWLKGQQIGLGAFSSCYQAQDVGTGTLMAVKQVTYVRNTSSEQEEVVEALREEIRMMSHLNHPNIIRMLGATCEKSNYNLFIEWMAGGSVAHLLSKYGAFKESVVINYTEQLLRGLSYLHENQIIHRDVKGANLLIDSTGQRLRIADFGAAARLASKGTGAGEFQGQLLGTIAFMAPEVLRGQQYGRSCDVWSVGCAIIEMACAKPPWNAEKHSNHLALIFKIASATTAPSIPSHLSPGLRDVALRCLELQPQDRPPSRELLKHPVFRTTW

SEQ ID NO: 2537 - protein, 400 aa, unidentified
MLSNSQGQSPPVPFPAPAPPPQPPTPALPHPPAQPPPPPPQQFPQFHVKSGLQIKKNAIIDDYKVTSQVLGLGINGKVLQIFNKRTQEKFALKMLQDCPKARREVELHWRASQCPHIVRIVDVYENLYAGRKCLLIVMECLDGGELFSRIQDRGDQAFTEREASEIMKSIGEAIQYLHSINIAHRDVKPENLLYTSKRPNAILKLTDFGFAKETTSHNSLTTPCYTPYYVAPEVLGPEKYDKSCDMWSLGVIMYILLCGYPPFYSNHGLAISPGMKTRIRMGQYEFPNPEWSEVSEEVKMLIRNLLKTEPTQRMTITEFMNHPWIMQSTKVPQTPLHTSRVLKEDKERWEDVKEEMTSALATMRVDYEQIKIKKIEDASNPLLLKRRKKARALEAAALAH

SEQ ID NO: 2538 - protein, 382 aa, unidentified
MDGETAEEQGGPVPPPVAPGGPGLGGAPGGRREPKKYAVTDDYQLSKQVLGLGVNGKVLECFHRRTGQKCALKLLYDSPKARQEVDHHWQASGGPHIVCILDVYENMHHGKRCLLIIMECMEGGELFSRIQERGDQAFTEREAAEIMRDIGTAIQFLHSHNIAHRDVKPENLLYTSKEKDAVLKLTDFGFAKETTQNALQTPCYTPYYVAPEVLGPEKYDKSCDMWSLGVIMYILLCGFPPFYSNTGQAISPGMKRRIRLGQYGFPNPEWSEVSEDAKQLIRLLLKTDPTERLTITQFMNHPWINQSMVVPQTPLHTARVLQEDKDHWDEVKEEMTSALATMRVDYDQVKIKDLKTSNNRLLNKRRKKQAGSSSASQGCNNQ

SEQ ID NO: 2539 - protein, 473 aa, unidentified
MSEESDMDKAIKETSILEEYSINWTQKLGAGISGPVRVCVKKSTQERFALKILLDRPKARNEVRLHMMCATHPNIVQIIEVFANSVQFPHESSPRARLLIVMEMMEGGELFHRISQHRHFTEKQASQVTKQIALALRHCHLLNIAHRDLKPENLLFKDNSLDAPVKLCDFGFAKIDQGDLMTPQFTPYYVAPQVLEAQRRHQKEKSGIIPTSPTPYTYNKSCDLWSLGVIIYVMLCGYPPFYSKHHSRTIPKDMRRKIMTGSFEFPEEEWSQISEMAKDVVRKLLKVKPEERLTIEGVLDHPWLNSTEALDNVLPSAQLMMDKAVVAGIQQAHAEQLANMRIQDLKVSLKPLHSVNNPILRKRKLLGTKPKDSVYIHDHENGAEDSNVALEKLRDVIAQCILPQAGKGENEDEKLNEVMQEAWKYNRECKLLRDTLQSFSWNGRGFTDKVDRLKLAEIVKQVIEEQTTSHESQ

SEQ ID NO: 2540 - protein, 335 aa, unidentified
MGASSSSALARLGLPARPWPRWLGVAALGLAAVALGTVAWRRAWPRRRRRLQQVGTVAKLWIYPVKSCKGVPVSEAECTAMGLRSGNLRDRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPRCILTTVDPDTGVIDRKQPLDTLKSYRLCDPSERELYKLSPLFGIYYSVEKIGSLRVGDPVYRMV

SEQ ID NO: 2541 - protein, 289 aa, unidentified
MLGWCEAIARNPHRIPNNTRTPEISGDLADASQTSTLNEKSPGRSASRSSNISKASSPTTGTAPRSQSRLSVCPSTQDICRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 2542 - protein, 402 aa, unidentified
MSFEGGHGGSRCRGAESGDAEPPPQPPPPPPPTPPPGEPAPVPAAPRYLPPLPASPETPERAAGPSEPLGEVAPRCRGADELPPPPLPLQPAGQEVAAAGDSGEGPRRLPEAAAAKGGPGESEAGAGGERERRGAGDQPETRSVCSSRSSSSGGGDQRAGHQHQHHQPICKICFQGAEQGELLNPCRCDGSVRYTHQLCLLKWISERGSWTCELCCYRYHVIAIKMKQPCQWQSISITLVEKVQMIAVILGSLFLIASVTWLLWSAFSPYAVWQRKDILFQICYGMYGFMDLVCIGLIVHEGAAVYRVFKRWRAVNLHWDVLNYDKATDIEESSRGESSTSRTLWLPLTALRNRNLVHPTQLTSPRFQCGYVLLHLFNRMRPHEDLSEDNSSGEVVMRVTSV

SEQ ID NO: 2543 - protein, 246 aa, unidentified
MTTGDCCHLPGSLCDCSGSPAFSKVVEATGLGPPQYVAQVTSRDGRLLSTVIRALDTPSDGPFCRICHEGANGECLLSPCGCTGTLGAVHKSCLEKWLSSSNTSYCELCHTEFAVEKRPRPLTEWLKDPGPRTEKRTLCCDMVCFLFITPLAAISGWLCLRGAQDHLRLHSQLEAVGLIALTIALFTIYVLWTLVSFRYHCQLYSEWRKTNQKVRLKIREADSPEGPQHSPLAAGLLKKVAEETPV

SEQ ID NO: 2544 - protein, 253 aa, unidentified
MTTSRCSHLPEVLPDCTSSAAPVVKTVEDCGSLVNGQPQYVMQVSAKDGQLLSTVVRTLATQSPFNDRPMCRICHEGSSQEDLLSPCECTGTLGTIHRSCLEHWLSSSNTSYCELCHFRFAVERKPRPLVEWLRNPGPQHEKRTLFGDMVCFLFITPLATISGWLCLRGAVDHLHFSSRLEAVGLIALTVALFTIYLFWTLVSFRYHCRLYNEWRRTNQRVILLIPKSVNVPSNQPSLLGLHSVKRNSKETVV

SEQ ID NO: 2545 - protein, 410 aa, unidentified
MLMPLCGLLWWWWCCCSGWYCYGLCAPAPQMLRHQGLLKCRCRMLFNDLKVFLLRRPPQAPLPMHGDPQPPGLAANNTLPALGAGGWAGWRGPREVVGREPPPVPPPPPLPPSSVEDDWGGPATEPPASLLSSASSDDFCKEKTEDRYSLGSSLDSGMRTPLCRICFQGPEQGELLSPCRCDGSVKCTHQPCLIKWISERGCWSCELCYYKYHVIAISTKNPLQWQAISLTVIEKVQVAAAILGSLFLIASISWLIWSTFSPSARWQRQDLLFQICYGMYGFMDVVCIGLIIHEGPSVYRIFKRWQAVNQQWKVLNYDKTKDLEDQKAGGRTNPRTSSSTQANIPSSEEETAGTPAPEQGPAQAAGHPSGPLSHHHCAYTILHILSHLRPHEQRSPPGSSRELVMRVTTV

SEQ ID NO: 2546 - protein, 278 aa, unidentified
MPDQALQQMLDRSCWVCFATDEDDRTAEWVRPCRCRGSTKWVHQACLQRWVDEKQRGNSTARVACPQCNAEYLIVFPKLGPVVYVLDLADRLISKACPFAAAGIMVGSIYWTAVTYGAVTVMQVVGHKEGLDVMERADPLFLLIGLPTIPVMLILGKMIRWEDYVLRLWRKYSNKLQILNSIFPGIGCPVPRIPAEANPLADHVSATRILCGALVFPTIATIVGKLMFSSVNSNLQRTILGGIAFVAIKGAFKVYFKQQQYLRQAHRKILNYPEQEEA

SEQ ID NO: 2547 - protein, 910 aa, unidentified
MDTAEEDICRVCRSEGTPEKPLYHPCVCTGSIKFIHQECLVQWLKHSRKEYCELCKHRFAFTPIYSPDMPSRLPIQDIFAGLVTSIGTAIRYWFHYTLVAFAWLGVVPLTACRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPANPPAENAVVGENPDAQDDQAEEEEEDNEEEDDAGVEDAADANNGAQDDMNWNALEWDRAAEELTWERMLGLDGSLVFLEHVFWVVSLNTLFILVFAFCPYHIGHFSLVGLGFEEHVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 2548 - protein, 291 aa, unidentified
MSMPLHQISAIPSQDAISARVYRSKTKEKEREEQNEKTLGHFMSHSSNISKAGSPPSASAPAPVSSFSRTSITPSSQDICRICHCEGDDESPLITPCHCTGSLHFVHQACLQQWIKSSDTRCCELCKYEFIMETKLKPLRKWEKLQMTSSERRKIMCSVTFHVIAITCVVWSLYVLIDRTAEEIKQGQATGILEWPFWTKLVVVAIGFTGGLLFMYVQCKVYVQLWKRLKAYNRVIYVQNCPETSKKNIFEKSPLTEPNFENKHGYGICHSDTNSSCCTEPEDTGAEIIHV

SEQ ID NO: 2549 - protein, 346 aa, unidentified
MLKSRLRMFLNELKLLVLTGGGRPRAEPQPRGGRGGGCGWAPFAGCSTRDGDGDEEEYYGSEPRARGLAGDKEPRAGPLPPPAPPLPPPGALDALSLSSSLDSGLRTPQCRICFQGPEQGELLSPCRCDGSVRCTHQPCLIRWISERGSWSCELCYFKYQVLAISTKNPLQWQAISLTVIEKVQIAAIVLGSLFLVASISWLIWSSLSPSAKWQRQDLLFQICYGMYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 2550 - protein, 520 aa, unidentified
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPAGVKGEQGSPGLAGPKGAPGQAGQKGDQGVKGSSGEQGVKGEKGERGENSVSVRIVGSSNRGRAEVYYSGTWGTICDDEWQNSDAIVFCRMLGYSKGRALYKVGAGTGQIWLDNVQCRGTESTLWSCTKNSWGHHDCSHEEDAGVECSV

SEQ ID NO: 2551 - protein, 753 aa, unidentified
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVSSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 2552 - protein, 752 aa, unidentified
MSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVADEPERIGGPEVTSCHLPWDQTETAPRLLRFPWSVKLTSSRPPEALMAALRQATAAARCRCRQPQPFLLACLHGGAGGPEPLSHFEVEVCQLPRPGLRGVLFRRVAGTALAFRTLVTRISNDLEL

SEQ ID NO: 2553 - protein, 900 aa, unidentified
MRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 2554 - protein, 173 aa, unidentified
MLPPPPRQPPPQARAARGAVRLQRPFLRSPLGVLRLLQLLAGAAFWITIATSKYQGPVHFALFVSVLFWLLTLGLYFLTLLGKHELVPVLGSRWLMVNVAHDVLAAALYGAATGIMSDQMQRHSYCNLKDYPLPCAYHAFLAAAVCGGVCHGLYLLSALYGCGRRCQGKQEVA

SEQ ID NO: 2555 - protein, 558 aa, unidentified
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 2556 - protein, 401 aa, unidentified
MEDPSGAREPRARPRERDPGRRPHPDQGRTHDRPRDRPGDPRRKRSSDGNRRRDGDRDPERDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRACCQMLEVLLNLLILACSSVSYSSTGGYTGITSLGGIYYYQFGGAYSGFDGADGEKAQQLDVQFYQLKLPMVTVAMACSGALTALCCLFVAMGVLRVPWHCPLLLVTEGLLDMLIAGGYIPALYFYFHYLSAAYGSPVCKERQALYQSKGYSGFGCSFHGADIGAGIFAALGIVVFALGAVLAIKGYRKVRKLKEKPAEMFEF

SEQ ID NO: 2557 - protein, 325 aa, unidentified
MDGSNVTSFVVEEPTNISTGRNASVGNAHRQIPIVHWVIMSISPVGFVENGILLWFLCFRMRRNPFTVYITHLSIADISLLFCIFILSIDYALDYELSSGHYYTIVTLSVTFLFGYNTGLYLLTAISVERCLSVLYPIWYRCHRPKYQSALVCALLWALSCLVTTMEYVMCIDREEESHSRNDCRAVIIFIAILSFLVFTPLMLVSSTILVVKIRKNTWASHSSKLYIVIMVTIIIFLIFAMPMRLLYLLYYEYWSTFGNLHHISLLFSTINSSANPFIYFFVGSSKKKRFKESLKVVLTRAFKDEMQPRRQKDNCNTVTVETVV

SEQ ID NO: 2558 - protein, 378 aa, unidentified
MVWGKICWFSQRAGWTVFAESQISLSCSLCLHSGDQEAQNPNLVSQLCGVFLQNETNETIHMQMSMAVGQQALPLNIIAPKAVLVSLCGVLLNGTVFWLLCCGATNPYMVYILHLVAADVIYLCCSAVGFLQVTLLTYHGVVFFIPDFLAILSPFSFEVCLCLLVAISTERCVCVLFPIWYRCHRPKYTSNVVCTLIWGLPFCINIVKSLFLTYWKHVKACVIFLKLSGLFHAILSLVMCVSSLTLLIRFLCCSQQQKATRVYAVVQISAPMFLLWALPLSVAPLITDFKMFVTTSYLISLFLIINSSANPIIYFFVGSLRKKRLKESLRVILQRALADKPEVGRNKKAAGIDPMEQPHSTQHVENLLPREHRVDVET

SEQ ID NO: 2559 - protein, 1570 aa, unidentified
MSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSSMEQLSQHEPKTPVAAAGSSKREPSTKGPEEKVAGKREGLGGLTLREKTWRGGSPEIKRFSASEASFLEGEASPPLGARRRFSALLEPSRFSAPQEDEDEARLRRPPRPSSDPAGSLDARAPKEETQGEGTSSAGDSEATDRPRPGDLCPPSKDGDASGPRATNDLVLRRARHQQMSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGASSQSSSPASSTPNSPASSASHHIRPSTLHGLSPKLHRQYRSARCKSAGNIPLSPLAHTPSPTQASPPPLPGHTVGSSHTTQSFPAKLHSSPPVVRPRPKSAEPPRSPLLKRVQSAEKLGASLSADKKGALRKHSLEVGHPDFRKDFHGELALHSLAESDGETPPVEGLGAPRQVAVRRLGRQESPLSLGADPLLPEGASRPPVSSKEKESPGGAEACTPPRATTPGGRTLERDVGCTRHQSVQTEDGTGGMARAVAKAALSPVQEHETGRRSSSGEAGTPLVPIVVEPARPGAKAVVPQPLGADSKGLQEPAPLAPSVPEAPRGRERWVLEVVEERTTLSGPRSKPASPKLSPEPQTPSLAPAKCSAPSSAVTPVPPASLLGSGTKPQVGLTSRCPAEAVPPAGLTKKGVSSPAPPGP

SEQ ID NO: 2560 - protein, 1798 aa, unidentified
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQDNLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 2561 - protein, 540 aa, unidentified
MPFAEDKTYKYICRNFSNFCNVDVVEILPYLPCLTARDQDRLRATCTLSGNRDTLWHLFNTLQRRPGWVEYFIAALRGCELVDLADEVASVYQSYQPRTSDRPPDPLEPPSLPAERPGPPTPAAAHSIPYNSCREKEPSYPMPVQETQAPESPGENSEQALQTLSPRAIPRNPDGGPLESSSDLAALSPLTSSGHQEQDTELGSTHTAGATSSLTPSRGPVSPSVSFQPLARSTPRASRLPGPTGSVVSTGTSFSSSSPGLASAGAAEGKQGAESDQAEPIICSSGAEAPANSLPSKVPTTLMPVNTVALKVPANPASVSTVPSKLPTSSKPPGAVPSNALTNPAPSKLPINSTRAGMVPSKVPTSMVLTKVSASTVPTDGSSRNEETPAAPTPAGATGGSSAWLDSSSENRGLGSELSKPGVLASQVDSPFSGCFEDLAISASTSLGMGPCHGPEENEYKSEGTFGIHVAENPSIQLLEGNPGPPADPDGGPRPQADRKFQEREVPCHRPSPGALWLQVAVTGVLVVTLLVVLYRRRLH

SEQ ID NO: 2562 - protein, 495 aa, unidentified
MAAEPQPSSLSYRTTGSTYLHPLSELLGIPLDQVNFVVCQLVALFAAFWFRIYLRPGTTSSDVRHAVATIFGIYFVIFCFGWYSVHLFVLVLMCYAIMVTASVSNIHRYSFFVAMGYLTICHISRIYIFHYGILTTDFSGPLMIVTQKITTLAFQVHDGLGRRAEDLSAEQHRLAIKVKPSFLEYLSYLLNFMSVIAGPCNNFKDYIAFIEGKHIHMKLLEVNWKRKGFHSLPEPSPTGAVIHKLGITLVSLLLFLTLTKTFPVTCLVDDWFVHKASFPARLCYLYVVMQASKPKYYFAWTLADAVNNAAGFGFSGVDKNGNFCWDLLSNLNIWKIETATSFKMYLENWNIQTATWLKCVCYQRVPWYPTVLTFILSALWHGVYPGYYFTFLTGILVTLAARAVRNNYRHYFLSSRALKAVYDAGTWAVTQLAVSYTVAPFVMLAVEPTISLYKSMYFYLHIISLLIILFLPMKPQAHTQRRPQTLNSINKRKTD

SEQ ID NO: 2563 - protein, 520 aa, unidentified
MATTSTTGSTLLQPLSNAVQLPIDQVNFVVCQLFALLAAIWFRTYLHSSKTSSFIRHVVATLLGLYLALFCFGWYALHFLVQSGISYCIMIIIGVENMHNYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRVCYERTSFSPTIQTFILSAIWHGVYPGYYLTFLTGVLMTLAARAMRNNFRHYFIEPSQLKLFYDVITWIVTQVAISYTVVPFVLLSIKPSLTFYSSWYYCLHILGILVLLLLPVKKTQRRKNTHENIQLSQSKKFDEGENSLGQNSFSTTNNVCNQNQEIASRHSSLKQ

SEQ ID NO: 2564 - protein, 435 aa, unidentified
MEWLWLFFLHPISFYQGAAFPFALLFNYLCIMDSFSTRARYLFLLTGGGALAVAAMGSYAVLVFTPAVCAVALLCSLAPQQVHRWTFCFQMSWQTLCHLGLHYTEYYLHEPPSVRFCITLSSLMLLTQRVTSLSLDICEGKVKAASGGFRSRSSLSEHVCKALPYFSYLLFFPALLGGSLCSFQRFQARVQGSSALHPRHSFWALSWRGLQILGLECLNVAVSRVVDAGAGLTDCQQFECIYVVWTTAGLFKLTYYSHWILDDSLLHAAGFGPELGQSPGEEGYVPDADIWTLERTHRISVFSRKWNQSTARWLRRLVFQHSRAWPLLQTFAFSAWWHGLHPGQVFGFVCWAVMVEADYLIHSFANEFIRSWPMRLFYRTLTWAHTQLIIAYIMLAVEVRSLSSLWLLCNSYNSVFPMVYCILLLLLAKRKHKCN

SEQ ID NO: 2565 - protein, 472 aa, unidentified
MSPEEWTYLVVLLISIPIGFLFKKAGPGLKRWGAAAVGLGLTLFTCGPHTLHSLVTILGTWALIQAQPCSCHALALAWTFSYLLFFRALSLLGLPTPTPFTNAVQLLLTLKLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 2566 - protein, 1052 aa, unidentified
MKLVNIWLLLLVVLLCGKKHLGDRLEKKSFEKAPCPGCSHLTLKVEFSSTVVEYEYIVAFNGYFTAKARNSFISSALKSSEVDNWRIIPRNNPSSDYPSDFEVIQIKEKQKAGLLTLEDHPNIKRVTPQRKVFRSLKYAESDPTVPCNETRWSQKWQSSRPLRRASLSLGSGFWHATGRHSSRRLLRAIPRQVAQTLQADVLWQMGYTGANVRVAVFDTGLSEKHPHFKNVKERTNWTNERTLDDGLGHGTFVAGVIASMRECQGFAPDAELHIFRVFTNNQVSYTSWFLDAFNYAILKKIDVLNLSIGGPDFMDHPFVDKVWELTANNVIMVSAIGNDGPLYGTLNNPADQMDVIGVGGIDFEDNIARFSSRGMTTWELPGGYGRMKPDIVTYGAGVRGSGVKGGCRALSGTSVASPVVAGAVTLLVSTVQKRELVNPASMKQALIASARRLPGVNMFEQGHGKLDLLRAYQILNSYKPQASLSPSYIDLTECPYMWPYCSQPIYYGGMPTVVNVTILNGMGVTGRIVDKPDWQPYLPQNGDNIEVAFSYSSVLWPWSGYLAISISVTKKAASWEGIAQGHVMITVASPAETESKNGAEQTSTVKLPIKVKIIPTPPRSKRVLWDQYHNLRYPPGYFPRDNLRMKNDPLDWNGDHIHTNFRDMYQHLRSMGYFVEVLGAPFTCFDASQYGTLLMVDSEEEYFPEEIAKLRRDVDNGLSLVIFSDWYNTSVMRKVKFYDENTRQWWMPDTGGANIPALNELLSVWNMGFSDGLYEGEFTLANHDMYYASGCSIAKFPEDGVVITQTFKDQGLEVLKQETAVVENVPILGLYQIPAEGGGRIVLYGDSNCLDDSHRQKDCFWLLDALLQYTSYGVTPPSLSHSGNRQRPPSGAGSVTPERMEGNHLHRYSKVLEAHLGDPKPRPLPACPRLSWAKPQPLNETAPSNLWKHQKLLSIDLDKVVLPNFRSNRPQVRPLSPGESGAWDIPGGIMPGRYNQEVGQTIPVFAFLGAMVVLAFFVVQINKAKSRPKRRKPRVKRPQLMQQVHPPKTPSV

SEQ ID NO: 2567 - protein, 519 aa, unidentified
MIPVSLVVVVVGGWTVVYLTDLVLKSSVYFKHSYEDWLENNGLSISPFHIRWQTAVFNRAFYSWGRRKARMLYQWFNFGMVFGVIAMFSSFFLLGKTLMQTLAQMMADSPSSYSSSSSSSSSSSSSSSSSSSSSSSLHNEQVLQVVVPGINLPVNQLTYFFTAVLISGVVHEIGHGIAAIREQVRFNGFGIFLFIIYPGAFVDLFTTHLQLISPVQQLRIFCAGIWHNFVLALLGILALVLLPVILLPFYYTGVGVLITEVAEDSPAIGPRGLFVGDLVTHLQDCPVTNVQDWNECLDTIAYEPQIGYCISASTLQQLSFPVRAYKRLDGSTECCNNHSLTDVCFSYRNNFNKRLHTCLPARKAVEATQVCRTNKDCKKSSSSSFCIIPSLETHTRLIKVKHPPQIDMLYVGHPLHLHYTVSITSFIPRFNFLSIDLPVVVETFVKYLISLSGALAIVNAVPCFALDGQWILNSFLDATLTSVIGDNDVKDLIGFFILLGGSVLLAANVTLGLWMVTAR

SEQ ID NO: 2568 - protein, 317 aa, unidentified
MAVQGSQRRLLGSLNSTPTAIPQLGLAANQTGARCLEVSISDGLFLSLGLVSLVENALVVATIAKNRNLHSPMYCFICCLALSDLLVSGSNVLETAVILLLEAGALVARAAVLQQLDNVIDVITCSSMLSSLCFLGAIAVDRYISIFYALRYHSIVTLPRARRAVAAIWVASVVFSTLFIAYYDHVAVLLCLVVFFLAMLVLMAVLYVHMLARACQHAQGIARLHKRQRPVHQGFGLKGAVTLTILLGIFFLCWGPFFLHLTLIVLCPEHPTCGCIFKNFNLFLALIICNAIIDPLIYAFHSQELRRTLKEVLTCSW

SEQ ID NO: 2569 - protein, 297 aa, unidentified
MKHIINSYENINNTARNNSDCPRVVLPEEIFFTISIVGVLENLIVLLAVFKNKNLQAPMYFFICSLAISDMLGSLYKILENILIILRNMGYLKPRGSFETTADDIIDSLFVLSLLGSIFSLSVIAADRYITIFHALRYHSIVTMRRTVVVLTVIWTFCTGTGITMVIFSHHVPTVITFTSLFPLMLVFILCLYVHMFLLARSHTRKISTLPRANMKGAITLTILLGVFIFCWAPFVLHVLLMTFCPSNPYCACYMSLFQVNGMLIMCNAVIDPFIYAFRSPELRDAFKKMIFCSRYW

SEQ ID NO: 2570 - protein, 323 aa, unidentified
MNASCCLPSVQPTLPNGSEHLQAPFFSNQSSSAFCEQVFIKPEVFLSLGIVSLLENILVILAVVRNGNLHSPMYFFLCSLAVADMLVSVSNALETIMIAIVHSDYLTFEDQFIQHMDNIFDSMICISLVASICNLLAIAVDRYVTIFYALRYHSIMTVRKALTLIVAIWVCCGVCGVVFIVYSESKMVIVCLITMFFAMMLLMGTLYVHMFLFARLHVKRIAALPPADGVAPQQHSCMKGAVTITILLGVFIFCWAPFFLHLVLIITCPTNPYCICYTAHFNTYLVLIMCNSVIDPLIYAFRSLELRNTFREILCGCNGMNLG

SEQ ID NO: 2571 - protein, 332 aa, unidentified [sequence omitted]

SEQ ID NO: 2572 - protein, 325 aa, unidentified
MNSSFHLHFLDLNLNATEGNLSGPNVKNKSSPCEDMGIAVEVFLTLGVISLLENILVIGAIVKNKNLHSPMYFFVCSLAVADMLVSMSSAWETITIYLLNNKHLVIADAFVRHIDNVFDSMICISVVASMCSLLAIAVDRYVTIFYALRYHHIMTARRSGAIIAGIWAFCTGCGIVFILYSESTYVILCLISMFFAMLFLLVSLYIHMFLLARTHVKRIAALPGASSARQRTSMQGAVTVTMLLGVFTVCWAPFFLHLTLMLSCPQNLYCSRFMSHFNMYLILIMCNSVMDPLIYAFRSQEMRKTFKEIICCRGFRIACSFPRRD

SEQ ID NO: 2573 - protein, 646 aa, unidentified
MGLPRLVCAFLLAACCCCPRVAGVPGEAEQPAPELVEVEVGSTALLKCGLSQSQGNLSHVDWFSVHKEKRTLIFRVRQGQGQSEPGEYEQRLSLQDRGATLALTQVTPQDERIFLCQGKRPRSQEYRIQLRVYKAPEEPNIQVNPLGIPVNSKEPEEVATCVGRNGYPIPQVIWYKNGRPLKEEKNRVHIQSSQTVESSGLYTLQSILKAQLVKEDKDAQFYCELNYRLPSGNHMKESREVTVPVFYPTEKVWLEVEPVGMLKEGDRVEIRCLADGNPPPHFSISKQNPSTREAEEETTNDNGVLVLEPARKEHSGRYECQGLDLDTMISLLSEPQELLVNYVSDVRVSPAAPERQEGSSLTLTCEAESSQDLEFQWLREETGQVLERGPVLQLHDLKREAGGGYRCVASVPSIPGLNRTQLVNVAIFGPPWMAFKERKVWVKENMVLNLSCEASGHPRPTISWNVNGTASEQDQDPQRVLSTLNVLVTPELLETGVECTASNDLGKNTSILFLELVNLTTLTPDSNTTTGLSTSTASPHTRANSTSTERKLPEPESRGVVIVAVIVCILVLAVLGAVLYFLYKKGKLPCRRSGKQEITLPPSRKSELVVEVKSDKLPEEMGLLQGSSGDKRAPGDQGEKYIDLRH

SEQ ID NO: 2574 - protein, 187 aa, unidentified
MEVEEIYKHQEVKMQAPAFRDKKQGVSAKNQGAHDPDYENITLAFKNQDHAKGGHSRPTSQVPAQCRPPSDSTQVPCWLYRAILSLYILLALAFVLCIILSAFIMVKNAEMSKELLGFKRELWNVSNSVQACEERQKRGWDSVQQSITMVRSKIDRLETTLAGIKNIDTKVQKILEVLQKMPQSSPQ

SEQ ID NO: 2575 - protein, 422 aa, unidentified
MSVGAMKKGVGRAVGLGGGSGCQATEEDPLPNCGACAPGQGGRRWRLPQPAWVEGSSARLWEQATGTGWMDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 2576 - protein, 340 aa, unidentified
MNPFHASCWNTSAELLNKSWNKEFAYQTASVVDTVILPSMIGIICSTGLVGNILIVFTIIRSRKKTVPDIYICNLAVADLVHIVGMPFLIHQWARGGEWVFGGPLCTIITSLDTCNQFACSAIMTVMSVDRYFALVQPFRLTRWRTRYKTIRINLGLWAASFILALPVWVYSKVIKFKDGVESCAFDLTSPDDVLWYTLYLTITTFFFPLPLILVCYILILCYTWEMYQQNKDARCCNPSVPKQRVMKLTKMVLVLVVVFILSAAPYHVIQLVNLQMEQPTLAFYVGYYLSICLSYASSSINPFLYILLSGNFQKRLPQIQRRATEKEINNMGNTLKSHF

SEQ ID NO: 2577 - protein, 350 aa, unidentified
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 2578 - protein, 580 aa, unidentified
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPPPSDDLTLLESSSSYKNLTLKFHKLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 2579 - protein, 566 aa, unidentified
MARQPYRFPQARIPERGSGVFRLTVRNAMAHRDSEMKEECLREDLKFYFMSPCEKYRARRQIPWKLGLQILKIVMVTTQLVRFGLSNQLVVAFKEDNTVAFKHLFLKGYSGTDEDDYSCSVYTQEDAYESIFFAINQYHQLKDITLGTLGYGENEDNRIGLKVCKQHYKKGTMFPSNETLNIDNDVELDCVQLDLQDLSKKPPDWKNSSFFRLEFYRLLQVEISFHLKGIDLQTIHSRELPDCYVFQNTIIFDNKAHSGKIKIYFDSDAKIEECKDLNIFGSTQKNAQYVLVFDAFVIVICLASLILCTRSIVLALRLRKRFLNFFLEKYKRPVCDTDQWEFINGWYVLVIISDLMTIIGSILKMEIKAKNLTNYDLCSIFLGTSTLLVWVGVIRYLGYFQAYNVLILTMQASLPKVLRFCACAGMIYLGYTFCGWIVLGPYHDKFENLNTVAECLFSLVNGDDMFATFAQIQQKSILVWLFSRLYLYSFISLFIYMILSLFIALITDSYDTIKKFQQNGFPETDLQEFLKECSSKEEYQKESSAFLSCICCRRRKRSDDHLIPIS

SEQ ID NO: 2580 - protein, 553 aa, unidentified
MADPEVVVSSCSSHEEENRCNFNQQTSPSEELLLEDQMRRKLKFFFMNPCEKFWARGRKPWKLAIQILKIAMVTIQLVLFGLSNQMVVAFKEENTIAFKHLFLKGYMDRMDDTYAVYTQSDVYDQLIFAVNQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQEFVNFFLLHYKKEVSVSDQMEFVNGWYIMIIISDILTIIGSILKMEIQAKSLTSYDVCSILLGTSTMLVWLGVIRYLGFFAKYNLLILTLQAALPNVIRFCCCAAMIYLGYCFCGWIVLGPYHDKFRSLNMVSECLFSLINGDDMFATFAKMQQKSYLVWLFSRIYLYSFISLFIYMILSLFIALITDTYETIKQYQQDGFPETELRTFISECKDLPNSGKYRLEDDPPVSLFCCCKK

SEQ ID NO: 2581 - protein, 999 aa, unidentified
MEPRAAAAGEPEPPAASSSFQARLWKNLQLGVGRSKGGGGGRAGGPERRTADTPSPSPPPPVGTGNAPARGSGAGSRWSGFKKRKQVLDRVFSSSQPNLCCSSPEPLEPGGAGRAEQGSTLRRRIREHLLPAVKGPAAASGAAGGTPPGGRSPDSAPSSSSASSSLSSSPQPPPRGDRARDEGARRQGPGAHLCHQKSSSLPGTACLEQLLEPPPPPAEPARSPAESRAPETGEEHGSSQKIINTAGTSNAEVPLADPGMYQLDITLRRGQSLAARDRGGTSDPYVKFKIGGKEVFRSKIIHKNLNPVWEEKACILVDHLREPLYIKVFDYDFGLQDDFMGSAFLDLTQLELNRPTDVTLTLKDPHYPDHDLGIILLSVILTPKEGESRDVTMLMRKSWKRSSKELSENEVVGSYFSVKSLFWRTCGRPALPVLGFCRAELQNPYCKNVQFQTQSLRLSDLHRKSHLWRGIVSITLIEGRDLKAMDSNGLSDPYVKFRLGHQKYKSKIMPKTLNPQWREQFDFHLYEERGGVIDITAWDKDAGKRDDFIGRCQVDLSALSREQTHKLELQLEEGEGHLVLLVTLTASATVSISDLSVNSLEDQKEREEILKRYSPLRIFHNLKDVGFLQVKVIRAEGLMAADVTGKSDPFCVVELNNDRLLTHTVYKNLNPEWNKVFTFNIKDIHSVLEVTVYDEDRDRSADFLGKVAIPLLSIQNGEQKAYVLKNKQLTGPTKGVIYLEIDVIFNAVKASLRTLIPKEQKYIEEENRLSKQLLLRNFIRMKRCVMVLVNAAYYVNSCFDWDSPPRSLAAFVLFLFVVWNFELYMIPLVLLLLLTWNYFLIISGKDNRQRDTVVEDMLEDEEEEDDKDDKDSEKKGFINKIYAIQEVCVSVQNILDEVASFGERIKNTFNWTVPFLSWLAIVALCVFTAILYCIPLRYIVLVWGINKFTKKLRSPYAIDNNELLDFLSRVPSDVQVVQYQELKPDPSHSPYKRKKNNLG

SEQ ID NO: 2582 - protein, 878 aa, unidentified
MDLDKPSVWGSLKQRTRPLLINLSKKKVKKNPSKPPDLRARHHLDRRLSLSVPDLLEAEALAPEGRPYSGPQSSYTSVPSSLSTAGIFPKSSSSSLKQSEEELDWSQEEASHLHVVETDSEEAYASPAERRRVSSNGIFDLQKTSLGGDAPEEPEKLCGSSDLNASMTSQHFEEQSVPGEASDGLSNLPSPFAYLLTIHLKEGRNLVVRDRCGTSDPYVKFKLNGKTLYKSKVIYKNLNPVWDEIVVLPIQSLDQKLRVKVYDRDLTTSDFMGSAFVILSDLELNRTTEHILKLEDPNSLEDDMGVIVLNLNLVVKQGDFKRHRWSNRKRLSASKSSLIRNLRLSESLKKNQLWNGIISITLLEGKNVSGGSMTEMFVQLKLGDQRYKSKTLCKSANPQWQEQFDFHYFSDRMGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRITMAIWNTMQFLKSCFQWESTLRSTIAFAVFLITVWNFELYMIPLALLLIFVYNFIRPVKGKVSSIQDSQESTDIDDEEDEDDKESEKKGLIERIYMVQDIVSTVQNVLEEIASFGERIKNTFNWTVPFLSSLACLILAAATIILYFIPLRYIILIWGINKFTKKLRNPYSIDNNELLDFLSRVPSDVQKVQYAELKLCSSHSPLRKKRSAL

SEQ ID NO: 2583 - protein, 351 aa, unidentified
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 2584 - protein, 336 aa, unidentified
MLQRGLWPWRTRLLPTPGTWRPARPWPLPPPPQVLRVKLCGNVKYYQSHHYSTVVPPDEITVIYRHGLPLVTLTLPSRKERCQFVVKPMLSTVGSFLQDLQNEDKGIKTAAIFTADGNMISASTLMDILLMNDFKLVINKIAYDVQCPKREKPSNEHTAEMEHMKSLVHRLFTILHLEESQKKREHHLLEKIDHLKEQLQPLEQVKAGIEAHSEAKTSGLLWAGLALLSIQGGALAWLTWWVYSWDIMEPVTYFITFANSMVFFAYFIVTRQDYTYSAVKSRQFLQFFHKKSKQQHFDVQQYNKLKEDLAKAKESLKQARHSLCLQMQVEELNEKN

SEQ ID NO: 2585 - protein, 359 aa, unidentified
MDCGSVGGQRTQRLPGRQRLLFLPVGLSGRPGGSETSARRCLSALSDGLGALRPRAPAARGGVSRASPLLLLLLVPSPRLAAAAPRRQLGDWERSRLGYAAPPAGRSSAWRCSPGVAAAAGALPQYHGPAPALVSCRRELSLSAGSLQLERKRRDFTSSGSRKLYFDTHALVCLLEDNGFATQQAEIIVSALVKILEANMDIVYKDMVTKMQQEITFQQVMSQIANVKKDMIILEKSEFSALRAENEKIKLELHQLKQQVMDEVIKVRTDTKLDFNLEKSRVKELYSLNEKKLLELRTEIVALHAQQDRALTQTDRKIETEVAGLKTMLESHKLDNIKYLAGSIFTCLTVALGFYRLWI

SEQ ID NO: 2586 - protein, 246 aa, unidentified
MSGAGEALAPGPVGPQRVAEAGGGQLGSTAQGKCDKDNTEKDITQATNSHFTHGEMQDQSIWGNPSDGELIRTQPQRLPQLQTSAQVPSGEEIGKIKNGHTGLSNGNGIHHGAKHGSADNRKLSAPVSQKMHRKIQSSLSVNSDISKKSKVNAVFSQKTGSSPEDCCVHCILACLFCEFLTLCNIVLGQASCGICTSEACCCCCGDEMGDDCNCPCDMDCGIMDACCESSDCLEICMECCGICFPS

SEQ ID NO: 2587 - protein, 956 aa, unidentified
MDLLYGLVWLLTVLLEGISGQGVYAPPTVRIVHSGLACNIEEERYSERVYTIREGETLELTCLVTGHPRPQIRWTKTAGSASDRFQDSSVFNETLRITNIQRHQGGRYYCKAENGLGSPAIKSIRVDVYYLDDPVVTVHQSIGEAKEQFYYERTVFLRCVANSNPPVRYSWRRGQEVLLQGSDKGVEIYEPFFTQGETKILKLKNLRPQDYANYSCIASVRNVCNIPDKMVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVLRAYPIRVLTYEWRLGNKLLRTGQFDSQEYTEYAVKSLSNENYGVYNCSIINEAGAGRCSFLVTGKAYAPEFYYDTYNPVWQNRHRVYSYSLQWTQMNPDAVDRIVAYRLGIRQAGQQRWWEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 2588 - protein, 714 aa, unidentified
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVTQERVHSLEASRVPKRTRSHSADSRAEGASDVENNEGVTNHTPVNENVELEHSTKVLSENVDNGLDRLLRKKAGLTVVPSYNALRNSEYQRQFVWKTSKETAPAFAANQVFHNKSQFVPPFKGNSVIHETEYKRNFKGLSPVKEPKLRNDLRENRNLETVSPERKSNKIDDRLKLEAEMELKDLHQPKRKLTPWKHQRLGKVNSEYRAKFLSPAQYLYKAGAWTHVKGNMPNQVKELREKAEFYRKRVQGTHFSRDHLNQILSDSNCCWDVSSTTSSEGTVSSNIRALDLAGDPTSHKTLQKCPSTEPEEKGNIVEEQPQKNTTEKLGVSAPTIPVRRRLAWDTENTSEDVQKQPGEKEEEDDNEEEGDRKTGKQAFMGEQEKLDVREKSKADKMKEGSDSSVSSEKGGRLPTPKLRELGGIQRTHHDLTTPAVGGAVLVSPSKMKPPAPEQRKRMTSQDCLETSKNDFTKKESRAVSLLTSPAAGIKTVDPLPLREDSEDNIHKFAEATLPVSKIPKYPTNPPGQLPSPPHVPSYWHPSRRIQGSLRDPEFQHNVGKARMNNLQLPQHEAFNDEDEDRLSEISARSAASSLRAFQTLARAKKRKENFWGKT

SEQ ID NO: 2589 - protein, 651 aa, unidentified
MSGVRAVRISIESACEKQVHEVGLDGTETYLPPLSMSQNLARLAQRIDFSQGSGSEEEEAAGTEGDAQEWPGAGSSADQDDEEGVVKFQPSLWPWDSVRNNLRSALTEMCVLYDVLSIVRDKKFMTLDPVSQDALPPKQNPQTLQLISKKKSLAGAAQILLKGAERLTKSVTENQENKLQRDFNSELLRLRQHWKLRKVGDKILGDLSYRSAGSLFPHHGTFEVIKNTDLDLDKKIPEDYCPLDVQIPSDLEGSAYIKVSIQKQAPDIGDLGTVNLFKRPLPKSKPGSPHWQTKLEAAQNVLLCKEIFAQLSREAVQIKSQVPHIVVKNQIISQPFPSLQLSISLCHSSNDKKSQKFATEKQCPEDHLYVLEHNLHLLIREFHKQTLSSIMMPHPASAPFGHKRMRLSGPQAFDKNEINSLQSSEGLLEKIIKQAKHIFLRSRAAATIDSLASRIEDPQIQAHWSNINDVYESSVKVLITSQGYEQICKSIQLQLNIGVEQIRVVHRDGRVITLSYQEQELQDFLLSQMSQHQVHAVQQLAKVMGWQVLSFSNHVGLGPIESIGNASAITVASPSGDYAISVRNGPESGSKIMVQFPRNQCKDLPKSDVLQDNKWSHLRGPFKEVQWNKMEGRNFVYKMELLMSALSPCLL

SEQ ID NO: 2590 - protein, 1368 aa, unidentified
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVPVSLPVTQ

SEQ ID NO: 2591 - protein, 989 aa, unidentified
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 2592 - protein, 1140 aa, unidentified
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSKNNQLFVNLKNVNPGKRGPVGDCTGTLPADWKHGGYLNELGAFGLDRSYMGKSLKDLGKNSEYNSSNCSLSSSENPYATIKDPPVLIPKSSECGYVEMKSPARRDSPYAEINNSTSANRNVYEVEPTVSVVQGVFSNNGRLSQDPYDLPKNSHIPCHYDLLPVRDSSSSPKQEDSGGSSSNSSSSSE

SEQ ID NO: 2593 - protein, 1044 aa, unidentified
MVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 2594 - protein, 2845 aa, unidentified
MALGKVLAMALVLALAVLGSLSPGARAGDCKGQRQVLREAPGFVTDGAGNYSVNGNCEWLIEAPSPQHRILLDFLFLDTECTYDYLFVYDGDSPRGPLLASLSGSTRPPPIEASSGKMLLHLFSDANYNLLGFNASFRFSLCPGGCQSHGQCQPPGVCACEPGWGGPDCGLQECSAYCGSHGTCASPLGPCRCEPGFLGRACDLHLWENQGAGWWHNVSARDPAFSARIGAAGAFLSPPGLLAVFGGQDLNNALGDLVLYNFSANTWESWDLSPAPAARHSHVAVAWAGSLVLMGGELADGSLTNDVWAFSPLGRGHWELLAPPASSSSGPPGLAGHAAALVDDVWLYVSGGRTPHDLFSSGLFRFRLDSTSGGYWEQVIPAGGRPPAATGHSMVFHAPSRALLVHGGHRPSTARFSVRVNSTELFHVDRHVWTTLKGRDGLQGPRERAFHTASVLGNYMVVYGGNVHTHYQEEKCYEDGIFFYHLGCHQWVSGAELAPPGTPEGRAAPPSGRYSHVAAVLGGSVLLVAGGYSGRPRGDLMAYKVPPFVFQAPAPDYHLDYCSMYTDHSVCSRDPECSWCQGACQAAPPPGTPLGACPAASCLGLGRLLGDCQACLAFSSPTAPPRGPGTLGWCVHNESCLPRPEQARCRGEQISGTVGWWGPAPVFVTSLEACVTQSFLPGLHLLTFQQPPNTSQPDKVSIVRSTTITLTPSAETDVSLVYRGFIYPMLPGGPGGPGAEDVAVWTRAQRLHVLARMARGPDTENMEEVGRWVAHQEKETRRLQRPGSARLFPLPGRDHKYAVEIQGQLNGSAGPGHSELTLLWDRTGVPGGSEISFFFLEPYRSSSCTSYSSCLGCLADQGCGWCLTSATCHLRQGGAHCGDDGAGGSLLVLVPTLCPLCEEHRDCHACTQDPFCEWHQSTSRKGDAACSRRGRGRGALKSPEECPPLCSQRLTCEDCLANSSQCAWCQSTHTCFLFAAYLARYPHGGCRGWDDSVHSEPRCRSCDGFLTCHECLQSHECGWCGNEDNPTLGRCLQGDFSGPLGGGNCSLWVGEGLGLPVALPARWAYARCPDVDECRLGLARCHPRATCLNTPLSYECHCQRGYQGDGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKRDRMRNVRGSSRGLGQVPGEQPGSWGFREVRKKMALWAALAGTGGFLEEISPHLKEPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQCLSPSYLPLRCMAGGCGRLLRGPESCSLGCAQATQCALCLRRPHCGWCAWGGQDGGGRCMEGGLSGPRDGLTCGRPGASWAFLSCPPEDECANGHHDCNETQNCHDQPHGYECSCKTGYTMDNMTGLCRPVCAQGCVNGSCVEPDHCRCHFGFVGRNCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKCTKCQCNGHADTCNEQDGTGCPCQNNTETGTCQGSSPSDRRDCYKYQCAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHIDLFVFFSVFFSCFFLFLSLCVLLWKAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 2595 - protein, 602 aa, unidentified
MNGGAERAMRSLPSLGGLALLCCAAAAAAAAVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPEYVCNCSVVGSLNVNRCNQTTGQCECRPGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 2596 - protein, 651 aa, unidentified
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 2597 - protein, 297 aa, unidentified
MSNRVVCREASHAGSWYTASGPQLNAQLEGWLSQVQSTKRPARAIIAPHAGYTYCGSCAAHAYKQVDPSITRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 2598 - protein, 746 aa, unidentified
MAWIRSTCILFFTLLFAHIAAVPIKYLPEENVHDADFGEQKDISEINLAAGLDLFQGDILLQKSRNGLRDPNTRWTFPIPYILADNLGLNAKGAILYAFEMFRLKSCVDFKPYEGESSYIIFQQFDGCWSEVGDQHVGQNISIGQGCAYKAIIEHEILHALGFYHEQSRTDRDDYVNIWWDQILSGYQHNFDTYDDSLITDLNTPYDYESLMHYQPFSFNKNASVPTITAKIPEFNSIIGQRLDFSAIDLERLNRMYNCTTTHTLLDHCTFEKANICGMIQGTRDDTDWAHQDSAQAGEVDHTLLGQCTGAGYFMQFSTSSGSAEEAALLESRILYPKRKQQCLQFFYKMTGSPSDRLVVWVRRDDSTGNVRKLVKVQTFQGDDDHNWKIAHVVLKEEQKFRYLFQGTKGDPQNSTGGIYLDDITLTETPCPTGVWTVRNFSQVLENTSKGDKLQSPRFYNSEGYGFGVTLYPNSRESSGYLRLAFHVCSGENDAILEWPVENRQVIITILDQEPDVRNRMSSSMVFTTSKSHTSPAINDTVIWDRPSRVGTYHTDCNCFRSIDLGWSGFISHQMLKRRSFLKNDDLIIFVDFEDITHLSQTEVPTKGKRLSPQGLILQGQEQQVSEEGSGKAMLEEALPVSLSQGQPSRQKRSVENTGPLEDHNWPQYFRDPCDPNPCQNDGICVNVKGMASCRCISGHAFFYTGERCQAVQVHGSVLGMVIGGTAGVIFLTFSIIAILSQRPRK

SEQ ID NO: 2599 - protein, 700 aa, unidentified
MDLWNLSWFLFLDALLVISGLATPENFDVDGGMDQDIFDINEGLGLDLFEGDIRLDRAQIRNSIIGEKYRWPHTIPYVLEDSLEMNAKGVILNAFERYRLKTCIDFKPWAGETNYISVFKGSGCWSSVGNRRVGKQELSIGANCDRIATVQHEFLHALGFWHEQSRSDRDDYVRIMWDRILSGREHNFNTYSDDISDSLNVPYDYTSVMHYSKTAFQNGTEPTIVTRISDFEDVIGQRMDFSDSDLLKLNQLYNCSSSLSFMDSCSFELENVCGMIQSSGDNADWQRVSQVPRGPESDHSNMGQCQGSGFFMHFDSSSVNVGATAVLESRTLYPKRGFQCLQFYLYNSGSESDQLNIYIREYSADNVDGNLTLVEEIKEIPTGSWQLYHVTLKVTKKFRVVFEGRKGSGASLGGLSIDDINLSETRCPHHIWHIRNFTQFIGSPNGTLYSPPFYSSKGYAFQIYLNLAHVTNAGIYFHLISGANDDQLQWPCPWQQATMTLLDQNPDIRQRMSNQRSITTDPFMTTDNGNYFWDRPSKVGTVALFSNGTQFRRGGGYGTSAFITHERLKSRDFIKGDDVYILLTVEDISHLNSTQIQLTPAPSVQDLCSKTTCKNDGVCTVRDGKAECRCQSGEDWWYMGERCEKRGSTRDTIVIAVSSTVAVFALMLIITLVSVYCTRKKYRERMSSNRPNLTPQNHAF

SEQ ID NO: 2600 - protein, 999 aa, unidentified
MGPAPLPLLLGLFLPALWRRAITEAREEAKPYPLFPGPFPGSLQTDHTPLLSLPHASGYQPALMFSPTQPGRPHTGNVAIPQVTSVESKPLPPLAFKHTVGHIILSEHKGVKFNCSISVPNIYQDTTISWWKDGKELLGAHHAITQFYPDDEVTAIIASFSITSVQRSDNGSYICKMKINNEEIVSDPIYIEVQGLPHFTKQPESMNVTRNTAFNLTCQAVGPPEPVNIFWVQNSSRVNEQPEKSPSVLTVPGLTEMAVFSCEAHNDKGLTVSKGVQINIKAIPSPPTEVSIRNSTAHSILISWVPGFDGYSPFRNCSIQVKEADPLSNGSVMIFNTSALPHLYQIKQLQALANYSIGVSCMNEIGWSAVSPWILASTTEGAPSVAPLNVTVFLNESSDNVDIRWMKPPTKQQDGELVGYRISHVWQSAGISKELLEEVGQNGSRARISVQVHNATCTVRIAAVTRGGVGPFSDPVKIFIPAHGWVDYAPSSTPAPGNADPVLIIFGCFCGFILIGLILYISLAIRKRVQETKFGNAFTEEDSELVVNYIAKKSFCRRAIELTLHSLGVSEELQNKLEDVVIDRNLLILGKILGEGEFGSVMEGNLKQEDGTSLKVAVKTMKLDNSSQREIEEFLSEAACMKDFSHPNVIRLLGVCIEMSSQGIPKPMVILPFMKYGDLHTYLLYSRLETGPKHIPLQTLLKFMVDIALGMEYLSNRNFLHRDLAARNCMLRDDMTVCVADFGLSKKIYSGDYYRQGRIAKMPVKWIAIESLADRVYTSKSDVWAFGVTMWEIATRGMTPYPGVQNHEMYDYLLHGHRLKQPEDCLDELYEIMYSCWRTDPLDRPTFSVLRLQLEKLLESLPDVRNQADVIYVNTQLLESSEGLAQGSTLAPLDLNIDPDSIIASCTPRAAISVVTAEVHDSKPHEGRYILNGGSEEWEDLTSAPSAAVTAEKNSVLPGERLVRNGVSWSHSSMLPLGSSLPDELLFADDSSEGSEVLM

SEQ ID NO: 2601 - protein, 1390 aa, unidentified
MKAPAVLAPGILVLLFTLVQRSNGECKEALAKSEMNVNMKYQLPNFTAETPIQNVILHEHHIFLGATNYIYVLNEEDLQKVAEYKTGPVLEHPDCFPCQDCSSKANLSGGVWKDNINMALVVDTYYDDQLISCGSVNRGTCQRHVFPHNHTADIQSEVHCIFSPQIEEPSQCPDCVVSALGAKVLSSVKDRFINFFVGNTINSSYFPDHPLHSISVRRLKETKDGFMFLTDQSYIDVLPEFRDSYPIKYVHAFESNNFIYFLTVQRETLDAQTFHTRIIRFCSINSGLHSYMEMPLECILTEKRKKRSTKKEVFNILQAAYVSKPGAQLARQIGASLNDDILFGVFAQSKPDSAEPMDRSAMCAFPIKYVNDFFNKIVNKNNVRCLQHFYGPNHEHCFNRTLLRNSSGCEARRDEYRTEFTTALQRVDLFMGQFSEVLLTSISTFIKGDLTIANLGTSEGRFMQVVVSRSGPSTPHVNFLLDSHPVSPEVIVEHTLNQNGYTLVITGKKITKIPLNGLGCRHFQSCSQCLSAPPFVQCGWCHDKCVRSEECLSGTWTQQICLPAIYKVFPNSAPLEGGTRLTICGWDFGFRRNNKFDLKKTRVLLGNESCTLTLSESTMNTLKCTVGPAMNKHFNMSIIISNGHGTTQYSTFSYVDPVITSISPKYGPMAGGTLLTLTGNYLNSGNSRHISIGGKTCTLKSVSNSILECYTPAQTISTEFAVKLKIDLANRETSIFSYREDPIVYEIHPTKSFISGGSTITGVGKNLNSVSVPRMVINVHEAGRNFTVACQHRSNSEIICCTTPSLQQLNLQLPLKTKAFFMLDGILSKYFDLIYVHNPVFKPFEKPVMISMGNENVLEIKGNDIDPEAVKGEVLKVGNKSCENIHLHSEAVLCTVPNDLLKLNSELNIEWKQAISSTVLGKVIVQPDQNFTGLIAGVVSISTALLLLLGFFLWLKKRKQIKDLGSELVRYDARVHTPHLDRLVSARSVSPTTEMVSNESVDYRATFPEDQFPNSSQNGSCRQVQYPLTDMSPILTSGDSDISSPLLQNTVHIDLSALNPELVQAVQHVVIGPSSLIVHFNEVIGRGHFGCVYHGTLLDNDGKKIHCAVKSLNRITDIGEVSQFLTEGIIMKDFSHPNVLSLLGICLRSEGSPLVVLPYMKHGDLRNFIRNETHNPTVKDLIGFGLQVAKGMKYLASKKFVHRDLAARNCMLDEKFTVKVADFGLARDMYDKEYYSVHNKTGAKLPVKWMALESLQTQKFTTKSDVWSFGVLLWELMTRGAPPYPDVNTFDITVYLLQGRRLLQPEYCPDPLYEVMLKCWHPKAEMRPSFSELVSRISAIFSTFIGEHYVHVNATYVNVKCVAPYPSLLSSEDNADDEVDTRPASFWETS

SEQ ID NO: 2602 - protein, 218 aa, unidentified
MALVPYEETTEFGLQKFHKPLATFSFANHTIQIRQDWRHLGVAAVVWDAAIVLSTYLEMGAVELRGRSAVELGAGTGLVGIVAALLGAHVTITDRKVALEFLKSNVQANLPPHIQTKTVVKELTWGQNLGSFSPGEFDLILGADIIYLEETFTDLLQTLEHLCSNHSVILLACRIRYERDNNFLAMLERQFTVRKVHYDPEKDVHIYEAQKRNQKEDL

SEQ ID NO: 2603 - protein, 378 aa, unidentified
MAGSYPEGAPAILADKRQQFGSRFLSDPARVFHHNAWDNVEWSEEQAAAAERKVQENSIQRVCQEKQVDYEINAHKYWNDFYKIHENGFFKDRHWLFTEFPELAPSQNQNHLKDWFLENKSEVCECRNNEDGPGLIMEEQHKCSSKSLEHKTQTPPVEENVTQKISDLEICADEFPGSSATYRILEVGCGVGNTVFPILQTNNDPGLFVYCCDFSSTAIELVQTNSEYDPSRCFAFVHDLCDEEKSYPVPKGSLDIIILIFVLSAVVPDKMQKAINRLSRLLKPGGMVLLRDYGRYDMAQLRFKKGQCLSGNFYVRGDGTRVYFFTQEELDTLFTTAGLEKVQNLVDRRLQVNRGKQLTMYRVWIQCKYCKPLLSSTS

SEQ ID NO: 2604 - protein, 244 aa, unidentified
MELTIFILRLAIYILTFPLYLLNFLGLWSWICKKWFPYFLVRFTVIYNEQMASKKRELFSNLQEFAGPSGKLSLLEVGCGTGANFKFYPPGCRVTCIDPNPNFEKFLIKSIAENRHLQFERFVVAAGENMHQVADGSVDVVVCTLVLCSVKNQERILREVCRVLRPGGAFYFMEHVAAECSTWNYFWQQVLDPAWHLLFDGCNLTRESWKALERASFSKLKLQHIQAPLSWELVRPHIYGYAVK

SEQ ID NO: 2605 - protein, 362 aa, unidentified
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYTCFVTSPIRASYSVTLRVIFTSGDMSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEMFEAVRVDDPDDLGERIKERPALNAQGGIYVINPEMGRSNSPGGDSDDGSLNEQGQEIAVQVSVHLQSETKSIDTESQGSSHFSPPDDIGSAESNCNYKDGAYENCQL

SEQ ID NO: 2606 - protein, 409 aa, unidentified
MDRLKSHLTVCFLPSVPFLILVSTLATAKSVTNSTLNGTNVVLGSVPVIIARTDHIIVKEGNSALINCSVYGIPDPQFKWYNSIGKLLKEEEDEKERGGGKWQMHDSGLLNITKVSFSDRGKYTCVASNIYGTVNNTVTLRVIFTSGDMGVYYMVVCLVAFTIVMVLNITRLCMMSSHLKKTEKAINEFFRTEGAEKLQKAFEIAKRIPIITSAKTLELAKVTQFKTMEFARYIEELARSVPLPPLIMNCRTIMEEIMEVVGLEEQGQNFVRHTPEGQEAADRDEVYTIPNSLKRSDSPAADSDASSLHEQPQQIAIKVSVHPQSKKEHADDQEGGQFEVKDVEETELSAEHSPETAEPSTDVTSTELTSEEPTPVEVPDKVLPPAYLEATEPAVTHDKNTCIIYESHV

SEQ ID NO: 2607 - protein, 342 aa, unidentified
MSKGTSSDTSLGRVSRAAFPSPTAAEMAEISRIQYEMEYTEGISQRMRVPEKLKVAPPNADLEQGFQEGVPNASVIMQVPERIVVAGNNEDVSFSRPADLDLIQSTPFKPLALKTPPRVLTLSERPLDFLDLERPPTTPQNEEIRAVGRLKRERSMSENAVRQNGQLVRNDSLWHRSDSAPRNKISRFQAPISAPEYTVTPSPQQARVCPPHMLPEDGANLSSARGILSLIQSSTRRAYQQILDVLDENRRPVLRGGSAAATSNPHHDNVRYGISNIDTTIEGTSDDLTVVDAASLRRQIIKLNRRLQLLEEENKERAKREMVMYSITVAFWLLNSWLWFRR

SEQ ID NO: 2608 - protein, 741 aa, unidentified
MAEPVSPLKHFVLAKKAITAIFDQLLEFVTEGSHFVEATYKNPELDRIATEDDLVEMQGYKDKLSIIGEVLSRRHMKVAFFGRTSSGKSSVINAMLWDKVLPSGIGHITNCFLSVEGTDGDKAYLMTEGSDEKKSVKTVNQLAHALHMDKDLKAGCLVRVFWPKAKCALLRDDLVLVDSPGTDVTTELDSWIDKFCLDADVFVLVANSESTLMNTEKHFFHKVNERLSKPNIFILNNRWDASASEPEYMEDVRRQHMERCLHFLVEELKVVNALEAQNRIFFVSAKEVLSARKQKAQGMPESGVALAEGFHARLQEFQNFEQIFEECISQSAVKTKFEQHTIRAKQILATVKNIMDSVNLAAEDKRHYSVEEREDQIDRLDFIRNQMNLLTLDVKKKIKEVTEEVANKVSCAMTDEICRLSVLVDEFCSEFHPNPDVLKIYKSELNKHIEDGMGRNLADRCTDEVNALVLQTQQEIIENLKPLLPAGIQDKLHTLIPCKKFDLSYNLNYHKLCSDFQEDIVFRFSLGWSSLVHRFLGPRNAQRVLLGLSEPIFQLPRSLASTPTAPTTPATPDNASQEELMITLVTGLASVTSRTSMGIIIVGGVIWKTIGWKLLSVSLTMYGALYLYERLSWTTHAKERAFKQQFVNYATEKLRMIVSSTSANCSHQVKQQIATTFARLCQQVDITQKQLEEEIARLPKEIDQLEKIQNNSKLLRNKAVQLENELENFTKQFLPSSNEES

SEQ ID NO: 2609 - protein, 757 aa, unidentified
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMKVAFFGRTSNGKSTVINAMLWDKVLPSGIGHTTNCFLRVEGTDGHEAFLLTEGSEEKRSAKTVNQLAHALHQDKQLHAGSLVSVMWPNSKCPLLKDDLVLMDSPGIDVTTELDSWIDKFCLDADVFVLVANSESTLMQTEKHFFHKVSERLSRPNIFILNNRWDASASEPEYMEEVRRQHMERCTSFLVDELGVVDRSQAGDRIFFVSAKEVLNARIQKAQGMPEGGGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENLEQEIAAMNKKIEVLDSLQSKAKLLRNKAGWLDSELNMFTHQYLQPSR

SEQ ID NO: 2610 - protein, 579 aa, unidentified
MKDFSDVILCMEATESSKTEFCNPAFEPESGPPCPPPVFPEDASYSVPAPWHGRRPRGLRPDCRFSWLCVLLLSSLLLLLLGLLVAIILAQLQAAPPSGASHSPLPAGGLTTTTTTPTITTSQAAGTPKGQQESGVSPSPQSTCGGLLSGPRGFFSSPNYPDPYPPNTHCVWHIQVATDHAIQLKIEALSIESVASCLFDRLELSPEPEGPLLRVCGRVPPPTLNTNASHLLVVFVSDSSVEGFGFHAWYQAMAPGRGSCAHDEFRCDQLICLLPDSVCDGFANCADGSDETNCSAKFSGCGGNLTGLQGTFSTPSYLQQYPHQLLCTWHISVPAGHSIELQFHNFSLEAQDECKFDYVEVYETSSSGAFSLLGRFCGAEPPPHLVSSHHELAVLFRTDHGISSGGFSATYLAFNATENPCGPSELSCQAGGCKGVQWMCDMWRDCTDGSDDNCSGPLFPPPELACEPVQVEMCLGLSYNTTAFPNIWVGMITQEEVVEVLSGYKSLTSLPCYQHFRRLLCGLLVPRCTPLGSVLPPCRSVCQEAEHQCQSGLALLGTPWPFNCNRLPEAADLEACAQP

SEQ ID NO: 2611 - protein, 465 aa, unidentified
MEEEDEEARALLAGGPDEADRGAPAAPGALPALCDPSRLAHRLLVLLLMCFLGFGSYFCYDNPAALQTQVKRDMQVNTTKFMLLYAWYSWPNVVLCFFGGFLIDRVFGIRWGTIIFSCFVCIGQVVFALGGIFNAFWLMEFGRFVFGIGGESLAVAQNTYAVSWFKGKELNLVFGLQLSMARIGSTVNMNLMGWLYSKIEALLGSAGHTTLGITLMIGGITCILSLICALALAYLDQRAERILHKEQGKTGEVIKLTDVKDFSLPLWLIFIICVCYYVAVFPFIGLGKVFFTEKFGFSSQAASAINSVVYVISAPMSPVFGLLVDKTGKNIIWVLCAVAATLVSHMMLAFTMWNPWIAMCLLGLSYSLLACALWPMVAFVVPEHQLGTAYGFMQSIQNLGLAIISIIAGMILDSRGYLFLEVFFIACVSLSLLSVVLLYLVNRAQGGNLNYSARQREEIKFSHTE

SEQ ID NO: 2612 - protein, 455 aa, unidentified
MGWGGGGGCTPRPPIHQQPPERRVVTVVFLGLLLDLLAFTLLLPLLPGLLESHGRAHDPLYGSWQGGVDWFATAIGMPVEKRYNSVLFGGLIGSAFSVLQFLCAPLTGATSDCLGRRPVMLLCLMGVATSYAVWATSRSFAAFLASRLIGGISKGNVSLSTAIVADLGSPLARSQGMAVIGVAFSLGFTLGPMLGASLPLEMAPWFALLFAASDLLFIFCFLPETLPLEKRAPSIALGFRDAADLLSPLALLRFSAVARGQDPPSGDRLSSLRRLGLVYFLYLFLFSGLEYTLSFLTHQRFQFSSLQQGKMFFLIGLTMATIQGAYARRIHPGGEVAAVKRALLLLVPAFLLIGWGRSLPVLGLGLLLYSFAAAVVVPCLSSVVAGYGSPGQKGTVMGTLRSLGALARAAGPLVAASVYWLAGAQACFTTWSGLFLLPFFLLQKLSYPAQTLKAE

SEQ ID NO: 2613 - protein, 449 aa, unidentified
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAVLWTAQGNCLTINSDEHSIGRNSGIFWALLQSSLFFGNLYIYFAWQGKTQISESDRRTVFIALTVISLVGTVLFFLIRKPDSENVLGEDESSDDQDMEVNESAQNNLTKAVDAFKKSFKLCVTKEMLLLSITTAYTGLELTFFSGVYGTCIGATNKFGAEEKSLIGLSGIFIGIGEILGGSLFGLLSKNNRFGRNPVVLLGILVHFIAFYLIFLNMPGDAPIAPVKGTDSSAYIKSSKEVAILCSFLLGLGDSCFNTQLLSILGFLYSEDSAPAFAIFKFVQSICAAVAFFYSNYLLLHWQLLVMVIFGFFGTISFFTVEWEAAAFVARGSDYRSI

SEQ ID NO: 2614 - protein, 480 aa, unidentified
MGPGPPAAGAAPSPRPLSLVARLSYAVGHFLNDLCASMWFTYLLLYLHSVRAYSSRGAGLLLLLGQVADGLCTPLVGYEADRAASCCARYGPRKAWHLVGTVCVLLSFPFIFSPCLGCGAATPEWAALLYYGPFIVIFQFGWASTQISHLSLIPELVTNDHEKVELTALRYAFTVVANITVYGAAWLLLHLQGSSRVEPTQDISISDQLGGQDVPVFRNLSLLVVGVGAVFSLLFHLGTRERRRPHAEEPGEHTPLLAPATAQPLLLWKHWLREPAFYQVGILYMTTRLIVNLSQTYMAMYLTYSLHLPKKFIATIPLVMYLSGFLSSFLMKPINKCIGRNMTYFSGLLVILAFAAWVALAEGLGVAVYAAAVLLGAGCATILVTSLAMTADLIGPHTNSGAFVYGSMSFLDKVANGLAVMAIQSLHPCPSELCCRACVSFYHWAMVAVTGGVGVAAALCLCSLLLWPTRLRRWDRDARP

SEQ ID NO: 2615 - protein, 517 aa, unidentified
MGLGQPQAWLLGLPTAVVYGSLALFTTILHNVFLLYYVDTFVSVYKINKMAFWVGETVFLLWNSLNDPLFGWLSDRQFLSSQPRSGAGLSSRAVVLARVQALGWHGPLLALSFLAFWVPWAPAGLQFLLCLCLYDGFLTLVDLHHHALLADLALSAHDRTHLNFYCSLFSAAGSLSVFASYAFWNKEDFSSFRAFCVTLAVSSGLGFLGATQLLRRRVEAARKDPGCSGLVVDSGLCGEELLVGSEEADSITLGRYLRQLARHRNFLWFVSMDLVQVFHCHFNSNFFPLFLEHLLSDHISLSTGSILLGLSYVAPHLNNLYFLSLCRRWGVYAVVRGLFLLKLGLSLLMLLAGPDHLSLLCLFIASNRVFTEGTCKLLTLVVTDLVDEDLVLNHRKQAASALLFGMVALVTKPGQTFAPLLGTWLLCFYTGHDLFQQSLITPVGSAHPWPEPPAPAPAQAPTLRQGCFYLLVLVPITCALLQLFTWSQFTLHGRRLHMVKAQRQNLSQAQTLDVKMV

SEQ ID NO: 2616 - protein, 490 aa, unidentified
MTQGKKKKRAANRSIMLAKKIIIKDGGTPQGIGSPSVYHAVIVIFLEFFAWGLLTAPTLVVLHETFPKHTFLMNGLIQGVKGLLSFLSAPLIGALSDVWGRKSFLLLTVFFTCAPIPLMKISPWWYFAVISVSGVFAVTFSVVFAYVADITQEHERSMAYGLVSATFAASLVTSPAIGAYLGRVYGDSLVVVLATAIALLDICFILVAVPESLPEKMRPASWGAPISWEQADPFASLKKVGQDSIVLLICITVFLSYLPEAGQYSSFFLYLRQIMKFSPESVAAFIAVLGILSIIAQTIVLSLLMRSIGNKNTILLGLGFQILQLAWYGFGSEPWMMWAAGAVAAMSSITFPAVSALVSRTADADQQGVVQGMITGIRGLCNGLGPALYGFIFYIFHVELKELPITGTDLGTNTSPQHHFEQNSIIPGPPFLFGACSVLLALLVALFIPEHTNLSLRSSSWRKHCGSHSHPHNTQAPGEAKEPLLQDTNV

SEQ ID NO: 2617 - protein, 506 aa, unidentified
MSVEPPPELEEKAASEPEAGAMPEKRAGAQAAGSTWLQGFGRPSVYHAAIVIFLEFFAWGLLTTPMLTVLHETFSQHTFLMNGLIQGVKGLLSFLSAPLIGALSDVWGRKPFLLGTVFFTCFPIPLMRISPWWYFAMISVSGVFSVTFSVIFAYVADVTQEHERSTAYGWVSATFAASLVSSPAIGAYLSASYGDSLVVLVATVVALLDICFILVAVPESLPEKMRPVSWGAQISWKQADPFASLKKVGKDSTVLLICITVFLSYLPEAGQYSSFFLYLRQVIGFGSVKIAAFIAMVGILSIVAQTAFLSILMRSLGNKNTVLLGLGFQMLQLAWYGFGSQAWMMWAAGTVAAMSSITFPAISALVSRNAESDQQGVAQGIITGIRGLCNGLGPALYGFIFYMFHVELTELGPKLNSNNVPLQGAVIPGPPFLFGACIVLMSFLVALFIPEYSKASGVQKHSNSSSGSLTNTPERGSDEDIEPLLQDSSIWELSSFEEPGNQCTEL

SEQ ID NO: 2618 - protein, 543 aa, unidentified
MAKGEGAESGSAAGLLPTSILQSTERPAQVKKEPKKKKQQLSVCNKLCYALGGAPYQVTGCALGFFLQIYLLDVAQKDEEVVFCFSSFQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 2619 - protein, 504 aa, unidentified
MAAPPAPAAKGSPQPEPHAPEPGPGSAKRGREDSRAGRLSFCTKVCYGIGGVPNQIASSATAFYLQLFLLDIAQIPAAQVSLVLFGGKVSGAAADPVAGFFINRSQRTGSGRLMPWVLGCTPFIALAYFFLWFLPPFTSLRGLWYTTFYCLFQALATFFQVPYTALTMLLTPCPRERDSATAYRMTVEMAGTLMGATVHGLIVSGAHRPHRCEATATPGPVTVSPNAAHLYCIAAAVVVVTYPVCISLLCLGVKERPDPSAPASGPGLSFLAGLSLTTRHPPYLKLVISFLFISAAVQVEQSYLVLFCTHASQLHDHVQGLVLTVLVSAVLSTPLWEWVLQRFGKKTSAFGIFAMVPFAILLAAVPTAPVAYVVAFVSGVSIAVSLLLPWSMLPDVVDDFQLQHRHGPGLETIFYSSYVFFTKLSGACALGISTLSLEFSGYKAGVCKQAEEVVVTLKVLIGAVPTCMILAGLCILMVGSTPKTPSRDASSRLSLRRRTSYSLA

SEQ ID NO: 2620 - protein, 412 aa, unidentified
MRGKLLPLAGLYLVQGLPYGLQSGLLPVLLRAGGLSLTRVGLAKVLYAPWLLKLAWAPLVDAQGSARAWVTRSTAGLGLVCGLLAGLPPPGAGQAGLPAAVAGLLLLLNLGAAMQDVALDALAVQLLEPAELGPGNTVQVVAYKLGAALAGGALLALLPTFSWPQLFLLLAATYWLAAALAWAAPALRRLPQQPPSEQRPHTAHLLRDVLAVPGTVWTAGFVLTYKLGEQGASSLFPLLLLDHGVSAPELGLWNGVGAVVCSIAGSSLGGTLLAKHWKLLPLLRSVLRFRLGGLACQTALVFHLDTLGASMDAGTILRGSALLSLCLQHFLGGLVTTVTFTGMMRCSQLAPRALQATHYSLLATLELLGKLLLGTLAGGLADGLGPHPCFLLLLILSAFPVLYLDLAPSTFL

SEQ ID NO: 2621 - protein, 514 aa, unidentified
MGCDGRVSGLLRRNLQPTLTYWSVFFSFGLCIAFLGPTLLDLRCQTHSSLPQISWVFFSQQLCLLLGSALGGVFKRTLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLPVPMAVLMLLSKERLLTCCPQRRPLLLSADELALETQPPEKEDASSLPPKFQSHLGHEDLFSCCQRKNLRGAPYSFFAIHITGALVLFMTDGLTGAYSAFVYSYAVEKPLSVGHKVAGYLPSLFWGFITLGRLLSIPISSRMKPATMVFINVVGVVVTFLVLLIFSYNVVFLFVGTASLGLFLSSTFPSMLAYTEDSLQYKGCATTVLVTGAGVGEMVLQMLVGSIFQAQGSYSFLVCGVIFGCLAFTFYILLLFFHRMHPGLPSVPTQDRSIGMENSECYQR

SEQ ID NO: 2622 - protein, 518 aa, unidentified
MLCASFLGLGLSVAIVGPTFQDLATNVNRNISSLSFIFVGRALGYLSGSVIGGFLVDVMNYFLLLGISMSATTVGLYLVPFCKTAILLTVMMSIFGVSIGILDTGGNVLILAIWGDKGAPHMQALHFSFALGAFLAPLLAKLALGPTASAENHTESDFHPALNQSSDADSEALFGVPNDKNLLWAYAVIGTYMFLVSVIFFCLFLKNSSKQEKARASAETFRRAKYHNALLCLLFLFFFFYVGAEVTYGSYVFSFATTHAGMKESEAAGLNSIFWGTFAACRGLAIFFATCLQPGTMIVLSNIGSLTSSLFLVLFDKNPICLWIATSVYGASMATTFPSGVSWIEQYTTIHGKSAAFFVIGASLGEMAIPAVIGILQGKYPDLPVVLYTSLGASIATGILFPVLYKLATSPLDRQRKEDRKSEDQKALLSSSGLNEYEEENEEEDAEKWNEMDFEMIETNDTMRHSIIETSRSSLTEPTAEVYNQYPSNALVFESSPFNTGSAHVKHLPETRTKGTNV

SEQ ID NO: 2623 - protein, 450 aa, unidentified
MLVTAYLAFVGLLASCLGLELSRCRAKPPGRACSNPSFLRFQLDFYQVYFLALAADWLQAPYLYKLYQHYYFLEGQIAILYVCGLASTVLFGLVASSLVDWLGRKNSCVLFSLTYSLCCLTKLSQDYFVLLVGRALGGLSTALLFSAFEAWYIHEHVERHDFPAEWIPATFARAAFWNHVLAVVAGVAAEAVASWIGLGPVAPFVAAIPLLALAGALALRNWGENYDRQRAFSRTCAGGLRCLLSDRRVLLLGTIQALFESVIFIFVFLWTPVLDPHGAPLGIIFSSFMAASLLGSSLYRIATSKRYHLQPMHLLSLAVLIVVFSLFMLTFSTSPGQESPVESFIAFLLIELACGLYFPSMSFLRRKVIPETEQAGVLNWFRVPLHSLACLGLLVLHDSDRKTGTRNMFSICSAVMVMALLAVVGLFTVVRHDAELRVPSPTEEPYAPEL

SEQ ID NO: 2624 - protein, 791 aa, unidentified
MADDKVAILTDDEEEQKRKYVLADPFNGISREPEPPSNETPSSTETSAIPEEEIDWIEKHCVKINNDLLISKVFYFFFYSAYGSLYPLLPVYYKQLGMSPSQSGLLVGIRYFIEFCSAPFWGVVADRFKKGKIVLLFSLLCWVLFNLGIGFVKPATLRCVPKIRPTTHPTNASHQLTILPTNSSFTSFLTISPKMREKRNLLETRLNVSDTVTLPTAPNMNSEPTLQPQTGEITNRMMDLTLNSSTATPVSPGSVTKETTTVIVTTTKSLPSDQVMLVYDQQEVEAIFLVILVVVIIGEFFSASSVTIVDTVTLQYLGKHRDRYGLQRMWGSLGWGLAMLSVGIGIDYTHIEVLIDGKGCKPPEYRNYQIVFIVFGVLMTMALIVATQFRFRYNHFKNDDSKGKEVEIPQVERNNSTESSEETPTTTSHSQAFNFWDLIKLLCSVQYGSVLFVAWFMGFGYGFVFTFLYWHLEDLNGTTTLFGVCSVLSHVSELTAYFFSHKLIELIGHIRVLYIGLACNTARYIYISYLENAWTVLPMEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNKPAWGVSSSPWVTFVYALYQIKEMMQLTRDNRASEIQPLQGTNENRENSPAGRAQPVPCETHSDPSRNQPSPDAAASQTQTSPAHPSVDPCTEESEEQQAQLAAGGH

SEQ ID NO: 2625 - protein, 586 aa, unidentified
MSANPRWDISRALGVAKLFHLVCGVREACVTPFLTLYLRQLGLAAPWVGTLMGTKHLIAAFWAPVCAFLAKSYRKRRALLIGSLLGSVGASLLMVLVPPVDKNRVHFPCNGSSGLTSTDALPGVTLPVNITSAQESASSHPAKRTAEVEMPGFRNPPGESDRETFRDLHVYLAPSVEGARTTSQALLHPVTSGLKDHPWEVTFEVVKTALPLLPGGKGPGNPANLSGTKGKAWAFDLSLEALRRTFILSLGSVAFWELLTAPLEQVADDSLYEFLDFVDATDRYRSLWVWRLLGMSAGVCGITALVGQLDCFLMTSGPRGVVHFYGYSVVSTLALLVSIAFPIPICQQWEPSYKRVKALSIVGGDPHLILLASTTVLVGAIVSTVQNFLFWHMKDHGSGELVMGFSVALSLLGEILLHPFKATLLRKLSRTGLVGLGLSCLAGQLLYYSFLWSWWSVLPIQILSAISNRALWWAVGASVEDLATPRMERALSALFRGHFYGSGCSLGSFVGGFVVMRFSLAVLYQACCVALLLWLALLLSIQRRLPRERKIKYSKLLSMEVSDTSDSEQGTEQDWLVKAMREEHSD

SEQ ID NO: 2626 - protein, 560 aa, unidentified
MAGPTEAETGLAEPRALCAQRGHRTYARRWVFLLAISLLNCSNATLWLSFAPVADVIAEDLVLSMEQINWLSLVYLVVSTPFGVAAIWILDSVGLRAATILGAWLNFAGSVLRMVPCMVVGTQNPFAFLMGGQSLCALAQSLVIFSPAKLAALWFPEHQRATANMLATMSNPLGVLVANVLSPVLVKKGEDIPLMLGVYTIPAGVVCLLSTICLWESVPPTPPSAGAASSTSEKFLDGLKLQLMWNKAYVILAVCLGGMIGISASFSALLEQILCASGHSSGFSGLCGALFITFGILGALALGPYVDRTKHFTEATKIGLCLFSLACVPFALVSQLQGQTLALAATCSLLGLFGFSVGPVAMELAVECSFPVGEGAATGMIFVLGQAEGILIMLAMTALTVRRSEPSLSTCQQGEDPLDWTVSLLLMAGLCTFFSCILAVFFHTPYRRLQAESGEPPSTRNAVGGADSGPGVDRGGAGRAGVLGPSTATPECTARGASLEDPRGPGSPHPACHRATPRAQGPAATDAPSRPGRLAGRVQASRFIDPAGSHSSFSSPWVIT

SEQ ID NO: 2627 - protein, 518 aa, unidentified
MAGLRNESEQEPLLGDTPGSREWDILETEEHYKSRWRSIRILYLTMFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAGNVAVVRSYTAGATSLQERTSSMANISMCQALGFILGPVFQTCFTFLGEKGVTWDVIKLQINMYTTPVLLSAFLGILNIILILAILREHRVDDSGRQCKSINFEEASTDEAQVPQGNIDQVAVVAINVLFFVTLFIFALFETIITPLTMDMYAWTQEQAVLYNGIILAALGVEAVVIFLGVKLLSKKIGERAILLGGLIVVWVGFFILLPWGNQFPKIQWEDLHNNSIPNTTFGEIIIGLWKSPMEDDNERPTGCSIEQAWCLYTPVIHLAQFLTSAVLIGLGYPVCNLMSYTLYSKILGPKPQGVYMGWLTASGSGARILGPMFISQVYAHWGPRWAFSLVCGIIVLTITLLGVVYKRLIALSVRYGRIQE

SEQ ID NO: 2628 - protein, 474 aa, unidentified
MELGGHWDMNSAPRLVSETAERKQEQKTGTEAEAADSGAVGARRFLLCLYLVGFLDLFGVSMVVPLLSLHVKSLGASPTVAGIVGSSYGILQLFSSTLVGCWSDVVGRRSSLLACILLSALGYLLLGAATNVFLFVLARVPAGIFKHTLSISRALLSDVVPEKERPLVIGHFNTASGVGFILGPVVGGYLTELEDGFYLTAFICFLVFILNAGLVWFFPWREAKPGSTEKGLPLRKTHVLLGRSHDTVQEAATSRRARASKKTAQPWVEVVLALRNMKNLLFSEMWDIFLVRLLMAMAVMLYYSNFVLALEERFGVRPKVTGYLISYSSMLGAVAGLALGPILRLYKHNSQALLLHSSILTCTLLLLYSLAPTMGAVVLSSTLLSFSTAIGRTCITDLQLTVGGAQASGTLIGVGQSVTAVGRIIAPLLSGVAQEVSPCGPPSLGAVLALVAIFIMSLNKRHSSGDGNSKLKSE

SEQ ID NO: 2629 - protein, 1857 aa, unidentified
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHFKLTDQTNNRFEVPHEHVQSFSGNAAASLTYQVEISRQPFSIKVTRRSNNRVLFDSSIGPLLFADQFLQLSTRLPSTNVYGLGEHVHQQYRHDMNWKTWPIFNRDTTPNGNGTNLYGAQTFFLCLEDASGLSFGVFLMNSNAMEVVLQPAPAITYRTIGGILDFYVFLGNTPEQVVQEYLELIGRPALPSYWALGFHLSRYEYGTLDNMREVVERNRAAQLPYDVQHADIDYMDERRDFTYDSVDFKGFPEFVNELHNNGQKLVIIVDPAISNNSSSSKPYGPYDRGSDMKIWVNSSDGVTPLIGEVWPGQTVFPDYTNPNCAVWWTKEFELFHNQVEFDGIWIDMNEVSNFVDGSVSGCSTNNLNNPPFTPRILDGYLFCKTLCMDAVQHWGKQYDIHNLYGYSMAVATAEAAKTVFPNKRSFILTRSTFAGSGKFAAHWLGDNTATWDDLRWSIPGVLEFNLFGIPMVGPDICGFALDTPEELCRRWMQLGAFYPFSRNHNGQGYKDQDPASFGADSLLLNSSRHYLNIRYTLLPYLYTLFFRAHSRGDTVARPLLHEFYEDNSTWDVHQQFLWGPGLLITPVLDEGAEKVMAYVPDAVWYDYETGSQVRWRKQKVEMELPGDKIGLHLRGGYIFPTQQPNTTTLASRKNPLGLIIALDENKEAKGELFWDNGETKDTVANKVYLLCEFSVTQNRLEVNISQSTYKDPNNLAFNEIKILGTEEPSNVTVKHNGVPSQTSPTVTYDSNLKVAIITDIDLLLGEAYTVEWSIKIRDEEKIDCYPDENGASAENCTARGCIWEASNSSGVPFCYFVNDLYSVSDVQYNSHGATADISLKSSVYANAFPSTPVNPLRLDVTYHKNEMLQFKIYDPNKNRYEVPVPLNIPSMPSSTPEGQLYDVLIKKNPFGIEIRRKSTGTIIWDSQLLGFTFSDMFIRISTRLPSKYLYGFGETEHRSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDVAFVNISRTVLQTRYTLLPYLYTLMHKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRQKFMGFKIALDDEGTAGGWLFWDDGQSIDTYGKGLYYLASFSASQNTMQSHIIFNNYITGTNPLKLGYIEIWGVGSVPVTSVSISVSGMVITPSFNNDPTTQVLSIDVTDRNISLHNFTSLTWISTL

SEQ ID NO: 2630 - protein, 240 aa, unidentified
MYLRRAVSKTLALPLRAPPNPAPLGKDASLRRMSSNRFPGSSGSNMIYYLVVGVTVSAGGYYAYKTVTSDQAKHTEHKTNLKEKTKAEIHPFQGEKENVAETEKASSEAPEELIVEAEVVDAEESPSATVVVIKEASACPGHVEAAPETTAVSAETGPEVTDAAARETTEVNPETTPEVTNAALDEAVTIDNDKDTTKNETSDEYAELEEENSPAESESSAGDDLQEEASVGSEAASAQG

SEQ ID NO: 2631 - protein, 445 aa, unidentified
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPLTWEGYDPSWN

SEQ ID NO: 2632 - protein, 478 aa, unidentified
MFKFHQMKHIFEILDKMRCLRKRSTVSFLGVLVIFLLFMNLYIEDSYVLEGDKQLIRETSTHQLNSERYVHTFKDLSNFSGAINVTYRYLAATPLQRKRYLTIGLSSVKRKKGNYLLETIKSIFEQSSYEELKEISVVVHLADFNSSWRDAMVQDITQKFAHHIIAGRLMVIHAPEEYYPILDGLKRNYNDPEDRVKFRSKQNVDYAFLLNFCANTSDYYVMLEDDVRCSKNFLTAIKKVIASLEGTYWVTLEFSKLGYIGKLYHSHDLPRLAHFLLMFYQEMPCDWLLTHFRGLLAQKNVIRFKPSLFQHMGYYSSYKGTENKLKDDDFEEESFDIPDNPPASLYTNMNVFENYEASKAYSSVDEYFWGKPPSTGDVFVIVFENPIIIKKIKVNTGTEDRQNDILHHGALDVGENVMPSKQRRQCSTYLRLGEFKNGNFEMSGVNQKIPFDIHCMRIYVTKTQKEWLIIRSISIWTS

SEQ ID NO: 2633 - protein, 741 aa, unidentified
MALFTPWKLSSQKLGFFLVTFGFIWGMMLLHFTIQQRTQPESSSMLREQILDLSKRYIKALAEENRNVVDGPYAGVMTAYDLKKTLAVLLDNILQRIGKLESKVDNLVVNGTGTNSTNSTTAVPSLVALEKINVADIINGAQEKCVLPPMDGYPHCEGKIKWMKDMWRSDPCYADYGVDGSTCSFFIYLSEVENWCPHLPWRAKNPYEEADHNSLAEIRTDFNILYSMMKKHEEFRWMRLRIRRMADAWIQAIKSLAEKQNLEKRKRKKVLVHLGLLTKESGFKIAETAFSGGPLGELVQWSDLITSLYLLGHDIRISASLAELKEIMKKVVGNRSGCPTVGDRIVELIYIDIVGLAQFKKTLGPSWVHYQCMLRVLDSFGTEPEFNHANYAQSKGHKTPWGKWNLNPQQFYTMFPHTPDNSFLGFVVEQHLNSSDIHHINEIKRQNQSLVYGKVDSFWKNKKIYLDIIHTYMEVHATVYGSSTKNIPSYVKNHGILSGRDLQFLLRETKLFVGLGFPYEGPAPLEAIANGCAFLNPKFNPPKSSKNTDFFIGKPTLRELTSQHPYAEVFIGRPHVWTVDLNNQEEVEDAVKAILNQKIEPYMPYEFTCEGMLQRINAFIEKQDFCHGQVMWPPLSALQVKLAEPGQSCKQVCQESQLICEPSFFQHLNKDKDMLKYKVTCQSSELAKDILVPSFDPKNKHCVFQGDLLLFSCAGAHPRHQRVCPCRDFIKGQVALCKDCL

SEQ ID NO: 2634 - protein, 792 aa, unidentified
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKLQGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 2635 - protein, 155 aa, unidentified
MVDLTQVMDDEVFMAFASYATIILSKMMLMSTATAFYRLTRKVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTLSMAYRLLKSKLYL

SEQ ID NO: 2636 - protein, 147 aa, unidentified
MAGNSILLAAVSILSACQQSYFALQVGKARLKYKVTPPAVTGSPEFERVFRAQQNCVEFYPIFIITLWMAGWYFNQVFATCLGLVYIYGRHLYFWGYSEAAKKRITGFRLSLGILALLTLLGALGIANSFLDEYLDLNIAKKLRRQF

SEQ ID NO: 2637 - protein, 152 aa, unidentified
MAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYTGEPSKRSRGALGSIALLGLVGTTVCSAFQHLGWVKSGLGSGPKCCH

SEQ ID NO: 2638 - protein, 1907 aa, unidentified
MAAAPGLLVWLLVLRLPWRVPGQLDPSTGRRFSEHKLCADDECSMLMYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEKTLQDMEKNPELSKEREPEPEPVEANSEESDSVFSENTEDLQEQFTTQKHHSHANSQANHAQGEQASFESFEEMLQDKLKVPESENNKTSNSSQVSNEQDKIDAYKLLKKEMTLDLKTKFGSTADALVSDDETTRLVTSLEDDFDEELDTEYYAVGKEDEENQEDFDELPLLTFTDGEDMKTPAKSGVEKYPTDKEQNSNEEDKVQLTVPPGIKNDDKNILTTWGDTIFSIVTGGEETRDTMDLESSSSEEEKEDDDDALVPDSKQGKPQSATDYSDPDNVDDGLFIVDIPKTNNDKEVNAEHHIKGKGRGVQESKRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHENTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 2639 - protein, 332 aa, unidentified
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 2640 - protein, 1124 aa, unidentified
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 2641 - protein, 2002 aa, unidentified
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASSSSESEMEEEGEEEEEEPRLPPSDLGGVPWKEAVRIHALLKGKSEEELEASKSFGPGNEEEEEEEEEYEEEEEEDYDEEEEESSEAGNQRLQQVMHAADPLEIQADVHWTHIREREEEERMAPASESSASGAPLDENDLEEDVDSEPAEIEGEAAEDGDPGDTGAELDDDQHWSDSPSDADRELRLPCPAEGEAELELRVSEDEEKLPASPKHQERGPSQATSPIRSPQESALLFIPVHSPSTEGPQLPPVPAATQEKSPEERLFPEPLLPKEKPKADAPSDLKAVHSPIRSQPVTLPEARTPVSPGSPQPQPPVAASTPPPSPLPICSQPQPSTEATVPSPTQSPIRFQPAPAKTSTPLAPLPVQSQSDTKDRLGSPLAVDEALRRSDLVEEFWMKSAEIRRSLGLTPVDRSKGPEPSFPTPAFRPVSLKSYSVEKSPQDEGLHLLKPLSIPKRLGLPKPEGEPLSLPTPRSPSDRELRSAQEERRELSSSSGLGLHGSSSNMKTLGSQSFNTSDSAMLTPPSSPPPPPPPGEEPATLRRKLREAEPNASVVPPPLPATWMRPPREPAQPPREEVRKSFVESVEEIPFADDVEDTYDDKTEDSSLQEKFFTPPSCWPRPEKPRHPPLAKENGRLPALEGTLQPQKRGLPLVSAEAKELAEERMRAREKSVKSQALRDAMARQLSRMQQMELASGAPRPRKASSAPSQGKERRPDSPTRPTLRGSEEPTLKHEATSEEVLSPPSDSGGPDGSFTSSEGSSGKSKKRSSLFSPRRNKKEKKSKGEGRPPEKPSSNLLEEAAAKPKSLWKSVFSGYKKDKKKKADDKSCPSTPSSGATVDSGKHRVLPVVRAELQLRRQLSFSEDSDLSSDDVLEKSSQKSRREPRTYTEEELNAKLTRRVQKAARRQAKQEELKRLHRAQIIQRQLQQVEERQRRLEERGVAVEKALRGEAGMGKKDDPKLMQEWFKLVQEKNAMVRYESELMIFARELELEDRQSRLQQELRERMAVEDHLKTEEELSEEKQILNEMLEVVEQRDSLVALLEEQRLREREEDKDLEAAMLSKGFSLNWS

SEQ ID NO: 2642 - protein, 383 aa, unidentified [sequence omitted]

SEQ ID NO: 2643 - protein, 530 aa, unidentified
MAALRRLLWPPPRVSPPLCAHQPLLGPWGRPAVTTLGLPGRPFSSREDEERAVAEAAWRRRRRWGELSVAAAAGGGLVGLVCYQLYGDPRAGSPATGRPSKSAATEPEDPPRGRGMLPIPVAAAKETVAIGRTDIEDLDLYATSRERRFRLFASIECEGQLFMTPYDFILAVTTDEPKVAKTWKSLSKQELNQMLAETPPVWKGSSKLFRNLKEKGVISYTEYLFLLCILTKPHAGFRIAFNMFDTDGNEMVDKKEFLVLQEIFRKKNEKREIKGDEEKRAMLRLQLYGYHSPTNSVLKTDAEELVSRSYWDTLRRNTSQALFSDLAERADDITSLVTDTTLLVHFFGKKGKAELNFEDFYRFMDNLQTEVLEIEFLSYSNGMNTISEEDFAHILLRYTNVENTSVFLENVRYSIPEEKGITFDEFRSFFQFLNNLEDFAIALNMYNFASRSIGQDEFKRAVYVATGLKFSPHLVNTVFKIFDVDKDDQLSYKEFIGIMKDRLHRGFRGYKTVQKYPTFKSCLKKELHSR

SEQ ID NO: 2644 - protein, 667 aa, unidentified
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 2645 - protein, 463 aa, unidentified
MAGAGERKGKKDDNGIGTAIDFVLSNARLVLGVGGAAMLGIATLAVKRMYDRAISAPTSPTRLSHSGKRSWEEPNWMGSPRLLNRDMKTGLSRSLQTLPTDSSTFDTDTFCPPRPKPVARKGQVDLKKSRLRMSLQEKLLTYYRNRAAIPAGEQARAKQAAVDICAELRSFLRAKLPDMPLRDMYLSGSLYDDLQVVTADHIQLIVPLVLEQNLWSCIPGEDTIMNVPGFFLVRRENPEYFPRGSSYWDRCVVGGYLSPKTVADTFEKVVAGSINWPAIGSLLDYVIRPAPPPEALTLEVQYERDKHLFIDFLPSVTLGDTVLVAKPHRLAQYDNLWRLSLRPAETARLRALDQADSGCRSLCLKILKAICKSTPALGHLTASQLTNVILHLAQEEADWSPDMLADRFLQALRGLISYLEAGVLPSALNPKVNLFAELTPEEIDELGYTLYCSLSEPEVLLQT

SEQ ID NO: 2646 - protein, 454 aa, unidentified
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPEGPAETDPEVTPQLSSPAPLCLTLQERLLAFERDRVTIPAAQVALAKQLAGDIALELQAYFRSKFPELPFGAFVPGGPLYDGLQAGAADHVRLLVPLVLEPGLWSLVPGVDTVARDPRCWAVRRTQLEFCPRGSSPWDRFLVGGYLSSRVLLELLRKALAASVNWPAIGSLLGCLIRPSMASEELLLEVQHERLELTVAVLVAVPGVDADDRLLLAWPLEGLAGNLWLQDLYPVEAARLRALDDHDAGTRRRLLLLLCAVCRGCSALGQLGRGHLTQVVLRLGEDNVDWTEEALGERFLQALELLIGSLEQASLPCHFNPSVNLFSSLREEEIDDIGYALYSGLQEPEGLL

SEQ ID NO: 2647 - protein, 632 aa, unidentified
MSDCCSAPGISWEAGVGRPAVPGLELQIRRGAMSEETVSESQFSLKTAALRVFDLPLTWYYSLSQIKFSPVAKKLFVVTAVSAISVIFLAHHFKRKRGKKKGKILPWEPEHLILEYTKRAASDKGSSCSSSRQNLTLSLSSTKDKGSQVCNYANGGLFSKYSGSAQSLASVQSVNSCHSCACGNSNSWDKADEDDIKLVNIPVTTPENLYLMGMELFEEALRRWEQALTFRNRQAEDEACGSIKLGAGDAIAEENVDDIISTEFIHKLEALLQRAYRLQEEFEATLGASDPNSLADDIDKDTDITMKGNVEDFGLRDTLSIASTDSFASAAELAEHREVRHTYSLESLCHCPFYEEAMHLVEEGKIYSRVLRTEMLECLGDSDFLAKLHCIRQAFQVILSESANRIFLAESGRKILSALIVKARKNPKKFEDVFDEMIYFLEQTDHWGSTEMELAARGVKNLNFYDVVLDFILMDSFEDLENPPTSIQNVVNNRWLNSSFKETAVASSCWSVLKQKRQQMKIPDGFFAHFYAICEHISPVLAWGFLGPRNSLYDLCCFFKNQVLLFLKDIFDFEKVRYSSTETLAEDLMQLLIRRTELLMAYLEADALRHTSSCLSSHGHVMSTGLLEAKVQ

SEQ ID NO: 2648 - protein, 593 aa, unidentified
MAFRRAEGTSMIQALAMTVAEIPVFLYTTFGQSAFSQLRLTPGLRKVLFATALGTVALALAAHQLKRRRRRKKQVGPEMGGEQLGTVPLPILLARKVPSVKKGYSSRRVQSPSSKSNDTLSGISSIEPSKHSGSSHSVASMMAVNSSSPTAACSGLWDARGMEESLTTSDGNAESLYMQGMELFEEALQKWEQALSVGQRGDSGSTPMPRDGLRNPETASEPLSEPESQRKEFAEKLESLLHRAYHLQEEFGSTFPADSMLLDLERTLMLPLTEGSLRLRADDEDSLTSEDSFFSATELFESLQTGDYPIPLSRPAAAYEEALQLVKEGRVPCRTLRTELLGCYSDQDFLAKLHCVRQAFEGLLEDKSNQLFFGKVGRQMVTGLMTKAEKSPKGFLESYEEMLSYALRPETWATTRLELEGRGVVCMSFFDIVLDFILMDAFEDLENPPASVLAVLRNRWLSDSFKETALATACWSVLKAKRRLLMVPDGFISHFYSVSEHVSPVLAFGFLGPKPQLAEVCAFFKHQIVQYLRDMFDLDNVRYTSLPALADDILQLSRRRSEILLGYLGVPAASSAGVNGALPRENGPLGELQ

SEQ ID NO: 2649 - protein, 78 aa, unidentified
MSESELGRKWDRCLADAVVKIGTGFGLGIVFSLTFFKRRMWPLAFGSGMGLGMAYSNCQHDFQAPYLLHGKYVKEQEQ

SEQ ID NO: 2650 - protein, 263 aa, unidentified
MWELRSASFWRAIFAEFFATLFYVFFGLGSSLRWAPGPLHVLQVAMAFGLALATLVQSVGHISGAHVNPAVTFAFLVGSQMSLLRAFCYMAAQLLGAVAGAAVLYSVTPPAVRGNLALNTLHPAVSVGQATTVEIFLTLQFVLCIFATYDERRNGQLGSVALAVGFSLALGHLFGMYYTGAGMNPARSFAPAILTGNFTNHWVYWVGPIIGGGLGSLLYDFLLFPRLKSISERLSVLKGAKPDVSNGQPEVTGEPVELNTQAL

SEQ ID NO: 2651 - protein, 570 aa, unidentified
MSRLEAKKPSLCKSEPLTTERVRTTLSVLKRIVTSCYGPSGRLKQLHNGFGGYVCTTSQSSALLSHLLVTHPILKILTASIQNHVSSFSDCGLFTAILCCNLIENVQRLGLTPTTVIRLNKHLLSLCISYLKSETCGCRIPVDFSSTQILLCLVRSILTSKPACMLTRKETEHVSALILRAFLLTIPENAEGHIILGKSLIVPLKGQRVIDSTVLPGILIEMSEVQLMRLLPIKKSTALKVALFCTTLSGDTSDTGEGTVVVSYGVSLENAVLDQLLNLGRQLISDHVDLVLCQKVIHPSLKQFLNMHRIIAIDRIGVTLMEPLTKMTGTQPIGSLGSICPNSYGSVKDVCTAKFGSKHFFHLIPNEATICSLLLCNRNDTAWDELKLTCQTALHVLQLTLKEPWALLGGGCTETHLAAYIRHKTHNDPESILKDDECTQTELQLIAEAFCSALESVVGSLEHDGGEILTDMKYGHLWSVQADSPCVANWPDLLSQCGCGLYNSQEELNWSFLRSTRRPFVPQSCLPHEAVGSASNLTLDCLTAKLSGLQVAVETANLILDLSYVIEDKN

SEQ ID NO: 2652 - protein, 465 aa, unidentified
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKDKVSLCHLGWSAMAPSGLTAAPTSLGSSDPPTSASQVAGTTGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 2653 - protein, 118 aa, unidentified
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 2654 - protein, 377 aa, unidentified
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 2655 - protein, 292 aa, unidentified
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRL

SEQ ID NO: 2656 - protein, 1068 aa, unidentified
MVSSDRPVSLEDEVSHSMKEMIGGCCVCSDERGWAENPLVYCDGHGCSVAVHQACYGIVQVPTGPWFCRKCESQERAARVRCELCPHKDGALKRTDNGGWAHVVCALYIPEVQFANVSTMEPIVLQSVPHDRYNKTCYICDEQGRESKAATGACMTCNKHGCRQAFHVTCAQFAGLLCEEEGNGADNVQYCGYCKYHFSKLKKSKRGSNRSYDQSLSDSSSHSQDKHHEKEKKKYKEKDKHKQKHKKQPEPSPALVPSLTVTTEKTYTSTSNNSISGSLKRLEDTTARFTNANFQEVSAHTSSGKDVSETRGSEGKGKKSSAHSSGQRGRKPGGGRNPGTTVSAASPFPQGSFSGTPGSVKSSSGSSVQSPQDFLSFTDSDLRNDSYSHSQQSSATKDVHKGESGSQEGGVNSFSTLIGLPSTSAVTSQPKSFENSPGDLGNSSLPTAGYKRAQTSGIEEETVKEKKRKGNKQSKHGPGRPKGNKNQENVSHLSVSSASPTSSVASAAGSITSSSLQKSPTLLRNGSLQSLSVGSSPVGSEISMQYRHDGACPTTTFSELLNAIHNGIYNSNDVAVSFPNVVSGSGSSTPVSSSHLPQQSSGHLQQVGALSPSAVSSAAPAVATTQANTLSGSSLSQAPSHMYGNRSNSSMAALIAQSENNQTDQDLGDNSRNLVGRGSSPRGSLSPRSPVSSLQIRYDQPGNSSLENLPPVAASIEQLLERQWSEGQQFLLEQGTPSDILGMLKSLHQLQVENRRLEEQIKNLTAKKERLQLLNAQLSVPFPTITANPSPSHQIHTFSAQTAPTTDSLNSSKSPHIGNSFLPDNSLPVLNQDLTSSGQSTSSSSALSTPPPAGQSPAQQGSGVSGVQQVNGVTVGALASGMQPVTSTIPAVSAVGGIIGALPGNQLAINGIVGALNGVMQTPVTMSQNPTPLTHTTVPPNATHPMPATLTNSASGLGLLSDQQRQILIHQQQFQQLLNSQQLTPEQHQAFLYQLMQHHHQQHHQPELQQLQIPGPTQIPINNLLAGTQAPPLHTATTNPFLTIHGDNASQKVARLSDKTGPVAQEKS

SEQ ID NO: 2657 - protein, 412 aa, unidentified
MGSPWNGSDGPEGAREPPWPALPPCDERRCSPFPLGALVPVTAVCLCLFVVGVSGNVVTVMLIGRYRDMRTTTNLYLGSMAVSDLLILLGLPFDLYRLWRSRPWVFGPLLCRLSLYVGEGCTYATLLHMTALSVERYLAICRPLRARVLVTRRRVRALIAVLWAVALLSAGPFLFLVGVEQDPGISVVPGLNGTARIASSPLASSPPLWLSRAPPPSPPSGPETAEAAALFSRECRPSPAQLGALRVMLWVTTAYFFLPFLCLSILYGLIGRELWSSRRPLRGPAASGRERGHRQTVRVLLVVVLAFIICWLPFHVGRIIYINTEDSRMMYFSQYFNIVALQLFYLSASINPILYNLISKKYRAAAFKLLLARKSRPRGFHRSRDTAGEVAGDTGGDTVGYTETSANVKTMG

SEQ ID NO: 2658 - protein, 238 aa, unidentified
MRFKNRFQRFMNHRAPANGRYKPTCYEHAANCYTHAFLIVPAIVGSALLHRLSDDCWEKITAWIYGMGLCALFIVSTVFHIVSWKKSHLRTVEHCFHMCDRMVIYFFIAASYAPWLNLRELGPLASHMRWFIWLMAAGGTIYVFLYHEKYKVVELFFYLTMGFSPALVVTSMNNTDGLQELACGGLIYCLGVVFFKSDGIIPFAHAIWHLFVATAAAVHYYAIWKYLYRSPTDFMRHL

SEQ ID NO: 2659 - protein, 270 aa, unidentified
MFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERTGSCVQFLRGEACPKAGTACLPARYKLVELLCYVVMGFFPALVILSMPNTEGIWELVTGGVFYCLGMVFFKSDGRIPFAHAIWHLFVAFGAGTHYYAIWRYLYLPSTLQTKVSK

SEQ ID NO: 2660 - protein, 750 aa, unidentified
MGKSESQMDITDINTPKPKKKQRWTPLEISLSVLVLLLTIIAVTMIALYATYDDGICKSSDCIKSAARLIQNMDATTEPCTDFFKYACGGWLKRNVIPETSSRYGNFDILRDELEVVLKDVLQEPKTEDIVAVQKAKALYRSCINESAIDSRGGEPLLKLLPDIYGWPVATENWEQKYGASWTAEKAIAQLNSKYGKKVLINLFVGTDDKNSVNHVIHIDQPRLGLPSRDYYECTGIYKEACTAYVDFMISVARLIRQEERLPIDENQLALEMNKVMELEKEIANATAKPEDRNDPMLLYNKMTLAQIQNNFSLEINGKPFSWLNFTNEIMSTVNISITNEEDVVVYAPEYLTKLKPILTKYSARDLQNLMSWRFIMDLVSSLSRTYKESRNAFRKALYGTTSETATWRRCANYVNGNMENAVGRLYVEAAFAGESKHVVEDLIAQIREVFIQTLDDLTWMDAETKKRAEEKALAIKERIGYPDDIVSNDNKLNNEYLELNYKEDEYFENIIQNLKFSQSKQLKKLREKVDKDEWISGAAVVNAFYSSGRNQIVFPAGILQPPFFSAQQSNSLNYGGIGMVIGHEITHGFDDNGRNFNKDGDLVDWWTQQSASNFKEQSQCMVYQYGNFSWDLAGGQHLNGINTLGENIADNGGLGQAYRAYQNYIKKNGEEKLLPGLDLNHKQLFFLNFAQVWCGTYRPEYAVNSIKTDVHSPGNFRIIGTLQNSAEFSEAFHCRKNSYMNPEKKCRVW

SEQ ID NO: 2661 - protein, 131 aa, unidentified
MAPSLWKGLVGIGLFALAHAAFSAAQHRSYMRLTEKEDESLPIDIVLQTLLAFAVTCYGIVHIAGEFKDMDATSELKNKTFDTLRNHPSFYVFNHRGRVLFRPSDTANSSNQDALSSNTSLKLRKLESLRR

SEQ ID NO: 2662 - protein, 582 aa, unidentified
MSPAPRPPRCLLLPLLTLGTALASLGSAQSSSFSPEAWLQQYGYLPPGDLRTHTQRSPQSLSAAIAAMQKFYGLQVTGKADADTMKAMRRPRCGVPDKFGAEIKANVRRKRYAIQGLKWQHNEITFCIQNYTPKVGEYATYEAIRKAFRVWESATPLRFREVPYAYIREGHEKQADIMIFFAEGFHGDSTPFDGEGGFLAHAYFPGPNIGGDTHFDSAEPWTVRNEDLNGNDIFLVAVHELGHALGLEHSSDPSAIMAPFYQWMDTENFVLPDDDRRGIQQLYGGESGFPTKMPPQPRTTSRPSVPDKPKNPTYGPNICDGNFDTVAMLRGEMFVFKERWFWRVRNNQVMDGYPMPIGQFWRGLPASINTAYERKDGKFVFFKGDKHWVFDEASLEPGYPKHIKELGRGLPTDKIDAALFWMPNGKTYFFRGNKYYRFNEELRAVDSEYPKNIKVWEGIPESPRGSFMGSDEVFTYFYKGNKYWKFNNQKLKVEPGYPKSALRDWMGCPSGGRPDEGTEEETEVIIIEVDEEGGGAVSAAAVVLPVLLLLLVLAVGLAVFFFRRHGTPRRLLYCQRSLLDKV

SEQ ID NO: 2663 - protein, 669 aa, unidentified
MGSDPSAPGRPGWTGSLLGDREEAARPRLLPLLLVLLGCLGLGVAAEDAEVHAENWLRLYGYLPQPSRHMSTMRSAQILASALAEMQRFYGIPVTGVLDEETKEWMKRPRCGVPDQFGVRVKANLRRRRKRYALTGRKWNNHHLTFSIQNYTEKLGWYHSMEAVRRAFRVWEQATPLVFQEVPYEDIRLRRQKEADIMVLFASGFHGDSSPFDGTGGFLAHAYFPGPGLGGDTHFDADEPWTFSSTDLHGNNLFLVAVHELGHALGLEHSSNPNAIMAPFYQWKDVDNFKLPEDDLRGIQQLYGTPDGQPQPTQPLPTVTPRRPGRPDHRPPRPPQPPPPGGKPERPPKPGPPVQPRATERPDQYGPNICDGDFDTVAMLRGEMFVFKGRWFWRVRHNRVLDNYPMPIGHFWRGLPGDISAAYERQDGRFVFFKGDRYWLFREANLEPGYPQPLTSYGLGIPYDRIDTAIWWEPTGHTFFFQEDRYWRFNEETQRGDPGYPKPISVWQGIPASPKGAFLSNDAAYTYFYKGTKYWKFDNERLRMEPGYPKSILRDFMGCQEHVEPGPRWPDVARPPFNPHGGAEPGADSAEGDVGDGDGDFGAGVNKDGGSRVVVQMEEVARTVNVVMVLVPLLLLLCVLGLTYALVQMQRKGAPRVLLYCKRSLQEWV

SEQ ID NO: 2664 - protein, 607 aa, unidentified
MILLTFSTGRRLDFVHHSGVFFLQTLLWILCATVCGTEQYFNVEVWLQKYGYLPPTDPRMSVLRSAETMQSALAAMQQFYGINMTGKVDRNTIDWMKKPRCGVPDQTRGSSKFHIRRKRYALTGQKWQHKHITYSIKNVTPKVGDPETRKAIRRAFDVWQNVTPLTFEEVPYSELENGKRDVDITIIFASGFHGDSSPFDGEGGFLAHAYFPGPGIGGDTHFDSDEPWTLGNPNHDGNDLFLVAVHELGHALGLEHSNDPTAIMAPFYQYMETDNFKLPNDDLQGIQKIYGPPDKIPPPTRPLPTVPPHRSIPPADPRKNDRPKPPRPPTGRPSYPGAKPNICDGNFNTLAILRREMFVFKDQWFWRVRNNRVMDGYPMQITYFWRGLPPSIDAVYENSDGNFVFFKGNKYWVFKDTTLQPGYPHDLITLGSGIPPHGIDSAIWWEDVGKTYFFKGDRYWRYSEEMKTMDPGYPKPITVWKGIPESPQGAFVHKENGFTYFYKGKEYWKFNNQILKVEPGYPRSILKDFMGCDGPTDRVKEGHSPPDDVDIVIKLDNTASTVKAIAIVIPCILALCLLVLVYTVFQFKRKGTPRHILYCKRSMQEWV

SEQ ID NO: 2665 - protein, 645 aa, unidentified
MPRSRGGRAAPGPPPPPPPPGQAPRWSRWRVPGRLLLLLLPALCCLPGAARAAAAAAGAGNRAAVAVAVARADEAEAPFAGQNWLKSYGYLLPYDSRASALHSAKALQSAVSTMQQFYGIPVTGVLDQTTIEWMKKPRCGVPDHPHLSRRRRNKRYALTGQKWRQKHITYSIHNYTPKVGELDTRKAIRQAFDVWQKVTPLTFEEVPYHEIKSDRKEADIMIFFASGFHGDSSPFDGEGGFLAHAYFPGPGIGGDTHFDSDEPWTLGNANHDGNDLFLVAVHELGHALGLEHSSDPSAIMAPFYQYMETHNFKLPQDDLQGIQKIYGPPAEPLEPTRPLPTLPVRRIHSPSERKHERQPRPPRPPLGDRPSTPGTKPNICDGNFNTVALFRGEMFVFKDRWFWRLRNNRVQEGYPMQIEQFWKGLPARIDAAYERADGRFVFFKGDKYWVFKEVTVEPGYPHSLGELGSCLPREGIDTALRWEPVGKTYFFKGERYWRYSEERRATDPGYPKPITVWKGIPQAPQGAFISKEGYYTYFYKGRDYWKFDNQKLSVEPGYPRNILRDWMGCNQKEVERRKERRLPQDDVDIMVTINDVPGSVNAVAVVIPCILSLCILVLVYTIFQFKNKTGPQPVTYYKRPVQEWV

SEQ ID NO: 2666 - protein, 247 aa, unidentified
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRNPF

SEQ ID NO: 2667 - protein, 335 aa, unidentified
MKVEFAPLNIQLARRLQTVAVLQWVLKYLLLGPMSIGITVMLIIHNYLFLYIPYLMWLYFDWHTPERGGRRSSWIKNWTLWKHFKDYFPIHLIKTQDLDPSHNYIFGFHPHGIMAVGAFGNFSVNYSDFKDLFPGFTSYLHVLPLWFWCPVFREYVMSVGLVSVSKKSVSYMVSKEGGGNISVIVLGGAKESLDAHPGKFTLFIRQRKGFVKIALTHGASLVPVVSFGENELFKQTDNPEGSWIRTVQNKLQKIMGFALPLFHARGVFQYNFGLMTYRKAIHTVVGRPIPVRQTLNPTQEQIEELHQTYMEELRKLFEEHKGKYGIPEHETLVLK

SEQ ID NO: 2668 - protein, 334 aa, unidentified
MVEFAPLFMPWERRLQTLAVLQFVFSFLALAEICTVGFIALLFTRFWLLTVLYAAWWYLDRDKPRQGGRHIQAIRCWTIWKYMKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGAPLVPIFSFGENDLFDQIPNSSGSWLRYIQNRLQKIMGISLPLFHGRGVFQYSFGLIPYRRPITTVVGKPIEVQKTLHPSEEEVNQLHQRYIKELCNLFEAHKLKFNIPADQHLEFC

SEQ ID NO: 2669 - protein, 341 aa, unidentified
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKLMGFSPCIFWGRGLFSATSWGLLPFAVPITTVVGRPIPVPQRLHPTEEEVNHYHALYMTALEQLFEEHKESCGVPASTCLTFI

SEQ ID NO: 2670 - protein, 837 aa, unidentified
MARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAPKYGSYNVFWTSNPGLPLLTEMVKSRLNSWFQHRPPGAPPERYLGLPGSLKWEDRGPSGQGQGQFLIQQVTLKIPISIEFVFESGSAQAGGNQALPRLAGSLLTQALESHAEGFRERFEKTFQLKEKGLSSGEQVLGQAALSGLLGGIGYFYGQGLVLPDIGVEGSEQKVDPALFPPVPLFTAVPSRSFFPRGFLWDEGFHQLVVQRWDPSLTREALGHWLGLLNADGWIGREQILGDEARARVPPEFLVQRAVHANPPTLLLPVAHMLEVGDPDDLAFLRKALPRLHAWFSWLHQSQAGPLPLSYRWRGRDPALPTLLNPKTLPSGLDDYPRASHPSVTERHLDLRCWVALGARVLTRLAEHLGEAEVAAELGPLAASLEAAESLDELHWAPELGVFADFGNHTKAVQLKPRPPQGLVRVVGRPQPQLQYVDALGYVSLFPLLLRLLDPTSSRLGPLLDILADSRHLWSPFGLRSLAASSSFYGQRNSEHDPPYWRGAVWLNVNYLALGALHHYGHLEGPHQARAAKLHGELRANVVGNVWRQYQATGFLWEQYSDRDGRGMGCRPFHGWTSLVLLAMAEDY

SEQ ID NO: 2671 - protein, 213 aa, unidentified
MHQQKRQPELVEGNLPVFVFPTELIFYADDQSTHKQVLTLYNPYEFALKFKVLCTTPNKYVVVDAAGAVKPQCCVDIVIRHRDVRSCHYGVIDKFRLQVSEQSQRKALGRKEVVATLLPSAKEQQKEEEEKRLKEHLTESLFFEQSFQPENRAVSSGPSLLTVFLGVVCIAALMLPTLGDVESLVPLYLHLSVNQKLVAAYILGLITMAILRT

SEQ ID NO: 2672 - protein, 518 aa, unidentified
MAENHAQNKAKLISETRRRFEAEYVTDKSDKYDARDVERLQQDDNWVESYLSWRHNIVDETLKMLDESFQWRKEISVNDLNESSIPRWLLEIGVIYLHGYDKEGNKLFWIRVKYHVKDQKTILDKKKLIAFWLERYAKRENGKPVTVMFDLSETGINSIDMDFVRFIINCFKVYYPKYLSKIVIFDMPWLMNAAFKIVKTWLGPEAVSLLKFTSKNEVQDYVSVEYLPPHMGGTDPFKYSYPPLVDDDFQTPLCENGPITSEDETSSKEDIESDGKETLETISNEEQTPLLKKINPTESTSKAEENEKVDSKVKAFKKPLSVFKGPLLHISPAEELYFGSTESGEKKTLIVLTNVTKNIVAFKVRTTAPEKYRVKPSNSSCDPGASVDIVVSPHGGLTVSAQDRFLIMAAEMEQSSGTGPAELTQFWKEVPRNKVMEHRLRCHTVESSKPNTLTLKDNAFNMSDKTSEDICLQLSRLLESNRKLEDQVQRCIWFQQLLLSLTMLLLAFVTSFFYLLYS

SEQ ID NO: 2673 - protein, 235 aa, unidentified
MRRGAPQDQELVGPGPPGRGSRGAPPPLGPVVPVLVFPPDLVFRADQRSGPRQLLTLYNPTGTALRFRVLCTAPAKYTVFDAEGYVKPQSCIDIVIRHVAPIPSHYDVQDRFRIELSEEGAEGRVVGRKDITSILRAPAYPLELQGQPDPAPRPGPPAGTPPPTARHFQEHPRQQLATSSFLLFLLTGIVSVAFLLLPLPDELGSQLPQVLHVSLGQKLVAAYVLGLLTMVFLRT

SEQ ID NO: 2674 - protein, 613 aa, unidentified
MCCWPLLLLWGLLPGTAAGGSGRTYPHRTLLDSEGKYWLGWSQRGSQIAFRLQVRTAGYVGFGFSPTGAMASADIVVGGVAHGRPYLQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVLESGHECYHPNMPDAFLTCETVIFAWAIGGEGFSYPPHVGLSLGTPLDPHYVLLEVHYDNPTYEEGLIDNSGLRLFYTMDIRKYDAGVIEAGLWVSLFHTIPPGMPEFQSEGHCTLECLEEALEAEKPSGIHVFAVLLHAHLAGRGIRLRHFRKGKEMKLLAYDDDFDFNFQEFQYLKEEQTILPGDNLITECRYNTKDRAEMTWGGLSTRSEMCLSYLLYYPRINLTRCASIPDIMEQLQFIGVKEIYRPVTTWPFIIKSPKQYKNLSFMDAMNKFKWTKKEGLSFNKLVLSLPVNVRCSKTDNAEWSIQGMTALPPDIERPYKAEPLVCGTSSSSSLHRDFSINLLVCLLLLSCTLSTKSL

SEQ ID NO: 2675 - protein, 109 aa, unidentified
MAGALVRKAADYVRSKDFRDYLMSTHFWGPVANWGLPIAAINDMKKSPEIISGRMTFALCCYSLTFMRFAYKVQPRNWLLFACHATNEVAQLIQGGRLIKHEMTKTASA

SEQ ID NO: 2676 - protein, 127 aa, unidentified [sequence omitted]

SEQ ID NO: 2677 - protein, 247 aa, unidentified
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 2678 - protein, 716 aa, unidentified
MNNFRATILFWAAAAWAKSGKPSGEMDEVGVQKCKNALKLPVLEVLPGGGWDNLRNVDMGRVMELTYSNCRTTEDGQYIIPDEIFTIPQKQSNLEMNSEILESWANYQSSTSYSINTELSLFSKVNGKFSTEFQRMKTLQVKDQAITTRVQVRNLVYTVKINPTLELSSGFRKELLDISDRLENNQTRMATYLAELLVLNYGTHVTTSVDAGAALIQEDHLRASFLQDSQSSRSAVTASAGLAFQNTVNFKFEENYTSQNVLTKSYLSNRTNSRVQSIGGVPFYPGITLQAWQQGITNHLVAIDRSGLPLHFFINPNMLPDLPGPLVKKVSKTVETAVKRYYTFNTYPGCTDLNSPNFNFQANTDDGSCEGKMTNFSFGGVYQECTQLSGNRDVLLCQKLEQKNPLTGDFSCPSGYSPVHLLSQIHEEGYNHLECHRKCTLLVFCKTVCEDVFQVAKAEFRAFWCVASSQVPENSGLLFGGLFSSKSINPMTNAQSCPAGYFPLRLFENLKVCVSQDYELGSRFAVPFGGFFSCTVGNPLVDPAISRDLGAPSLKKCPGGFSQHPALISDGCQVSYCVKSGLFTGGSLPPARLPPFTRPPLMSQAATNTVIVTNSENARSWIKDSQTHQWRLGEPIELRRAMNVIHGDGGGLSGGAAAGVTVGVTTILAVVITLAIYGTRKFKKKAYQAIEERQSLVPGTAATGDTTYQEQGQSPA

SEQ ID NO: 2679 - protein, 681 aa, unidentified
MAPQVWRRRTLERCLTEVGKATGRPECFLTIQEGLASKFTSLTKVLYDFNKILENGRIHGSPLQKLVIENFDDEQIWQQLELQNEPILQYFQNAVSETINDEDISLLPESEEQEREEDGSEIEADDKEDLEDLEEEEVSDMGNDDPEMGERAENSSKSDLRKSPVFSDEDSDLDFDISKLEQQSKVQNKGQGKPREKSIVDDKFFKLSEMEAYLENIEKEEERKDDNDEEEEDIDFFEDIDSDEDEGGLFGSKKLKSGKSSRNLKYKDFFDPVESDEDITNVHDDELDSNKEDDEIAEEEAEELSISETDEDDDLQENEDNKQHKESLKRVTFALPDDAETEDTGVLNVKKNSDEVKSSFEKRQEKMNEKIASLEKELLEKKPWQLQGEVTAQKRPENSLLEETLHFDHAVRMAPVITEETTLQLEDIIKQRIRDQAWDDVVRKEKPKEDAYEYKKRLTLDHEKSKLSLAEIYEQEYIKLNQQKTAEEENPEHVEIQKMMDSLFLKLDALSNFHFIPKPPVPEIKVVSNLPAITMEEVAPVSVSDAALLAPEEIKEKNKAGDIKTAAEKTATDKKRERRKKKYQKRMKIKEKEKRRKLLEKSSVDQAGKYSKTVASEKLKQLTKTGKASFIKDEGKDKALKSSQAFFSKLQDQVKMQINDAKKTEKKKKKRQDISVHKLKL

SEQ ID NO: 2680 - protein, 241 aa, unidentified
MAVFLQLLPLLLSRAQGNPGASLDGRPGDRVNLSCGGVSHPIRWVWAPSFPACKGLSKGRRPILWASSSGTPTVPPLQPFVGRLRSLDSGIRRLELLLSAGDSGTFFCKGRHEDESRTVLHVLGDRTYCKAPGPTHGSVYPQLLIPLLGAGLVLGLGALGLVWWLHRRLPPQPIRPLPRFAPLVKTEPQRPVKEEEPKIPGDLDQEPSLLYADLDHLALSRPRRLSTADPADASTIYAVVV

SEQ ID NO: 2681 - protein, 635 aa, unidentified
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 2682 - protein, 396 aa, unidentified
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREARGSSRCGPGPLLPTSAPVLLQHYPLYRRSDANCSGEDAAPAEERDIPFKENYDVLSREASQKLLWWLQPRLVLSGHTHSACEVHHGGRVPELSVPSFSWRNRNNPSFIMGSITPTDYTLSKCYLPREDVVLIIYCGVVGFLVVLTLTHFGLLASPFLSGLNLLGKRKTR

SEQ ID NO: 2683 - protein, 113 aa, unidentified
MALWRAYQRALAAHPWKVQVLTAGSLMGLGDIISQQLVERRGLQEHQRGRTLTMVSLGCGFVDYPDALITNYYLWPAVQLANFYLVPLHYRLAVVQCVAVIWNSYLSWKAHRL

SEQ ID NO: 2684 - protein, 196 aa, unidentified
MAGWWPALSRAARRHPWPTNVLLYGSLVSAGDALQQRLQGREANWRQTRRVATLVVTFHANFNYVWLRLLERALPGRAPHALLAKLLCDQVVGAPIAVSAFYVGMSILQGKDDIFLDLKQKFWNTYLSGLMYWPFVQLTNFSLVPVQWRTAYAGVCGFLWATFICFSQQSGDGTFKSAFTILYTKGTSATEGYPKK

SEQ ID NO: 2685 - protein, 206 aa, unidentified
MARGGWRRLRRLLSAGQLLFQGRALLVTNTLGCGALMAAGDGVRQSWEIRARPGQVFDPRRSASMFAVGCSMGPFLHYWYLSLDRLFPASGLRGFPNVLKKVLVDQLVASPLLGVWYFLGLGCLEGQTVGESCQELREKFWEFYKADWCVWPAAQFVNFLFVPPQFRVTYINGLTLGWDTYLSYLKYRSPVPLTPPGCVALDTRAD

SEQ ID NO: 2686 - protein, 248 aa, unidentified
MAPGAPSSSPSPILAVLLFSSLVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 2687 - protein, 269 aa, unidentified
MAASAGAGAVIAAPDSRRWLWSVLAAALGLLTAGVSALEVYTPKEIFVANGTQGKLTCKFKSTSTTGGLTSVSWSFQPEGADTTVSFFHYSQGQVYLGNYPPFKDRISWAGDLDKKDASINIENMQFIHNGTYICDVKNPPDIVVQPGHIRLYVVEKENLPVFPVWVVVGIVTAVVLGLTLLISMILAVLYRRKNSKRDYTGCSTSESLSPVKQAPRKSPSDTEGLVKSLPSGSHQGPVIYAQLDHSGGHHSDKINKSESVVYADIRKN

SEQ ID NO: 2688 - protein, 215 aa, unidentified
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 2689 - protein, 235 aa, unidentified
MQQRGAAGSRGCALFPLLGVLFFQGVYIVFSLEIRADAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSSVALLSILVFVPSAVVVALLLVRMGRKAAGLKKRSRSGYKKSSIEVSDDTDQEEEEACMARLCVRCAECLDSDYEETY

SEQ ID NO: 2690 - protein, 341 aa, unidentified
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 2691 - protein, 172 aa, unidentified
MANGTNASAPYYSYEYYLDYLDLIPVDEKKLKAHKHSIVIAFWVSLAAFVVLLFLILLYMSWSASPQMRNSPKHHQTCPWSHGLNLHLCIQKCLPCHREPLATSQAQASSVEPGSRTGPDQPLRQESSSTLPLGGFQTHPTLLWELTLNGGPLVRSKPSEPPPGDRTSQLQS

SEQ ID NO: 2692 - protein, 205 aa, unidentified
MSAQRLISNRTSQQSASNSDYTWEYEYYEIGPVSFEGLKAHKYSIVIGFWVGLAVFVIFMFFVLTLLTKTGAPHQDNAESSEKRFRMNSFVSDFGRPLEPDKVFSRQGNEESRSLFHCYINEVERLDRAKACHQTTALDSDVQLQEAIRSSGQPEEELNRLMKFDIPNFVNTDQNYFGEDDLLISEPPIVLETKPLSQTSHKDLD

SEQ ID NO: 2693 - protein, 1456 aa, unidentified [sequence omitted]

SEQ ID NO: 2694 - protein, 1479 aa, unidentified
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELDFLSHNLQKFSRAQEQHWWIGLHTSESDGRFRWTDGSIINFISWAPGKPRPVGKDKKCVYMTASREDWGDQRCLTALPYICKRSNVTKETQPPDLPTTALGGCPSDWIQFLNKCFQVQGQEPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESRNASLAYVPDPYTQAFLTQAARGLRTPLWIGLAGEEGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAALVVVLMAVLLLLALLTAALILYRRRQSIERGAFEGARYSRSSSSPTEATEKNILVSDMEMNEQQE

SEQ ID NO: 2695 - protein, 321 aa, unidentified
MNQTLNSSGTVESALNYSRGSTVHTAYLVLSSLAMFTCLCGMAGNSMVIWLLGFRMHRNPFCIYILNLAAADLLFLFSMASTLSLETQPLVNTTDKVHELMKRLMYFAYTVGLSLLTAISTQRCLSVLFPIWFKCHRPRHLSAWVCGLLWTLCLLMNGLTSSFCSKFLKFNEDRCFRVDMVQAALIMGVLTPVMTLSSLTLFVWVRRSSQQWRRQPTRLFVVVLASVLVFLICSLPLSIYWFVLYWLSLPPEMQVLCFSLSRLSSSVSSSANPVIYFLVGSRRSHRLPTRSLGTVLQQALREEPELEGGETPTVGTNEMGA

SEQ ID NO: 2696 - protein, 312 aa, unidentified
MMEPREAGQHVGAANGAQEDVAFNLIILSLTEGLGLGGLLGNGAVLWLLSSNVYRNPFAIYLLDVACADLIFLGCHMVAIVPDLLQGRLDFPGFVQTSLATLRFFCYIVGLSLLAAVSVEQCLAALFPAWYSCRRPRHLTTCVCALTWALCLLLHLLLSGACTQFFGEPSRHLCRTLWLVAAVLLALLCCTMCGASLMLLLRVERGPQRPPPRGFPGLILLTVLLFLFCGLPFGIYWLSRNLLWYIPHYFYHFSFLMAAVHCAAKPVVYFCLGSAQGRRLPLRLVLQRALGDEAELGAVRETSRRGLVDIAA

SEQ ID NO: 2697 - protein, 343 aa, unidentified
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 2698 - protein, 289 aa, unidentified
MFGLFGLWRTFDSVVFYLTLIVGLGGPVGNGLVLWNLGFRIKKGPFSIYLLHLAAADFLFLSCRVGFSVAQAALGAQDTLYFVLTFLWFAVGLWLLAAFSVERCLSDLFPACYQGCRPRHASAVLCALVWTPTLPAVPLPANACGLLRNSACPLVCPRYHVASVTWFLVLARVAWTAGVVLFVWVTCCSTRPRPRLYGIVLGALLLLFFCGLPSVFYWSLQPLLNFLLPVFSPLATLLACVNSSSKPLIYSGLGRQPGKREPLRSVLRRALGEGAELGARGQSLPMGLL

SEQ ID NO: 2699 - protein, 322 aa, unidentified
MDPTISTLDTELTPINGTEETLCYKQTLSLTVLTCIVSLVGLTGNAVVLWLLGCRMRRNAFSIYILNLAAADFLFLSGRLIYSLLSFISIPHTISKILYPVMMFSYFAGLSFLSAVSTERCLSVLWPIWYRCHRPTHLSAVVCVLLWALSLLRSILEWMLCGFLFSGADSAWCQTSDFITVAWLIFLCVVLCGSSLVLLIRILCGSRKIPLTRLYVTILLTVLVFLLCGLPFGIQFFLFLWIHVDREVLFCHVHLVSIFLSALNSSANPIIYFFVGSFRQRQNRQNLKLVLQRALQDASEVDEGGGQLPEEILELSGSRLEQ

SEQ ID NO: 2700 - protein, 330 aa, unidentified
MDPTTPAWGTESTTVNGNDQALLLLCGKETLIPVFLILFIALVGLVGNGFVLWLLGFRMRRNAFSVYVLSLAGADFLFLCFQIINCLVYLSNFFCSISINFPSFFTTVMTCAYLAGLSMLSTVSTERCLSVLWPIWYRCRRPRHLSAVVCVLLWALSLLLSILEGKFCGFLFSDGDSGWCQTFDFITAAWLIFLFMVLCGSSLALLVRILCGSRGLPLTRLYLTILLTVLVFLLCGLPFGIQWFLILWIWKDSDVLFCHIHPVSVVLSSLNSSANPIIYFFVGSFRKQWRLQQPILKLALQRALQDIAEVDHSEGCFRQGTPEMSRSSLV

SEQ ID NO: 2701 - protein, 322 aa, unidentified
MDSTIPVLGTELTPINGREETPCYKQTLSFTGLTCIVSLVALTGNAVVLWLLGCRMRRNAVSIYILNLVAADFLFLSGHIICSPLRLINIRHPISKILSPVMTFPYFIGLSMLSAISTERCLSILWPIWYHCRRPRYLSSVMCVLLWALSLLRSILEWMFCDFLFSGANSVWCETSDFITIAWLVFLCVVLCGSSLVLLVRILCGSRKMPLTRLYVTILLTVLVFLLCGLPFGIQWALFSRIHLDWKVLFCHVHLVSIFLSALNSSANPIIYFFVGSFRQRQNRQNLKLVLQRALQDTPEVDEGGGWLPQETLELSGSRLEQ

SEQ ID NO: 2702 - protein, 322 aa, unidentified
MDPTVPVFGTKLTPINGREETPCYNQTLSFTVLTCIISLVGLTGNAVVLWLLGYRMRRNAVSIYILNLAAADFLFLSFQIIRLPLRLINISHLIRKILVSVMTFPYFTGLSMLSAISTERCLSVLWPIWYRCRRPTHLSAVVCVLLWGLSLLFSMLEWRFCDFLFSGADSSWCETSDFIPVAWLIFLCVVLCVSSLVLLVRILCGSRKMPLTRLYVTILLTVLVFLLCGLPFGILGALIYRMHLNLEVLYCHVYLVCMSLSSLNSSANPIIYFFVGSFRQRQNRQNLKLVLQRALQDKPEVDKGEGQLPEESLELSGSRLGP

SEQ ID NO: 2703 - protein, 443 aa, unidentified
MECLRSLPCLLPRAMRLPRRTLCALALDVTSVGPPVAACGRRANLIGRSRAAQLCGPDRLRVAGEVHRFRTSDVSQATLASVAPVFTVTKFDKQGNVTSFERKKTELYQELGLQARDLRFQHVMSITVRNNRIIMRMEYLKAVITPECLLILDYRNLNLEQWLFRELPSQLSGEGQLVTYPLPFEFRAIEALLQYWINTLQGKLSILQPLILETLDALVDPKHSSVDRSKLHILLQNGKSLSELETDIKIFKESILEILDEEELLEELCVSKWSDPQVFEKSSAGIDHAEEMELLLENYYRLADDLSNAARELRVLIDDSQSIIFINLDSHRNVMMRLNLQLTMGTFSLSLFGLMGVAFGMNLESSLEEDHRIFWLITGIMFMGSGLIWRRLLSFLGRQLEAPLPPMMASLPKKTLLADRSMELKNSLRLDGLGSGRSILTNR

SEQ ID NO: 2704 - protein, 904 aa, unidentified
MGMDLTCPFGISPACGAQASWSIFGADAAEVPGTRGHSQQEAAMPHIPEDEEPPGEPQAAQSPAGQGPPAAGVSCSPTPTIVLTGDATSPEGETDKNLANRVHSPHKRLSHRHLKVSTASLTSVDPAGHIIDLVNDQLPDISISEEDKKKNLALLEEAKLVSERFLTRRGRKSRSSPGDSPSAVSPNLSPSASPTSSRSNSLTVPTPPGLDVCSGPPSPLPGAPPQQKGDEADVSSPHPGEPNVPKGLADRKQNDQRKVSQGRLAPRPPPVEKSKEIAIEQKENFDPLQYPETTPKGLAPVTNSSGKMALNSPQPGPVESELGKQLLKTGWEGSPLPRSPTQDAAGVGPPASQGRGPAGEPMGPEAGSKAELPPTVSRPPLLRGLSWDSGPEEPGPRLQKVLAKLPLAEEEKRFAGKAGGKLAKAPGLKDFQIQVQPVRMQKLTKLREEHILMRNQNLVGLKLPDLSEAAEQEKGLPSELSPAIEEEESKSGLDVMPNISDVLLRKLRVHRSLPGSAPPLTEKEVENVFVQLSLAFRNDSYTLESRINQAERERNLTEENTEKELENFKASITSSASLWHHCEHRETYQKLLEDIAVLHRLAARLSSRAEVVGAVRQEKRMSKATEVMMQYVENLKRTYEKDHAELMEFKKLANQNSSRSCGPSEDGVPRTARSMSLTLGKNMPRRRVSVAVVPKFNALNLPGQTPSSSSIPSLPALSESPNGKGSLPVTSALPALLENGKTNGDPDCEASAPALTLSCLEELSQETKARMEEEAYSKGFQEGLKKTKELQDLKEEEEEQKSESPEEPEEVEETEEEEKGPRSSKLEELVHFLQVMYPKLCQHWQVIWMMAAVMLVLTVVLGLYNSYNSCAEQADGPLGRSTCSAAQRDSWWSSGLQHEQPTEQ

SEQ ID NO: 2705 - protein, 297 aa, unidentified
MTTPRNSVNGTFPAEPMKGPIAMQSGPKPLFRRMSSLVGPTQSFFMRESKTLGAVQIMNGLFHIALGGLLMIPAGIYAPICVTVWYPLWGGIMYIISGSLLAATEKNSRKCLVKGKMIMNSLSLFAAISGMILSIMDILNIKISHFLKMESLNFIRAHTPYINIYNCEPANPSEKNSPSTQYCYSIQSLFLGILSVMLIFAFFQELVIAGIVENEWKRTCSRPKSNIVLLSAEEKKEQTIEIKEEVVGLTETSSQPKNEEDIEIIPIQEEEEEETETNFPEPPQDQESSPIENDSSP

SEQ ID NO: 2706 - protein, 267 aa, unidentified
MKAEATVIPSRCARGLPSWQVLSPVQPWQTSAPQNTTQPKLLAPHQHEKSQKKSSLLKELGAFHITIALLHLVFGGYLASIVKNLHLVVLKSWYPFWGAASFLISGILAITMKTFSKTYLKMLCLMTNLISLFCVLSGLFVISKDLFLESPFESPIWRMYPNSTVHIQRLELALLCFTVLELFLPVPTAVTAWRGDCPSAKNDDACLVPNTPLHLKGLPVEPPPSYQSVIQGDAQHKQHQRLREVKQVAPDTWIVTDGAAIWTQTAN

SEQ ID NO: 2707 - protein, 267 aa, unidentified
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 2708 - protein, 152 aa, unidentified
MIGIFHIFMWYFLLVLYMGQIKGAFGTYEPVTYKTGCTLWGIFFIIAGVFLIRVTKYPTRSGIISTLIINIICIITTITAVTLTIIELSHFNSVSYRNYGQAKLGREVSRILLFFYGLEFSIALTHSIYSCSNLFRRQNDLTSVTEEAESTP

SEQ ID NO: 2709 - protein, 679 aa, unidentified
MESTSQDRRATHVITIKPNETVLTAFPYRPHSSLLDFLKGEPRVLGATQILLALIIVGFGTIFALNYIGFSQRLPLVVLTGYPFWGALIFILTGYLTVTDKKSKLLGQGVTGMNVISSLVAITGITFTILSYRHQDKYCQMPSFEEICVFSRTLFIVLFFLPSDVTQNSEQPAPEENDQLQFVLQEEFSSDDSTTNAQSVIFGGYAFFKLTLSRSPLVSQPGNKGREFVPDEQKQSILPSPKFSEEEIEPLPPTLEKKPSENMSIQLDSTFKQMKDEDLQSAIVQPSQMQTKLLQDQAASLQVFPSHSALKLEDISPEDLPSQALPVEGLSEQTMPSKSTSSHVKQSSNLTANDLPPQGILSQDTSSQDMLFHDMTSQDMQSLDMLSQDTPSHAMPPQDIPSQDMLSQALSAHAILPEASTSHIVQFPEIQHLLQQPPDLQPENTEPQNQQILQMSYQDIRSEVMEETKEWKSEEELHRRKSSRRHSLNQQTKALQYLRRHSLDVQAKGQKSSKRHSLDQQSKGWQSPKQKSLDQQIKDWLSPKRHSVDKQAQLNQTKEQLPDQQAEDQQAKGEQYPEGQSKDGQVKDQQTDKEQNSKKQTQDQQTEDQPAQEKKSPKGQFQNVQAEGQQAQVEKVPKLLCQDSESQIQQYQFWQFHKGNLQAGQPRTVNLLAKNPLTG

SEQ ID NO: 2710 - protein, 240 aa, unidentified
MSAAPASNGVFVVIPPNNASGLCPPPAILPTSMCQPPGIMQFEEPPLGAQTPRATQPPDLRPVETFLTGEPKVLGTVQILIGLIHLGFGSVLLMVRRGHVGIFFIEGGVPFWGGACFIISGSLSVAAEKNHTSCLVRSSLGTNILSVMAAFAGTAILLMDFGVTNRDVDRGYLAVLTIFTVLEFFTAVIAMHFGCQAIHAQASAPVIFLPNAFSADFNIPSPAASAPPAYDNVAYAQGVV

SEQ ID NO: 2711 - protein, 244 aa, unidentified
MDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEDRVYEELNIYSATYSELEDPGEMSPPIDL

SEQ ID NO: 2712 - protein, 214 aa, unidentified
MASHEVDNAELGSASAHGTPGSEAGPEELNTSVYQPIDGSPDYQKAKLQVLGAIQILNAAMILALGVFLGSLQYPYHFQKHFFFFTFYTGYPIWGAVFFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 2713 - protein, 239 aa, unidentified [sequence omitted]

SEQ ID NO: 2714 - protein, 132 aa, unidentified
MTTMQGMEQTTPGAGPDVPQLGNIDVIHSYLCKGLQEKFFKRKPKVLGVVRILIALMSLSMGIIMMCVAFSSYEEHPIFVYVAYTIWGSVMYPYQLQQELEQQKVWNYLKNLSWRIMGSYLCFGERSELKPL

SEQ ID NO: 2715 - protein, 200 aa, unidentified
MDSSTAHSPVFLVFPPEITASEYESTELSATTFSTQSPLQKLFARKMKILGTIQILFGIMTFSFGVIFLFTLLKPYPRFPFIFLSGYPFWGSVLFINSGAFLIAVKRKTTETLIILSRIMNFLSALGAIAGIILLTFGFILDQNYICGYSHQNSQCKAVTVLFLGILITLMTFSIIELFISLPFSILGCHSEDCDCEQCC

SEQ ID NO: 2716 - protein, 248 aa, unidentified
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGSVLFLPHSYIGNSGMSSKMTHDCGYEELLTS

SEQ ID NO: 2717 - protein, 147 aa, unidentified
MTSQPISNETIIMLPSNVINFSQAEKPEPTNQGQDSLKKRLQAKVKVIGVHSSLAGSILSALSALVGFILLSVNPAALNPASLQCKLDEKDIPTRLLLSYDYHSPYTMDCHRAKASLAGTLSLMLVSTVLEFCLAVLTAVLQWKQTV

SEQ ID NO: 2718 - protein, 240 aa, unidentified
MLLQSQTMGVSHSFTPKGITIPQREKPGHMYQNEDYLQNGLPTETTVLGTVQILCCLLISSLGAILVFAPYPSHFNPAISTTLMSGYPFLGALCFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 2719 - protein, 250 aa, unidentified
MNSMTSAVPVANSVLVVAPHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISGSLSVAAENQPYSYCLLSGSLGLNIVSAICSAVGVILFITDLSIPHPYAYPDYYPYAWGVNPGMAISGVLLVFCLLEFGIACASSHFGCQLVCCQSSNVSVIYPNIYAANPVITPEPVTSPPSYSSEIQANK

SEQ ID NO: 2720 - protein, 630 aa, unidentified
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 2721 - protein, 293 aa, unidentified
MATNESVSIFSSASLAVEYVDSLLPENPLQEPFKNAWNYMLNNYTKFQIATWGSLIVHEALYFLFCLPGFLFQFIPYMKKYKIQKDKPETWENQWKCFKVLLFNHFCIQLPLICGTYYFTEYFNIPYDWERMPRWYFLLARCFGCAVIEDTWHYFLHRLLHHKRIYKYIHKVHHEFQAPFGMEAEYAHPLETLILGTGFFIGIVLLCDHVILLWAWVTIRLLETIDVHSGYDIPLNPLNLIPFYAGSRHHDFHHMNFIGNYASTFTWWDRIFGTDSQYNAYNEKRKKFEKKTE

SEQ ID NO: 2722 - protein, 451 aa, unidentified
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLTPFTKVRLVGGSGPHEGRVEILHSGQWGTICDDRWEVRVGQVVCRSLGYPGVQAVHKAAHFGQGTGPIWLNEVFCFGRESSIEECKIRQWGTRACSHSEDAGVTCTL

SEQ ID NO: 2723 - protein, 1400 aa, unidentified
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIQGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARGMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 2724 - protein, 226 aa, unidentified
MNENLFASFIAPTILGLPAAVLIILFPPLLIPTSKYLINNRLITTQQWLIKLTSKQMMTMHNTKGRTWSLMLVSLIIFIATTNLLGLLPHSFTPTTQLSMNLAMAIPLWAGTVIMGFRSKIKNALAHFLPQGTPTPLIPMLVIIETISLLIQPMALAVRLTANITAGHLLMHLIGSATLAMSTINLPSTLIIFTILILLTILEIAVALIQAYVFTLLVSLYLHDNT

SEQ ID NO: 2725 - protein, 68 aa, unidentified
MPQLNTTVWPTMITPMLLTLFLITQLKMLNTNYHLPPSPKPMKMKNYNKPWEPKWTKICSLHSLPPQS

SEQ ID NO: 2726 - protein, 513 aa, unidentified
MFADRWLFSTNHKDIGTLYLLFGAWAGVLGTALSLLIRAELGQPGNLLGNDHIYNVIVTAHAFVMIFFMVMPIMIGGFGNWLVPLMIGAPDMAFPRMNNMSFWLLPPSLLLLLASAMVEAGAGTGWTVYPPLAGNYSHPGASVDLTIFSLHLAGVSSILGAINFITTIINMKPPAMTQYQTPLFVWSVLITAVLLLLSLPVLAAGITMLLTDRNLNTTFFDPAGGGDPILYQHLFWFFGHPEVYILILPGFGMISHIVTYYSGKKEPFGYMGMVWAMMSIGFLGFIVWAHHMFTVGMDVDTRAYFTSATMIIAIPTGVKVFSWLATLHGSNMKWSAAVLWALGFIFLFTVGGLTGIVLANSSLDIVLHDTYYVVAHFHYVLSMGAVFAIMGGFIHWFPLFSGYTLDQTYAKIHFTIMFIGVNLTFFPQHFLGLSGMPRRYSDYPDAYTTWNILSSVGSFISLTAVMLMIFMIWEAFASKRKVLMVEEPSMNLEWLYGCPPPYHTFEEPVYMKS

SEQ ID NO: 2727 - protein, 227 aa, unidentified
MAHAAQVGLQDATSPIMEELITFHDHALMIIFLICFLVLYALFLTLTTKLTNTNISDAQEMETVWTILPAIILVLIALPSLRILYMTDEVNDPSLTIKSIGHQWYWTYEYTDYGGLIFNSYMLPPLFLEPGDLRLLDVDNRVVLPIEAPIRMMITSQDVLHSWAVPTLGLKTDAIPGRLNQTTFTATRPGVYYGQCSEICGANHSFMPIVLELIPLKIFEMGPVFTL

SEQ ID NO: 2728 - protein, 261 aa, unidentified
MTHQSHAYHMVKPSPWPLTGALSALLMTSGLAMWFHFHSMTLLMLGLLTNTLTMYQWWRDVTRESTYQGHHTPPVQKGLRYGMILFITSEVFFFAGFFWAFYHSSLAPTPQLGGHWPPTGITPLNPLEVPLLNTSVLLASGVSITWAHHSLMENNRNQMIQALLITILLGLYFTLLQASEYFESPFTISDGIYGSTFFVATGFHGLHVIIGSTFLTICFIRQLMFHFTSKHHFGFEAAAWYWHFVDVVWLFLYVSIYWWGS

SEQ ID NO: 2729 - protein, 380 aa, unidentified
MTPMRKTNPLMKLINHSFIDLPTPSNISAWWNFGSLLGACLILQITTGLFLAMHYSPDASTAFSSIAHITRDVNYGWIIRYLHANGASMFFICLFLHIGRGLYYGSFLYSETWNIGIILLLATMATAFMGYVLPWGQMSFWGATVITNLLSAIPYIGTDLVQWIWGGYSVDSPTLTRFFTFHFILPFIIAALATLHLLFLHETGSNNPLGITSHSDKITFHPYYTIKDALGLLLFLLSLMTLTLFSPDLLGDPDNYTLANPLNTPPHIKPEWYFLFAYTILRSVPNKLGGVLALLLSILILAMIPILHMSKQQSMMFRPLSQSLYWLLAADLLILTWIGGQPVSYPFTIIGQVASVLYFTTILILMPTISLIENKMLKWA

SEQ ID NO: 2730 - protein, 318 aa, unidentified
MPMANLLLLIVPILIAMAFLMLTERKILGYMQLRKGPNVVGPYGLLQPFADAMKLFTKEPLKPATSTITLYITAPTLALTIALLLWTPLPMPNPLVNLNLGLLFILATSSLAVYSILWSGWASNSNYALIGALRAVAQTISYEVTLAIILLSTLLMSGSFNLSTLITTQEHLWLLLPSWPLAMMWFISTLAETNRTPFDLAEGESELVSGFNIEYAAGPFALFFMAEYTNIIMMNTLTTTIFLGTTYDALSPELYTTYFVTKTLLLTSLFLWIRTAYPRFRYDQLMHLLWKNFLPLTLALLMWYVSMPITISSIPPQT

SEQ ID NO: 2731 - protein, 347 aa, unidentified
MNPLAQPVIYSTIFAGTLITALSSHWFFTWVGLEMNMLAFIPVLTKKMNPRSTEAAIKYFLTQATASMILLMAILFNNMLSGQWTMTNTTNQYSSLMIMMAMAMKLGMAPFHFWVPEVTQGTPLTSGLLLLTWQKLAPISIMYQISPSLNVSLLLTLSILSIMAGSWGGLNQTQLRKILAYSSITHMGWMMAVLPYNPNMTILNLTIYIILTTTAFLLLNLNSSTTTLLLSRTWNKLTWLTPLIPSTLLSLGGLPPLTGFLPKWAIIEEFTKNNSLIIPTIMATITLLNLYFYLRLIYSTSITLLPMSNNVKMKWQFEHTKPTPFLPTLIALTTLLLPISPFMLMIL

SEQ ID NO: 2732 - protein, 115 aa, unidentified
MNFALILMINTLLALLLMIITFWLPQLNGYMEKSTPYECGFDPMSPARVPFSMKFFLVAITFLLFDLEIALLLPLPWALQTTNLPLMVMSSLLLIIILALSLAYEWLQKGLDWTE

SEQ ID NO: 2733 - protein, 459 aa, unidentified
MLKLIVPTIMLLPLTWLSKKHMIWINTTTHSLIISIIPLLFFNQINNNLFSCSPTFSSDPLTTPLLMLTTWLLPLTIMASQRHLSSEPLSRKKLYLSMLISLQISLIMTFTATELIMFYIFFETTLIPTLAIITRWGNQPERLNAGTYFLFYTLVGSLPLLIALIYTHNTLGSLNILLLTLTAQELSNSWANNLMWLAYTMAFMVKMPLYGLHLWLPKAHVEAPIAGSMVLAAVLLKLGGYGMMRLTLILNPLTKHMAYPFLVLSLWGMIMTSSICLRQTDLKSLIAYSSISHMALVVTAILIQTPWSFTGAVILMIAHGLTSSLLFCLANSNYERTHSRIMILSQGLQTLLPLMAFWWLLASLANLALPPTINLLGELSVLVTTFSWSNITLLLTGLNMLVTALYSLYMFTTTQWGSLTHHINNMKPSFTRENTLMFMHLSPILLLSLNPDIITGFSS

SEQ ID NO: 2734 - protein, 98 aa, unidentified
MPLIYMNIMLAFTISLLGMLVYRSHLMSSLLCLEGMMLSLFIMATLMTLNTHSLLANIVPIAMLVFAACEAAVGLALLVSISNTYGLDYVHNLNLLQC

SEQ ID NO: 2735 - protein, 603 aa, unidentified
MTMHTTMTTLTLTSLIPPILTTLVNPNKKNSYPHYVKSIVASTFIISLFPTTMFMCLDQEVIISNWHWATTQTTQLSLSFKLDYFSMMFIPVALFVTWSIMEFSLWYMNSDPNINQFFKYLLIFLITMLILVTANNLFQLFIGWEGVGIMSFLLISWWYARADANTAAIQAILYNRIGDIGFILALAWFILHSNSWDPQQMALLNANPSLTPLLGLLLAAAGKSAQLGLHPWLPSAMEGPTPVSALLHSSTMVVAGIFLLIRFHPLAENSPLIQTLTLCLGAITTLFAAVCALTQNDIKKIVAFSTSSQLGLMMVTIGINQPHLAFLHICTHAFFKAMLFMCSGSIIHNLNNEQDIRKMGGLLKTMPLTSTSLTIGSLALAGMPFLTGFYSKDHIIETANMSYTNAWALSITLIATSLTSAYSTRMILLTLTGQPRFPTLTNINENNPTLLNPIKRLAAGSLFAGFLITNNISPASPFQTTIPLYLKLTALAVTFLGLLTALDLNYLTNKLKMKSPLCTFYFSNMLGFYPSITHRTIPYLGLLTSQNLPLLLLDLTWLEKLLPKTISQHQISTSIITSTQKGMIKLYFLSFFFPLILTLLLIT

SEQ ID NO: 2736 - protein, 174 aa, unidentified
MMYALFLLSVGLVMGFVGFSSKPSPIYGGLVLIVSGVVGCVIILNFGGGYMGLMVFLIYLGGMMVVFGYTTAMAIEEYPEAWGSGVEVLVSVLVGLAMEVGLVLWVKEYDGVVVVVNFNSVGSWMIYEGEGSGLIREDPIGAGALYDYGRWLVVVTGWTLFVGVYIVIEIARGN

SEQ ID NO: 2737 - protein, 389 aa, unidentified
MGASDPEVAPWARGGAAGMAGAGAGAGARGGAAAGVEARARDPPPAHRAHPRHPRPAAQPSARRMDGGSGGLGSGDNAPTTEALFVALGAGVTALSHPLLYVKLLIQVGHEPMPPTLGTNVLGRKVLYLPSFFTYAKYIVQVDGKIGLFRGLSPRLMSNALSTVTRGSMKKVFPPDEIEQVSNKDDMKTSLKKVVKETSYEMMMQCVSRMLAHPLHVISMRCMVQFVGREAKYSGVLSSIGKIFKEEGLLGFFVGLIPHLLGDVVFLWGCNLLAHFINAYLVDDSVSDTPGGLGNDQNPGSQFSQALAIRSYTKFVMGIAVSMLTYPFLLVGDLMAVNNCGLQAGLPPYSPVFKSWIHCWKYLSVQGQLFRGSSLLFRRVSSGSCFALE

SEQ ID NO: 2738 - protein, 303 aa, unidentified
MADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 2739 - protein, 582 aa, unidentified
MAARSWQDELAQQAEEGSARLREMLSVGLGFLRTELGLDLGLEPKRYPGWVILVGTGALGLLLLFLLGYGWAAACAGARKKRRSPPRKREEAAAVPAAAPDDLALLKNLRSEEQKKKNRKKLSEKPKPNGRTVEVAEGEAVRTPQSVTAKQPPEIDKKNEKSKKNKKKSKSDAKAVQNSSRHDGKEVDEGAWETKISHREKRQQRKRDKVLTDSGSLDSTIPGIENTITVTTEQLTTASFPVGSKKNKGDSHLNVQVSNFKSGKGDSTLQVSSGLNENLTVNGGGWNEKSVKLSSQISAGEEKWNSVSPASAGKRKTEPSAWSQDTGDANTNGKDWGRSWSDRSIFSGIGSTAEPVSQSTTSDYQWDVSRNQPYIDDEWSGLNGLSSADPNSDWNAPAEEWGNWVDEERASLLKSQEPIPDDQKVSDDDKEKGEGALPTGKSKKKKKKKKKQGEDNSTAQDTEELEKEIREDLPVNTSKTRPKQEKAFSLKTISTSDPAEVLVKNSQPIKTLPPATSTEPSVILSKSDSDKSSSQVPPILQETDKSKSNTKQNSVPPSQTKSETSWESPKQIKKKKKARRET

SEQ ID NO: 2740 - protein, 166 aa, unidentified
MSEPQPRGAERDLYRDTWVRYLGYANEVGEAFRSLVPAAVVWLSYGVASSYVLADAIDKGKKAGEVPSPEAGRSARVTVAVVDTFVWQALASVAIPGFTINRVCAASLYVLGTATRWPLAVRKWTTTALGLLTIPIIIHPIDRSVDFLLDSSLRKLYPTVGKPSSS

SEQ ID NO: 2741 - protein, 385 aa, unidentified
MSLILNILREMLEYFGVPVEQVLLIWENKDYGSTRSIVRIIGKMLPLEPCRRPNFELIPLLNSVDSDNCGSMVPSFADILYVANDEEASYLRFRNSIWKNEEEKVEIFHPLRLVRDPLSPAVRQKETVKNDLPVNEAAIRKIAALENELTFLRSQIAAIVEMQELKNSTNSSSFGLSDERISLGQLSSSRAAHLSVDPDQLPGSVLSPPPPPPLPPQFSSLQPPCFPPVQPGSNNICDSDNPATEMSKQNPAANKTNYSHHSKSQRNKDIPNMLDVLKDMNKVKLRAIERSPGGRPIHKRKRQNSHWDPVSLISHALKQKFAFQEDDSFEKENRSWESSPFSSPETSRFGHHISQSEGQRTKEEMVNTKAVDQGISNTSLLNSRI

SEQ ID NO: 2742 - protein, 935 aa, unidentified [sequence omitted]

SEQ ID NO: 2743 - protein, 978 aa, unidentified
MGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 2744 - protein, 350 aa, unidentified [sequence omitted]

SEQ ID NO: 2745 - protein, 362 aa, unidentified
MSENGSFANCCEAGGWAVRPGWSGAGSARPSRTPRPPWVAPALSAVLIVTTAVDVVGNLLVILSVLRNRKLRNAGNLFLVSLALADLVVAFYPYPLILVAIFYDGWALGEEHCKASAFVMGLSVIGSVFNITAIAINRYCYICHSMAYHRIYRRWHTPLHICLIWLLTVVALLPNFFVGSLEYDPRIYSCTFIQTASTQYTAAVVVIHFLLPIAVVSFCYLRIWVLVLQARRKAKPESRLCLKPSDLRSFLTMFVVFVIFAICWAPLNCIGLAVAINPQEMAPQIPEGLFVTSYLLAYFNSCLNAIVYGLLNQNFRREYKRILLALWNPRHCIQDASKGSHAEGLQSPAPPIIGVQHQADAL

SEQ ID NO: 2746 - protein, 1270 aa, unidentified
MTDDNSDDKIEDELQTFFTSDKDGNTHAYNPKSPPTQNSSASSVNWNSANPDDMVVDYETDPAVVTGENISLSLQGVEVFGHEKSSSDFISKQVLDMHKDSICQCPALVGTEKPKYLQHSCHSLEAVEGQSVEPSLPFVWKPNDNLNCAGYCDALELNQTFDMTVDKVNCTFISHHAIGKSQSFHTAGSLPPTGRRSGSTSSLSYSTWTSSHSDKTHARETTYDRESFENPQVTPSEAQDMTYTAFSDVVMQSEVFVSDIGNQCACSSGKVTSEYTDGSQQRLVGEKETQALTPVSDGMEVPNDSALQEFFCLSHDESNSEPHSQSSYRHKEMGQNLRETVSYCLIDDECPLMVPAFDKSEAQVLNPEHKVTETEDTQMVSKGKDLGTQNHTSELILSSPPGQKVGSSFGLTWDANDMVISTDKTMCMSTPVLEPTKVTFSVSPIEATEKCKKVEKGNRGLKNIPDSKEAPVNLCKPSLGKSTIKTNTPIGCKVRKTEIISYPRPNFKNVKAKVMSRAVLQPKDAALSKVTPRPQQTSASSPSSVNSRQQTVLSRTPRSDLNADKKAEILINKTHKQQFNKLITSQAVHVTTHSKNASHRVPRTTSAVKSNQEDVDKASSSNSACETGSVSALFQKIKGILPVKMESAECLEMTYVPNIDRISPEKKGEKENGTSMEKQELKQEIMNETFEYGSLFLGSASKTTTTSGRNISKPDSCGLRQIAAPKAKVGPPVSCLRRNSDNRNPSADRAVSPQRIRRVSSSGKPTSLKTAQSSWVNLPRPLPKSKASLKSPALRRTGSTPSIASTHSELSTYSNNSGNAAVIKYEEKPPKPAFQNGSSGSFYLKPLVSRAHVHLMKTPPKGPSRKNLFTALNAVEKSRQKNPRSLCIQPQTAPDALPPEKTLELTQYKTKCENQSGFILQLKQLLACGNTKFEALTVVIQHLLSEREEALKQHKTLSQELVNLRGELVTASTTCEKLEKARNELQTVYEAFVQQHQAEKTERENRLKEFYTREYEKLRDTYIEEAEKYKMQLQEQFDNLNAAHETSKLEIEASHSEKLELLKKAYEASLSEIKKGHEIEKKSLEDLLSEKQESLEKQINDLKSENDALNEKLKSEEQKRRAREKANLKNPQIMYLEQELESLKAVLEIKNEKLHQQDIKLMKMEKLVDNNTALVDKLKRFQQENEELKARMDKHMAISRQLSTEQAVLQESLEKESKVNKRLSMENEELLWKLHNGDLCSPKRSPTSSAIPLQSPRNSGSFPSPSISPR

SEQ ID NO: 2747 - protein, 466 aa, unidentified
MLLGGPPRSPRSGTSPKGPWSSTGHVQFGKSPQTWPRRTRPRSPEPAAPSGVRGSTWTRRRDSPRRAGPTALSRYVGHLWMGRRPPSPEARGPVPRSSAASRARRSLASPGISPGPLTATIGGAVAGGGPRQGRAEAHKEVFPGQRVGKMAAPMELFCWSGGWGLPSVDLDSLAVLTYARFTGAPLKVHKISNPWQSPSGTLPALRTSHGEVISVPHKIITHLRKEKYNADYDLSARQGADTLAFMSLLEEKLLPVLVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 2748 - protein, 1255 aa, unidentified
MTPGTQSPFFLLLLLTVLTVVTGSGHASSTPGGEKETSATQRSSVPSSTEKNAVSMTSSVLSSHSPGSGSSTTQGQDVTLAPATEPASGSAATWGQDVTSVPVTRPALGSTTPPAHDVTSAPDNKPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDTRPAPGSTAPPAHGVTSAPDNRPALGSTAPPVHNVTSASGSASGSASTLVHNGTSARATTTPASKSTPFSIPSHHSDTPTTLASHSTKTDASSTHHSSVPPLTSSNHSTSPQLSTGVSFFFLSFHISNLQFNSSLEDPSTDYYQELQRDISEMFLQIYKQGGFLGLSNIKFRPGSVVVQLTLAFREGTINVHDVETQFNQYKTEAASRYNLTISDVSVSDVPFPFSAQSGAGVPGWGIALLVLVCVLVALAIVYLIALAVCQCRRKNYGQLDIFPARDTYHPMSEYPTYHTHGRYVPPSSTDRSPYEKVSAGNGGSSLSYTNPAVAATSANL

SEQ ID NO: 2749 - protein, 512 aa, unidentified
MKAIIHLTLLALLSVNTATNQGNSADAVTTTETATSGPTVAAADTTETNFPETASTTANTPSFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQLILTIVGTIAGIVILSMIIALIVTARSNNKTKHIEEENLIDEDFQNLKLRSTGFTNLGAEGSVFPKVRITASRDSQMQNPYSRHSSMPRPDY

SEQ ID NO: 2750 - protein, 334 aa, unidentified
MLALAKILLISTLFYSLLSGSHGKENQDINTTQNIAEVFKTMENKPISLESEANLNSDKENITTSNLKASHSPPLNLPNNSHGITDFSSNSSAEHSLGSLKPTSTISTSPPLIHSFVSKVPWNAPIADEDLLPISAHPNATPALSSENFTWSLVNDTVKTPDNSSITVSILSSEPTSPSVTPLIVEPSGWLTTNSDSFTGFTPYQEKTTLQPTLKFTNNSKLFPNTSDPQKENRNTGIVFGAILGAILGVSLLTLVGYLLCGKRKTDSFSHRRLYDDRNEPVLRLDNAPEPYDVSFGNSSYYNPTLNDSAMPESEENARDGIPMDDIPPLRTSV

SEQ ID NO: 2751 - protein, 4493 aa, unidentified
MPRPGTMALCLLTLVLSLLPPQAAAEQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYGLVGAGVVLMLIILVALLMLVFRSKREVKRQKYRLSQLYKWQEEDSGPAPGTFQNIGFDICQDDDSIHLESIYSNFQPSLRHIDPETKIRIQRPQVMTTSF

SEQ ID NO: 2752 - protein, 566 aa, unidentified
MKMQKGNVLLMFGLLLHLEAATNSNETSTSANTGSSVISSGASTATNSGSSVTSSGVSTATISGSSVTSNGVSIVTNSEFHTTSSGISTATNSEFSTVSSGISIATNSESSTTSSGASTATNSESSTPSSGASTATNSDSSTTSSGASTATNSDSSTTSSEASTATNSESSTTSSGASTATNSESSTVSSRASTATNSESSTTSSGASTATNSESRTTSNGAGTATNSESSTTSSGASTATNSESSTPSSGAGTATNSESSTTSSGAGTATNSESSTVSSGISTVTNSESSTPSSGANTATNSESSTTSSGANTATNSDSSTTSSGASTATNSESSTTSSGASTATNSESSTTSSGASTATNSGSSTTSSGTSTATNSESSTVSSGASTATTSESSTTSSGASTATNSESSTVSSGASTATNSESSTTSSGANTATNSGSSVTSAGSGTAALTGMHTTSHSASTAVSEAKPGGSLVPWEIFLITLVSVVAAVGLFAGLFFCVRNSLSLRNTFNTAVYHPHGLNHGLGPGPGGNHGAPHRPRWSPNWFWRRPVSSIAMEMSGRNSGP

SEQ ID NO: 2753 - protein, 1773 aa, unidentified
MRRGNISPAFWFLWLLLFGLLGPSSENTTAFTKGSDTTTASITGSETTMASTMASTSALTTGSKITTDSTTGSETTSASTMASTAAFTTGSETNTASTTDSGTTIASTRTFTTGSDTTTGSTAGSETIVASTTVSGTTTTFTIASTTVPETTMASSTTSTAGSEKTMASSIISETTMASTTGSETATVSTTGSETTTTSTASSEATKVSTTGSETTTASTAGSETTTTSTSMAGSEATTTSTADSKVITASSMSSETTVAPAAGSNTTTASTTGSETTTILIKASETTTASTAGSETTTPSPTGSQTTIVSISGSEITTTSTAGSENTTVSSAGSGTTTASMAGSETTVSTAGSETTTVSITGTETTMVSAMGSETTTNSTTSSETTVTSTAGSETTTVSTVGSETTTAYTADSETTAASTTGSEMTTVFTAGSETITPSTAGSETTTVSTAGSETTTVSTTGSETTTASTAHSETTAASTMGSETTKVSTAGSETTVSTAGSETTAASTEDSETNTAFTEDSKTTTASTTGFETTAASTTGSEPTMASTMGSETTMASTIGPETTKVSTASSEVTTVFAAGSETIRASTVGSETTTVSTTGSETTTASIMGSETSTDSTTGSETTTASTEGSETTTASTEGSEATTVSTTGSETTTVSITDSETTTTCTEGSEMTAVSTTVFETTTASTEGSEITIASTSDSETTTASTEGSETTTVTTAGSETKTAYTTGSETTTASNTGLETTTVFTIGSDTTTASTEGSETTAVSATGSEMTTVSTEGSENTTVSTTGSETTTVSTTGLETTTTSTEGSEMTTVSTTGAETTTDSTEGSGTTAASTAGSETTTVSTADSENTTASTADSETTSASTTGSETTTASTTSSETTTASTEGSETTTVSTTDSETTMVSTTGSERTITSTEGSETTTVSATGSETTVSTEGSGTTTVSITGSETTKVSTTGSETTTTSTEGSEITTASITGSETTTASTEGSETTTASTEGSETTSASTTGSETTTASTTSSETTMASIMGSETTMASTIGSETTKVSTASSKMTTVFTENSETTIASTTASETTTVSTAGSETIPASTAGSETTTTTSTEGSETTTASTEGSETTTASTESSETTTATTIGSETTTASTEGSETTTTSTEGSETTTASTEGSEITTVSTTGSETTTASTEGSETTTASTEGSELTTVSTTGSETITVSAEGSETTTVTTMGSETTTASTAGSETTTVSTAGSETTTASIEGSETTTVSSTGSETTTVSTTGTETTITSTEGSETTTVTTAGSETTAVYTTGSETTTTSTEGSETTTVSTTGSETTTASTADLETTTVSTSGSGTTTASTAGSETTTVYITGSKTTTASTEGSEATTVSTTSSETTTASTTGSEMTTVFTTVSETTTVSTIGSEATTSSAAGSEATTTSTEGSETTTASTAGSETTTASTAGSETTTASTSGSETNTACTTGSETSTPSSAGSETNTAFIIGSESTIASTASLEPTATSLTGSETTTVSITASGATAASTTVSSTTFVLTKATDVSIQPITNTPMSGTRTTGTRLTASSSVTMAPGMDFTASAASHTVPGIVLNTSGLGTSTMGASSTTSAHGVRTTTGSTREPTSSTFQETGPVSMGTNTVSMSHTPTNVIKPSGYLQPWAIILISLAAVVAAVGLSVGLSFCLRNLFFPLRYCGIYYPHGHSHSLGLDLNLGLGSGTFHSLGNALVHGGELEMGHGGTHGFGYGVGHGLSHIHGDGYGVNHGGHYGHGGGH

SEQ ID NO: 2754 - protein, 2169 aa, unidentified
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETVTQETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTVDPEGQSPATFSRTSTQDTTAFSKNHQTQSVETTRVSQINTLNTLTPVTTSTVLSSPSGFNPSGTVSQETFPSGETTISSPSSVSNTFLVTSKVFRMPISRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTRAAGTIPRVPSKVSAIGEPGEPTTYSSHSTTLPKTTGAGAQTQWTQETGTTGEALLSSPSYSVIQMIKTATSPSSSPMLDRHTSQQITTAPSTNHSTIHSTSTSPQESPAVSQRGHTRAPQTTQESQTTRSVSPMTDTKTVTTPGSSFTASGHSPSEIVPQDAPTISAATTFAPAPTGNGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTGTSRGSDTISLASQATDTFSTVPPTPPSITSSGLTSPQTQTHTLSPSGSGKTFTTALISNATPLPVTSTSSASTGHATPLAVSSATSASTVSSDSPLKMETSGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 2755 - protein, 352 aa, unidentified
MESGGRPSLCQFILLGTTSVVTAALYSVYRQKARVSQELKGAKKVHLGEDLKSILSEAPGKCVPYAVIEGAVRSVKETLNSQFVENCKGVIQRLTLQEHKMVWNRTTHLWNDCSKIIHQRTNTVPFDLVPHEDGVDVAVRVLKPLDSVDLGLETVYEKFHPSIQSFTDVIGHYISGERPKGIQETEEMLKVGATLTGVGELVLDNNSVRLQPPKQGMQYYLSSQDFDSLLQRQESSVRLWKVLALVFGFATCATLFFILRKQYLQRQERLRLKQMQEEFQEHEAQLLSRAKPEDRESLKSACVVCLSSFKSCVFLECGHVCSCTECYRALPEPKKCPICRQAITRVIPLYNS

SEQ ID NO: 2756 - protein, 869 aa, unidentified
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEWSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 2757 - protein, 400 aa, unidentified
MASEKPLAAVTCTAPVNIAVIKYWGKRDEELVLPINSSLSVTLHQDQLKTTTTAVISKDFTEDRIWLNGREEDVGQPRLQACLREIRCLARKRRNSRDGDPLPSSLSCKVHVASVNNFPTAAGLASSAAGYACLAYTLARVYGVESDLSEVARRGSGSACRSLYGGFVEWQMGEQADGKDSIARQVAPESHWPELRVLILVVSAEKKLTGSTVGMRASVETSPLLRFRAESVVPARMAEMARCIRERDFPSFAQLTMKDSNQFHATCLDTFPPISYLNAISWRIIHLVHRFNAHHGDTKVAYTFDAGPNAVIFTLDDTVAEFVAAVWHGFPPGSNGDTFLKGLQVRPAPLSAELQAALAMEPTPGGVKYIIVTQVGPGPQILDDPCAHLLGPDGLPKPAA

SEQ ID NO: 2758 - protein, 442 aa, unidentified
MALPSRILLWKLVLLQSSAVLLHSGSSVPAAAGSSVVSESAVSWEAGARAVLRCQSPRMVWTQDRLHDRQRVLHWDLRGPGGGPARRLLDLYSAGEQRVYEARDRGRLELSASAFDDGNFSLLIRAVEETDAGLYTCNLHHHYCHLYESLAVRLEVTDGPPATPAYWDGEKEVLAVARGAPALLTCVNRGHVWTDRHVEEAQQVVHWDRQPPGVPHDRADRLLDLYASGERRAYGPLFLRDRVAVGADAFERGDFSLRIEPLEVADEGTYSCHLHHHYCGLHERRVFHLTVAEPHAEPPPRGSPGNGSSHSGAPGPDPTLARGHNVINVIVPESRAHFFQQLGYVLATLLLFILLLVTVLLAARRRRGGYEYSDQKSGKSKGKDVNLAEFAVAAGDQMLYRSEDIQLDYKNNILKERAELAHSPLPAKYIDLDKGFRKENCK

SEQ ID NO: 2759 - protein, 322 aa, unidentified
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGQPRRSRDVSCSRSHAYYVCAWDRRLAVAILTAINLLAYVADLVHSAHLVFVKV

SEQ ID NO: 2760 - protein, 307 aa, unidentified
MGSTMEPPGGAYLHLGAVTSPVGTARVLQLAFGCTTFSLVAHRGGFAGVQGTFCMAAWGFCFAVSALVVACEFTRLHGCLRLSWGNFTAAFAMLATLLCATAAVLYPLYFARRECSPEPAGCAARDFRLAASVFAGLLFLAYAVEVALTRARPGQVSSYMATVSGLLKIVQAFVACIIFGALVHDSRYGRYVATQWCVAVYSLCFLATVAVVALSVMGHTGGLGCPFDRLVVVYTFLAVLLYLSAAVIWPVFCFDPKYGEPKRPPNCARGSCPWDSQLVVAIFTYVNLLLYVVDLAYSQRIRFVPSL

SEQ ID NO: 2761 - protein, 235 aa, unidentified
MRTQVYEGLCKNYFSLAVLQRDRIKLLFFDILVFLSVFLLFLLFLVDIMANNTTSLGSPWPENFWEDLIMSFTVSMAIGLVLGGFIWAVFICLSRRRRASAPISQWSSSRRSRSSYTHGLNRTGFYRHSGCERRSNLSLASLTFQRQASLEQANSFPRKSSFRASTFHPFLQCPPLPVETESQLVTLPSSNISPTISTSHSLSRPDYWSSNSLRVGLSTPPPPAYESIIKAFPDS

SEQ ID NO: 2762 - protein, 313 aa, unidentified
MALRICVTYTPALPIGLCTRCCLCLEQSPSWCHCLRGVSFLTFHLHQSVPLGDRDSLLMFTRQAGHFVEGSKAGRSRGRLCLSQALRVAVRGAFVSLWFAAGAGDRERNKGDKGAQTGAGLSQEAEDVDVSRARRVTDAPQGTLCGTGNRNSGSQSARVVGVAHLGEAFRVGVEQAISSCPEEVHGRHGLSMEIMWARMDVALRSPGRGLLAGAGALCMTLAESSCPDYERGRRACLTLHRHPTPHCSTWGLPLRVAGSWLTVVTVEALGGWRMGVRRTGQVGPTMHPPPVSGASPLLLHHLLLLLLIIILTC

SEQ ID NO: 2763 - protein, 1914 aa, unidentified
MGDVKLVASSHISKTSLSVDPSRVDSMPLTEAPAFILPPRNLCIKEGATAKFEGRVRGYPEPQVTWHRNGQPITSGGRFLLDCGIRGTFSLVIHAVHEEDRGKYTCEATNGSGARQVTVELTVEGSFAKQLGQPVVSKTLGDRFSAPAVETRPSIWGECPPKFATKLGRVVVKEGQMGRFSCKITGRPQPQVTWLKGNVPLQPSARVSVSEKNGMQVLEIHGVNQDDVGVYTCLVVNGSGKASMSAELSIQGLDSANRSFVRETKATNSDVRKEVTNVISKESKLDSLEAAAKSKNCSSPQRGGSPPWAANSQPQPPRESKLESCKDSPRTAPQTPVLQKTSSSITLQAARVQPEPRAPGLGVLSPSGEERKRPAPPRPATFPTRQPGLGSQDVVSKAANRRIPMEGQRDSAFPKFESKPQSQEVKENQTVKFRCEVSGIPKPEVAWFLEGTPVRRQEGSIEVYEDAGSHYLCLLKARTRDSGTYSCTASNAQGQLSCSWTLQVERLAVMEVAPSFSSVLKDCAVIEGQDFVLQCSVRGTPVPRITWLLNGQPIQYARSTCEAGVAELHIQDALPEDHGTYTCLAENALGQVSCSAWVTVHEKKSSRKSEYLLPVAPSKPTAPIFLQGLSDLKVMDGSQVTMTVQVSGNPPPEVIWLHNGNEIQESEDFHFEQRGTQHSLCIQEVFPEDTGTYTCEAWNSAGEVRTQAVLTVQEPHDGTQPWFISKPRSVTASLGQSVLISCAIAGDPFPTVHWLRDGKALCKDTGHFEVLQNEDVFTLVLKKVQPWHAGQYEILLKNRVGECSCQVSLMLQNSSARALPRGREPASCEDLCGGGVGADGGGSDRYGSLRPGWPARGQGWLEEEDGEDVRGVLKRRVETRQHTEEAIRQQEVEQLDFRDLLGKKVSTKTLSEDDLKEIPAEQMDFRANLQRQVKPKTVSEEERKVHSPQQVDFRSVLAKKGTSKTPVPEKVPPPKPATPDFRSVLGGKKKLPAENGSSSAETLNAKAVESSKPLSNAQPSGPLKPVGNAKPAETLKPMGNAKPAETLKPMGNAKPDENLKSASKEELKKDVKNDVNCKRGHAGTTDNEKRSESQGTAPAFKQKLQDVHVAEGKKLLLQCQVSSDPPATIIWTLNGKTLKTTKFIILSQEGSLCSVSIEKALPEDRGLYKCVAKNDAGQAECSCQVTVDDAPASENTKAPEMKSRRPKSSLPPVLGTESDATVKKKPAPKTPPKAAMPPQIIQFPEDQKVRAGESVELFGKVTGTQPITCTWMKFRKQIQESEHMKVENSENGSKLTILAARQEHCGCYTLLVENKLGSRQAQVNLTVVDKPDPPAGTPCASDIRSSSLTLSWYGSSYDGGSAVQSYSIEIWDSANKTWKELATCRSTSFNVQDLLPDHEYKFRVRAINVYGTSEPSQESELTTVGEKPEEPKDEVEVSDDDEKEPEVDYRTVTINTEQKVSDFYDIEERLGSGKFGQVFRLVEKKTRKVWAGKFFKAYSAKEKENIRQEISIMNCLHHPKLVQCVDAFEEKANIVMVLEIVSGGELFERIIDEDFELTERECIKYMRQISEGVEYIHKQGIVHLDLKPENIMCVNKTGTRIKLIDFGLARRLENAGSLKVLFGTPEFVAPEVINYEPIGYATDMWSIGVICYILVSGLSPFMGDNDNETLANVTSATWDFDDEAFDEISDDAKDFISNLLKKDMKNRLDCTQCLQHPWLMKDTKNMEAKKLSKDRMKKYMARRKWQKTGNAVRAIGRLSSMAMISGLSGRKSSTGSPTSPLNAEKLESEEDVSQAFLEAVAEEKPHVKPYFSKTIRDLEVVEGSAARFDCKIEGYPDPEVVWFKDDQSIRESRHFQIDYDEDGNCSLIISDVCGDDDAKYTCKAVNSLGEATCTAELIVETMEEGEGEGEEEEE

SEQ ID NO: 2764 - protein, 819 aa, unidentified
MSGTSKESLGHGGLPGLGKTCLTTMDTKLNMLNEKVDQLLHFQEDVTEKLQSMCRDMGHLERGLHRLEASRAPGPGGADGVPHIDTQAGWPEVLELVRAMQQDAAQHGARLEALFRMVAAVDRAIALVGATFQKSKVADFLMQGRVPWRRGSPGDSPEENKERVEEEGGKPKHVLSTSGVQSDAREPGEESQKADVLEGTAERLPPIRASGLGADPAQAVVSPGQGDGVPGPAQAFPGHLPLPTKVEAKAPETPSENLRTGLELAPAPGRVNVVSPSLEVAPGAGQGASSSRPDPEPLEEGTRLTPGPGPQCPGPPGLPAQARATHSGGETPPRISIHIQEMDTPGEMLMTGRGSLGPTLTTEAPAAAQPGKQGPPGTGRCLQAPGTEPGEQTPEGARELSPLQESSSPGGVKAEEEQRAGAEPGTRPSLARSDDNDHEVGALGLQQGKSPGAGNPEPEQDCAARAPVRAEAVRRMPPGAEAGSVVLDDSPAPPAPFEHRVVSVKETSISAGYEVCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 2765 - protein, 388 aa, unidentified
MLKVKRLEEFNTCYNSNQLEKMAFFQCREEVEKVKCFLEKNSGDQDSRSGHNEAKEVWSNADLTERMPVKSKRTSALAVDIPAPPAPFDHRIVTAKQGAVNSFYTVSKTEILGGGRFGQVHKCEETATGLKLAAKIIKTRGMKDKEEVKNEISVMNQLDHANLIQLYDAFESKNDIVLVMEYVDGGELFDRIIDESYNLTELDTILFMKQICEGIRHMHQMYILHLDLKPENILCVNRDAKQIKIIDFGLARRYKPREKLKVNFGTPEFLAPEVVNYDFVSFPTDMWSVGVIAYMLLSGLSPFLGDNDAETLNNILACRWDLEDEEFQDISEEAKEFISKLLIKEKSWRISASEALKHPWLSDHKLHSRLNAQKKKNRGSDAQDFVTK

SEQ ID NO: 2766 - protein, 2061 aa, unidentified
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 2767 - protein, 1151 aa, unidentified
MEVVDETEALQRFFEGHDINGALEPSNIDTSILEEYISKEDASDLCFPDISAPASSASYSHGQPAMPGSSGVHHLSPPGGGPSPGRHGPLPPPGYGTPLNCNNNNGMGAAPKPFPGGTGPPIKAEPKAPYAPGTLPDSPPDSGSEAYSPQQVNEPHLLRTITPETLCHVGVPSRLEHPPPPPAHLPGPPPPPPPPPHYPVLQRDLYMKAEPPIPHYAAMGQGLVPTDLHHTQQSQMLHQLLQQHGAELPTHPSKKRKHSESPPSTLNAQMLNGMIKQEPGTVTALPLHPTRAPSPPWPPQGPLSPGPGSLPLSIARVQTPPWHPPGAPSPGLLQDSDSLSGSYLDPNYQSIKWQPHQQNKWATLYDANYKELPMLTYRVDADKGFNFSVGDDAFVCQKKNHFQVTVYIGMLGEPKYVKTPEGLKPLDCFYLKLHGVKLEALNQSINIEQSQSDRSKRPFNPVTVNLPPEQVTKVTVGRLHFSETTANNMRKKGKPNPDQRYFMLVVALQAHAQNQNYTLAAQISERIIVRASNPGQFESDSDVLWQRAQVPDTVFHHGRVGINTDRPDEALVVHGNVKVMGSLMHPSDLRAKEHVQEVDTTEQLKRISRMRLVHYRYKPEFAASAGIEATAPETGVIAQEVKEILPEAVKDTGDMVFANGKTIENFLVVNKERIFMENVGAVKELCKLTDNLETRIDELERWSHKLAKLRRLDSLKSTGSSGAFSHAGSQFSRAGSVPHKKRPPKVASKSSSVVPDQACISQRFLQGTIIALVVVMAFSVVSMSTLYVLSLRTEEDLVDTDGSFAVSTSCLLALLRPQPPGGSEALCPWSSQSFGTTQLRQSPLTTGLPGIQPSLLLVTTSLTSSAPGSAVRTLDMCSSHPCPVICCSSPTTNPTTGPSLGPSFNPGHVLSPSPSPSTNRSGPSQMALLPVTNIRAKSWGLSVNGIGHSKHHKSLEPLASPAVPFPGGQGKAKNSPSLGFHGRARRGALQSSVGPAEPTWAQGQSASLLAEPVPSLTSIQVLENSMSITSQYCAPGDACRPGNFTYHIPVSSGTPLHLSLTLQMNSSSPVSVVLCSLRSKEEPCEEGSLPQSLHTHQDTQGTSHRWPITILSFREFTYHFRVALLGQANCSSEALAQPATDYHFHFYRLCD

SEQ ID NO: 2768 - protein, 583 aa, unidentified
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 2769 - protein, 972 aa, unidentified
MATRGHVQDPNDRRLRPIYDYLDNGNNKMAIQQADKLLKKHKDLHCAKVLKAIGLQRTGKQEEAFTLAQEVAALEPTDDNSLQALTILYREMHRPELVTKLYEAAVKKVPNSEEYHSHLFMAYARVGEYKKMQQAGMALYKIVPKNPYYFWSVMSLIMQSISAQDENLSKTMFLPLAERMVEKMVKEDKIEAEAEVELYYMILERLGKYQEALDVIRGKLGEKLTSEIQSRENKCMAMYKKLSRWPECNALSRRLLLKNSDDWQFYLTYFDSVFRLIEEAWSPPAEGEHSLEGEVHYSAEKAVKFIEDRITEESKSSRHLRGPHLAKLELIRRLRSQGCNDEYKLGDPEELMFQYFKKFGDKPCCFTDLKVFVDLLPATQCTKFINQLLGVVPLSTPTEDKLALPADIRALQQHLCVVQLTRLLGLYHTMDKNQKLSVVRELMLRYQHGLEFGKTCLKTELQFSDYYCLLAVHALIDVWRETGDETTVWQALTLLEEGLTHSPSNAQFKLLLVRIYCMLGAFEPVVDLYSSLDAKHIQHDTIGYLLTRYAESLGQYAAASQSCNFALRFFHSNQKDTSEYIIQAYKYGAFEKIPEFIAFRNRLNNSLHFAQVRTERMLLDLLLEANISTSLAESIKSMNLRPEEDDIPWEDLRDNRDLNVFFSWDPKDRDVSEEHKKLSLEEETLWLRIRSLTLRLISGLPSLNHPVEPKNSEKTAENGVSSRIDILRLLLQQLEATLETGKRFIEKDIQYPFLGPVPTRMGGFFNSGCSQCQISSFYLVNDIYELDTSGLEDTMEIQERIENSFKSLLDQLKDVFSKCKGDLLEVKDGNLKTHPTLLENLVFFVETISVILWVSSYCESVLRPYKLNLQKKKKKKKETSIIMPPVFTSFQDYVTGLQTLISNVVDHIKGLETHLIALKLEELILEDTSLSPEERKFSKTVQGKVQSSYLHSLLEMGELLKKRLETTKKLKI

SEQ ID NO: 2770 - protein, 740 aa, unidentified
MAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKEYTFRLDVEEGVGIPRIPVHPIGYNDAEILLRYLGGIAPPDKSWKGALNVSYSIGPGFTGSDSFRKVRMHVYNINKITRIYNVVGTIRGSVEPDRYVILGGHRDSWVFGAIDPTSGVAVLQEIARSFGKLMSKGWRPRRTIIFASWDAEEFGLLGSTEWAEENVKILQERSIAYINSDSSIEGNYTLRVDCTPLLYQLVYKLTKEIPSPDDGFESKSLYESWLEKDPSPENKNLPRINKLGSGSDFEAYFQRLGIASGRARYTKNKKTDKYSSYPVYHTIYETFELVEKFYDPTFKKQLSVAQLRGALVYELVDSKIIPFNIQDYAEALKNYAASIYNLSKKHDQQLTDHGVSFDSLFSAVKNFSEAASDFHKRLIQVDLNNPIAVRMMNDQLMLLERAFIDPLGLPGKLFYRHIIFAPSSHNKYAGESFPGIYDAIFDIENKANSRLAWKEVKKHISIAAFTIQAAAGTLKEVL

SEQ ID NO: 2771 - protein, 795 aa, unidentified
MGENEASLPNTSLQGKKMAYQKVHADQRAPGHSQYLDNDDLQATALDLEWDMEKELEESGFDQFQLDGAENQNLGHSETIDLNLDSIQPATSPKGRFQRLQEESDYITHYTRSAPKSNRCNFCHVLKILCTATILFIFGILIGYYVHTNCPSDAPSSGTVDPQLYQEILKTIQAEDIKKSFRNLVQLYKNEDDMEISKKIKTQWTSLGLEDVQFVNYSVLLDLPGPSPSTVTLSSSGQCFHPNGQPCSEEARKDSSQDLLYSYAAYSAKGTLKAEVIDVSYGMADDLKRIRKIKNVTNQIALLKLGKLPLLYKLSSLEKAGFGGVLLYIDPCDLPKTVNPSHDTFMVSLNPGGDPSTPGYPSVDESFRQSRSNLTSLLVQPISAPLVAKLISSPKARTKNEACSSLELPNNEIRVVSMQVQTVTKLKTVTNVVGFVMGLTSPDRYIIVGSHHHTAHSYNGQEWASSTAIITAFIRALMSKVKRGWRPDRTIVFCSWGGTAFGNIGSYEWGEDFKKVLQKNVVAYISLHSPIRGNSSLYPVASPSLQQLVVEKNNFNCTRRAQCPETNISSIQIQGDADYFINHLGVPIVQFAYEDIKTLEGPSFLSEARFSTRATKIEEMDPSFNLHETITKLSGEVILQIANEPVLPFNALDIALEVQNNLKGDQPNTHQLLAMALRLRESAELFQSDEMRPANDPKERAPIRIRMLNDILQDMEKSFLVKQAPPGFYRNILYHLDEKTSRFSILIEAWEHCKPLASNETLQEALSEVLNSINSAQVYFKAGLDVFKSVLDGKN

SEQ ID NO: 2772 - protein, 515 aa, unidentified
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEECPLGWHGPGCQRPCKCEHHCPCDPKTGNCSVSRVKQCLQPPEATLRAGELSFFTRTAWLALTLALAFLLLISTAANLSLLLSRAERNRRLHGDYAYHPLQEMNGEPLAAEKEQPGGAHNPFKD

SEQ ID NO: 2773 - protein, 1738 aa, unidentified
MLKRKQSSRVEAQPVTDFGPDESLSDNADILWINKPWVHSLLRICAIISVISVCMNTPMTFEHYPPLQYVTFTLDTLLMFLYTAEMIAKMHIRGIVKGDSSYVKDRWCVFDGFMVFCLWVSLVLQVFEIADIVDQMSPWGMLRIPRPLIMIRAFRIYFRFELPRTRITNILKRSGEQIWSVSIFLLFFLLLYGILGVQMFGTFTYHCVVNDTKPGNVTWNSLAIPDTHCSPELEEGYQCPPGFKCMDLEDLGLSRQELGYSGFNEIGTSIFTVYEAASQEGWVFLMYRAIDSFPRWRSYFYFITLIFFLAWLVKNVFIAVIIETFAEIRVQFQQMWGSRSSTTSTATTQMFHEDAAGGWQLVAVDVNKPQGRAPACLQKMMRSSVFHMFILSMVTVDVIVAASNYYKGENFRRQYDEFYLAEVAFTVLFDLEALLKIWCLGFTGYISSSLHKFELLLVIGTTLHVYPDLYHSQFTYFQVLRVVRLIKISPALEDFVYKIFGPGKKLGSLVVFTASLLIVMSAISLQMFCFVEELDRFTTFPRAFMSMFQILTQEGWVDVMDQTLNAVGHMWAPVVAIYFILYHLFATLILLSLFVAVILDNLELDEDLKKLKQLKQSEANADTKEKLPLRLRIFEKFPNRPQMVKISKLPSDFTVPKIRESFMKQFIDRQQQDTCCLLRSLPTTSSSSCDHSKRSAIEDNKYIDQKLRKSVFSIRARNLLEKETAVTKILRACTRQRMLSGSFEGQPAKERSILSVQHHIRQERRSLRHGSNSQRISRGKSLETLTQDHSNTVRYRNAQREDSEIKMIQEKKEQAEMKRKVQEEELRENHPYFDKPLFIVGREHRFRNFCRVVVRARFNASKTDPVTGAVKNTKYHQLYDLLGLVTYLDWVMIIVTICSCISMMFESPFRRVMHAPTLQIAEYVFVIFMSIELNLKIMADGLFFTPTAVIRDFGGVMDIFIYLVSLIFLCWMPQNVPAESGAQLLMVLRCLRPLRIFKLVPQMRKVVRELFSGFKEIFLVSILLLTLMLVFASFGVQLFAGKLAKCNDPNIIRREDCNGIFRINVSVSKNLNLKLRPGEKKPGFWVPRVWANPRNFNFDNVGNAMLALFEVLSLKGWVEVRDVIIHRVGPIHGIYIHVFVFLGCMIGLTLFVGVVIANFNENKGTALLTVDQRRWEDLKSRLKIAQPLHLPPRPDNDGFRAKMYDITQHPFFKRTIALLVLAQSVLLSVKWDVEDPVTVPLATMSVVFTFIFVLEVTMKIIAMSPAGFWQSRRNRYDLLVTSLGVVWVVLHFALLNAYTYMMGACVIVFRFFSICGKHVTLKMLLLTVVVSMYKSFFIIVGMFLLLLCYAFAGVVLFGTVKYGENINRHANFSSAGKAITVLFRIVTGEDWNKIMHDCMVQPPFCTPDEFTYWATDCGNYAGALMYFCSFYVIIAYIMLNLLVAIIVENFSLFYSTEEDQLLSYNDLRHFQIIWNMVDDKREGVIPTFRVKFLLRLLRGRLEVDLDKDKLLFKHMCYEMERLHNGGDVTFHDVLSMLSYRSVDIRKSLQLEELLAREQLEYTIEEEVAKQTIRMWLKKCLKRIRAKQQQSCSIIHSLRESQQQELSRFLNPPSIETTQPSEDTNANSQDNSMQPETSSQQQLLSPTLSDRGGSRQDAADAGKPQRKFGQWRLPSAPKPISHSVSSVNLRFGGRTTMKSVVCKMNPMTDAASCGSEVKKWWTRQLTVESDESGDDLLDI

SEQ ID NO: 2774 - protein, 206 aa, unidentified
MAPSHLSVREMREDEKPLVLEMLKAGVKDTENRVALHALTRPPALLLLAAASSGLRFVLASFALALLLPVFLAVAAVKLGLRARWGSLPPPGGLGGPWVAVRGSGDVCGVLALAPGTNAGDGARVTRLSVSRWHRRRGVGRRLLAFAEARARAWAGGMGEPRARLVVPVAVAAWGVGGMLEGCGYQAEGGWGCLGYTLVREFSKDL

SEQ ID NO: 2775 - protein, 227 aa, unidentified
MAPCHIRKYQESDRQWVVGLLSRGMAEHAPATFRQLLKLPRTLILLLGGPLALLLVSGSWLLALVFSISLFPALWFLAKKPWTEYVDMTLCTDMSDITKSYLSERGSCFWVAESEEKVVGMVGALPVDDPTLREKRLQLFHLFVDSEHRRQGIAKALVRTVLQFARDQGYSEVILDTGTIQLSAMALYQSMGFKKTGQSFFCVWARLVALHTVHFIYHLPSSKVGSL

SEQ ID NO: 2776 - protein, 302 aa, unidentified
MHCGPPDMVCETKIVAAEDHEALPGAKKDALLAAAGAMWPPLPAAPGPAAAPPAPPPAPVAQPHGGAGGAGPPGGRGVCIREFRAAEQEAARRIFYDGIMERIPNTAFRGLRQHPRAQLLYALLAALCFAVSRSLLLTCLVPAALLGLRYYYSRKVIRAYLECALHTDMADIEQYYMKPPGSCFWVAVLDGNVVGIVAARAHEEDNTVELLRMSVDSRFRGKGIAKALGRKVLEFAVVHNYSAVVLGTTAVKVAAHKLYESLGFRHMGASDHYVLPGMTLSLAERLFFQVRYHRYRLQLREE

SEQ ID NO: 2777 - protein, 2385 aa, unidentified
MPVLGVASKLRQPAVGSKPVHTALPIPNLGTTGSQHCSSRPLELTETESSMLSCQLALKSTCEFGEKKPLQGKAKEKEDSKIYTDWANHYLAKSGHKRLIKDLQQDIADGVLLAEIIQIIANEKVEDINGCPRSQSQMIENVDVCLSFLAARGVNVQGLSAEEIRNGNLKAILGLFFSLSRYKQQQHHQQQYYQSLVELQQRVTHASPPSEASQAKTQQDMQSSLAARYATQSNHSGIATSQKKPTRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAGSKNLSNKKSLLQPKEKEEKNRDKNKVCTEKPVKEEKDQVTEMAPKKTSKIASLIPKGSKTTAAKKESLIPSSSGIPKPGSKVPTVKQTISPGSTASKESEKFRTTKGSPSQSLSKPITMEKASASSCPAPLEGREAGQASPSGSCTMTVAQSSGQSTGNGAVQLPQQQQHSHPNTATVAPFIYRAHSENEGTALPSADSCTSPTKMDLSYSKTAKQCLEEISGEDPETRRMRTVKNIADLRQNLEETMSSLRGTQISHSTLETTFDSTVTTEVNGRTIPNLTSRPTPMTWRLGQACPRLQAGDAPSLGAGYPRSGTSRFIHTDPSRFMYTTPLRRAAVSRLGNMSQIDMSEKASSDLDMSSEVDVGGYMSDGDILGKSLRTDDINSGYMTDGGLNLYTRSLNRIPDTATSRDIIQRGVHDVTVDADSWDDSSSVSSGLSDTLDNISTDDLNTTSSVSSYSNITVPSRKNTQLRTDSEKRSTTDETWDSPEELKKPEEDFDSHGDAGGKWKTVSSGLPEDPEKAGQKASLSVSQTGSWRRGMSAQGGAPSRQKAGTSALKTPGKTDDAKASEKGKAPLKGSSLQRSPSDAGKSSGDEGKKPPSGIGRSTATSSFGFKKPSGVGSSAMITSSGATITSGSATLGKIPKSAAIGGKSNAGRKTSLDGSQNQDDVVLHVSSKTTLQYRSLPRPSKSSTSGIPGRGGHRSSTSSIDSNVSSKSAGATTSKLREPTKIGSGRSSPVTVNQTDKEKEKVAVSDSESVSLSGSPKSSPTSASACGAQGLRQPGSKYPDIASPTFRRLFGAKAGGKSASAPNTEGVKSSSVMPSPSTTLARQGSLESPSSGTGSMGSAGGLSGSSSPLFNKPSDLTTDVISLSHSLASSPASVHSFTSGGLVWAANMSSSSAGSKDTPSYQSMTSLHTSSESIDLPLSHHGSLSGLTTGTHEVQSLLMRTGSVRSTLSESMQLDRNTLPKKGLRYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEEKAHSEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWVNSRGSELRSSFKQAFGKKKSTKPPSSHSDIEELTDSSLPASPKLPHNAGDCGSASMKPSQSASASPLVWPPKKRQNGPVIYKHRSRICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 2778 - protein, 2371 aa, unidentified
MAAPESGPALSPGTAEGEEETILYDLLVNTEWPPETEVQPRGNQKHGASFIITKAIRDRLLFLRQYIWYSPAPFLLPDGLVRLVNKQINWHLVLASNGKLLAAVQDQCVEIRSAKDDFTSIIGKCQVPKDPKPQWRRVAWSYDCTLLAYAESTGTVRVFDLMGSELFVISPASSFIGDLSYAIAGLIFLEYKASAQWSAELLVINYRGELRSYLVSVGTNQSYQESHCFSFSSHYPHGINTAIYHPGHRLLLVGGCETAEVGMSKASSCGLSAWRVLSGSPYYKQVTNGGDGVTAVPKTLGLLRMLSVKFYSRQGQEQDGIFKMSLSPDGMLLAAIHFSGKLSIWAIPSLKQQGEWGQNEQPGYDDLNPDWRLSTEKRKKIKDKESFYPLIDVNWWADSAVTLARCSGALTVSSVKTLKNLLGKSCEWFEPSPQVTATHDGGFLSLECEIKLAPKRSRLETRAGEEDEGEEDSDSDYEISAKARYFGYIKQGLYLVTEMERFAPPRKRPRTITKNYRLVSLRSTTPEELYQRKIESEEYEEALSLAHTYGLDTDLVYQRQWRKSAVNVASIQNYLSKIKKRSWVLHECLERVPENVDAAKELLQYGLKGTDLEALLAIGKGADDGRFTLPGEIDIDSISYEELSPPDEEPAKNKKEKELKKRQELLKLVNFSKLTLEQKELCRCRRKLLTYLDRLATYEEILGVPHASEQRYDAEFFKKFRNQNIVLSARTYAQESNVQALEILFTYHGSDLLPHRLAILSNFPETTSPHEYSVLLPEACFNGDSLMIIPWHEHKHRAKDWCEELACRMVVEPNLQDESEFLYAAQPELLRFRMTQLTVEKVMDWYQTRAEEIEHYARQVDCALSLIRLGMERNIPGLLVLCDNLVTLETLVYEARCDVTLTLKELQQMKDIEKLRLLMNSCSEDKYVTSAYQWMVPFLHRCEKQSPGVANELLKEYLVTLAKGDLKFPLKIFQHSKPDLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQVRLCPDRISLIKECISQSPTCYKQSTKLLGLAELLRVAGENPEERRGQVLILLVEQALRFHDYKAASMHCQELMATGYPKSWDVCSQLGQSEGYQDLATRQELMAFALTHCPPSSIELLLAASSSLQTEILYQRVNFQIHHEGGENISASPLTSKAVQEDEVGVPGSNSADLLRWTTATTMKVLSNTTTTTKAVLQAVSDGQWWKKSLTYLRPLQGQKCGGAYQIGTTANEDLEKQGCHPFYESVISNPFVAESEGTYDTYQHVPVESFAEVLLRTGKLAEAKNKGEVFPTTEVLLQLASEALPNDMTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWV

SEQ ID NO: 2779 - protein, 2946 aa, unidentified
MASEKPGPGPGLEPQPVGLIAVGAAGGGGGGSGGGGTGGSGMGELRGASGSGSVMLPAGMINPSVPIRNIRMKFAVLIGLIQVGEVSNRDIVETVLNLLVGGEFDLEMNFIIQDAESITCMTELLEHCDVTCQAEIWSMFTAILRKSVRNLQTSTEVGLIEQVLLKMSAVDDMIADLLVDMLGVLASYSITVKELKLLFSMLRGESGIWPRHAVKLLSVLNQMPQRHGPDTFFNFPGCSAAAIALPPIAKWPYQNGFTLNTWFRMDPLNNINVDKDKPYLYCFRTSKGVGYSAHFVGNCLIVTSLKSKGKGFQHCVKYDFQPRKWYMISIVHIYNRWRNSEIRCYVNGQLVSYGDMAWHVNTNDSYDKCFLGSSETADANRVFCGQLGAVYVFSEALNPAQIFAIHQLGPGYKSTFKFKSESDIHLAEHHKQVLYDGKLASSIAFTYNAKATDAQLCLESSPKENASIFVHSPHALMLQDVKAIVTHSIHSAIHSIGGIQVLFPLFAQLDNRQLNDSQVETTVCATLLAFLVELLKSSVAMQEQMLGGKGFLVIGYLLEKSSRVHITRAVLEQFLSFAKYLDGLSHGAPLLKQLCDHILFNPAIWIHTPAKVQLSLYTYLSAEFIGTATIYTTIRRVGTVLQLMHTLKYYYWVINPADSSGITPKGLDGPRPSQKEIISLRAFMLLFLKQLILKDRGVKEDELQSILNYLLTMHEDENIHDVLQLLVALMSEHPASMIPAFDQRNGIRVIYKLLASKSESIWVQALKVLGYFLKHLGHKRKVEIMHTHSLFTLLGERLMLHTNTVTVTTYNTLYEILTEQVCTQVVHKPHPEPDSTVKIQNPMILKVVATLLKNSTPSAELMEVRRLFLSDMIKLFSNSRENRRCLLQCSVWQDWMFSLGYINPKNSEEQKITEMVYNIFRILLYHAIKYEWGGWRVWVDTLSIAHSKVTYEAHKEYLAKMYEEYQRQEEENIKKGKKGNVSTISGLSSQTTGAKGGMEIREIEDLSQSQSPESETDYPVSTDTRDLLMSTKVSDDILGNSDRPGSGVHVEVHDLLVDIKAEKVEATEVKLDDMDLSPETLVGGENGALVEVESLLDNVYSAAVEKLQNNVHGSVGIIKKNEEKDNGPLITLADEKEDLPNSSTSFLFDKIPKQEEKLLPELSSNHIIPNIQDTQVHLGVSDDLGLLAHMTGSVDLTCTSSIIEEKEFKIHTTSDGMSSISERDLASSTKGLEYAEMTATTLETESSSSKIVPNIDAGSIISDTERSDDGKESGKEIRKIQTTTTTQAVQGRSITQQDRDLRVDLGFRGMPMTEEQRRQFSPGPRTTMFRIPEFKWSPMHQRLLTDLLFALETDVHVWRSHSTKSVMDFVNSNENIIFVHNTIHLISQMVDNIIIACGGILPLLSAATSPTGSKTELENIEVTQGMSAETAVTFLSRLMAMVDVLVFASSLNFSEIEAEKNMSSGGLMRQCLRLVCCVAVRNCLECRQRQRDRGNKSSHGSSKPQEVPQSVTATAASKTPLENVPGNLSPIKDPDRLLQDVDINRLRAVVFRDVDDSKQAQFLALAVVYFISVLMVSKYRDILEPQRETTRTGSQPGRNIRQEINSPTSTVVVIPSIPHPSLNHGFLAKLIPEQSFGHSFYKETPAAFPDTIKEKETPTPGEDIQVESSIPHTDSGIGEEQVASILNGAELETSTGPDAMSELLSTLSSEVKKSQESLTENPSETLKPATSISSISQTKGINVKEILKSLVAAPVEIAECGPEPIPYPDPALKRETQAILPMQFHSFDRSVVVPVKKPPPGSLAVTTVGATTAGSGLPTGSTSNIFAATGATPKSMINTTGAVDSGSSSSSSSSSFVNGATSKNLPAVQTVAPMPEDSAENMSITAKLERALEKVAPLLREIFVDFAPFLSRTLLGSHGQELLIEGLVCMKSSTSVVELVMLLCSQEWQNSIQKNAGLAFIELINEGRLLCHAMKDHIVRVANEAEFILNRQRAEDVHKHAEFESQCAQYAADRREEEKMCDHLISAAKHRDHVTANQLKQKILNILTNKHGAWGAVSHSQLHDFWRLDYWEDDLRRRRRFVRNAFGSTHAEALLKAAIEYGTEEDVVKSKKTFRSQAIVNQNAETELMLEGDDDAVSLLQEKEIDNLAGPVVLSTPAQLIAPVVVAKGTLSITTTEIYFEVDEDDSAFKKIDTKVLAYTEGLHGKWMFSEIRAVFSRRYLLQNTALEVFMANRTSVMFNFPDQATVKKVVYSLPRVGVGTSYGLPQARRISLATPRQLYKSSNMTQRWQRREISNFEYLMFLNTIAGRTYNDLNQYPVFPWVLTNYESEELDLTLPGNFRDLSKPIGALNPKRAVFYAERYETWEDDQSPPYHYNTHYSTATSTLSWLVRIEPFTTFFLNANDGKFDHPDRTFSSVARSWRTSQRDTSDVKELIPEFYYLPEMFVNSNGYNLGVREDEVVVNDVDLPPWAKKPEDFVRINRMALESEFVSCQLHQWIDLIFGYKQRGPEAVRALNVFHYLTYEGSVNLDSITDPVLREAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 2780 - protein, 858 aa, unidentified
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 2781 - protein, 837 aa, unidentified
MSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 2782 - protein, 408 aa, unidentified
MRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASAKIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 2783 - protein, 1128 aa, unidentified
MSRSVLQPSQQKLAEKLTILNDRGVGMLTRLYNIKKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 2784 - protein, 1127 aa, unidentified
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 2785 - protein, 722 aa, unidentified
MYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 2786 - protein, 563 aa, unidentified
MLEEAGEVLENMLKASCLPLGFIVFLPAVLLLVAPPLPAADAAHEFTVYRMQQYDLQGQPYGTRNAVLNTEARTMAAEVLSRRCVLMRLLDFSYEQYQKALRQSAGAVVIILPRAMAAVPQDVVRQFMEIEPEMLAMETAVPVYFAVEDEALLSIYKQTQAASASQGSASAAEVLLRTATANGFQMVTSGVQSKAVSDWLIASVEGRLTGLGGEDLPTIVIVAHYDAFGVAPWLSLGADSNGSGVSVLLELARLFSRLYTYKRTHAAYNLLFFASGGGKFNYQGTKRWLEDNLDHTDSSLLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRSRVDSKTLTRNTRIIAEALTRVIYNLTEKGTPPDMPVFTEQMQIQQEQLDSVMDWLTNQPRAAQLVDKDSTFLSTLEHHLSRYLKDVKQHHVKADKRDPEFVFYDQLKQVMNAYRVKPAVFDLLLAVGIAAYLGMAYVAVQHFSLLYKTVQRLLVKAKTQ

SEQ ID NO: 2787 - protein, 102 aa, unidentified
MTTATPLGDTTFFSLNMTTRGEDFLYKSSGAIVAAVVVVVIIIFTVVLILLKMYNRKMRTRRELEPKGPKPTAPSAVGPNSNGSQHPATVTFSPVDVQVETR

SEQ ID NO: 2788 - protein, 304 aa, unidentified
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 2789 - protein, 276 aa, unidentified
MAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTSWTPRDLVSSQTQTQSCVPPTAGARQAPESPSTIPVPSQPQNSTLRPGPAAPIALVPVFCGLLVAKSLVLSALLVWWGDIWWKTMMELRSLDTQKATCHLQQVTDLPWTSVSSPVEREILYHTVARTKISDDDDEHTL

SEQ ID NO: 2790 - protein, 201 aa, unidentified
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 2791 - protein, 454 aa, unidentified
MTWRAAASTCAALLILLWALTTEGDLKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFSIHWWPISFIGVGLVLLIVLIPWKKICNKSSSAYTPLKCILKHWNSFDTQTLKKEHLIFFCTRAWPSYQLQDGEAWPPEGSVNINTIQQLDVFCRQEGKWSEVPYVQAFFALRDNPDLCQCCRIDPALLTVTSGKSIDDNSTKSEKQTPREHSDAVPDAPILPVSPIWEPPPATTSTTPVLSSQPPTLLLPLQ

SEQ ID NO: 2792 - protein, 709 aa, unidentified
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 2793 - protein, 674 aa, unidentified
MATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNAVQASAEHQKRLQQFLEFKE

SEQ ID NO: 2794 - protein, 221 aa, unidentified
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 2795 - protein, 336 aa, unidentified
MARRRSQRVCASGPSMLNSARGAPELLRGTATNAEVSAAAAGATGSEELPPGDRGCRNGGGRGPAATTSSTGVAVGAEHGEDSLSRKPDPEPGRMDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 2796 - protein, 321 aa, unidentified
MSEQSKDLSDPNFAAEAPNSEVHSSPGVSEGVPPSATLAEPQSPPLGPTAAPQAAPPPQAPNDEGDPKALQQAAEEGRAHQAPSAAQPGPAPPAPAQLVQKAHELMWYVLVKDQKKMIIWFPDMVKDVIGSYKKWCRSILRRTSLILARVFGLHLRLTSLHTMEFALVKALEPEELDRVALSNRMPMTGLLLMILSLIYVKGRGARESAVWNVLRILGLRPWKKHSTFGDVRKLITEEFVQMNYLKYQRVPYVEPPEYEFFWGSRASREITKMQIMEFLARVFKKDPQAWPSRYREALEEARALREANPTAHYPRSSVSED

SEQ ID NO: 2797 - protein, 371 aa, unidentified
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 2798 - protein, 352 aa, unidentified
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYIAYLKDRRLSGGAVPSASMTRLARSRTASLTSASSVDGSRPQACTHSESSEGLGQVNHTMEVSC

SEQ ID NO: 2799 - protein, 882 aa, unidentified
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQHQRAHDDPVALKYTFHEVITAGSDASSKLRALQNRCLVPGWYATHIERWLSAYHANQILVLDGKLLRTEPAKVMDMVQKFLGVTNTIDYHKTLAFDPKKGFWCQLLEGGKTKCLGKSKGRKYPEMDLDSRAFLKDYYRDHNIELSKLLYKMGQTLPTWLREDLQNTR

SEQ ID NO: 2800 - protein, 883 aa, unidentified
MLQLWKVVRPARQLELHRLILLLIAFSLGSMGFLAYYVSTSPKAKEPLPLPLGDCSSGGAAGPGPARPPVPPRPPRPPETARTEPVVLVFVESAYSQLGQEIVAILESSRFRYSTELAPGRGDMPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGTEEEDAGDDMLLKHRKEFWWFPHMWSHMQPHLFHNRSVLADQMRLNKQFALEHGIPTDLGYAVAPHHSGVYPIHTQLYEAWKSVWGIQVTSTEEYPHLRPARYRRGFIHNGIMVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTESRLFLTDFFRNHNLELSKLLSRLGQPVPSWLREELQHSSLG

SEQ ID NO: 2801 - protein, 70 aa, unidentified
MWFEILPGLSVMGVCLLIPGLATAYIHRFTNGGKEKRVAHFGYHWSLMERDRRISGVDRYYVSKGLENID

SEQ ID NO: 2802 - protein, 141 aa, unidentified
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARTHNYGIGAAACVYFGIAASLVKMGRLEGWEVFAKPKV

SEQ ID NO: 2803 - protein, 144 aa, unidentified
MAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKVGESVFHTTRWVPPLIGELYGLRTTEEALHASHGFMWYT

SEQ ID NO: 2804 - protein, 84 aa, unidentified
MAARVGAFLKNAWDKEPVLVVSFVVGGLAVILPPLSPYFKYSVMINKATPYNYPVPVRDDGNMPDVPSHPQDPQGPSLEWLKKL

SEQ ID NO: 2805 - protein, 81 aa, unidentified
MLRQIIGQAKKHPSLIPLFVFIGTGATGATLYLLRLALFNPDVCWDRNNPEPWNKLGPNDQYKFYSVNVDYSKLKKERPDF

SEQ ID NO: 2806 - protein, 87 aa, unidentified
MAGASLGARFYRQIKRHPGIIPMIGLICLGMGSAALYLLRLALRSPDVCWDRKNNPEPWNRLSPNDQYKFLAVSTDYKKLKKDRPDF

SEQ ID NO: 2807 - protein, 377 aa, unidentified
MAAAAQSRVVRVLSMSRSAITAIATSVCHGPPCRQLHHALMPHGKGGRSSVSGIVATVFGATGFLGRYVVNHLGRMGSQVIIPYRCDKYDIMHLRPMGDLGQLLFLEWDARDKDSIRRVVQHSNVVINLIGRDWETKNFDFEDVFVKIPQAIAQLSKEAGVEKFIHVSHLNANIKSSSRYLRNKAVGEKVVRDAFPEAIIVKPSDIFGREDRFLNSFASMHRFGPIPLGSLGWKTVKQPVYVVDVSKGIVNAVKDPDANGKSFAFVGPSRYLLFHLVKYIFAVAHRLFLPFPLPLFAYRWVARVFEISPFEPWITRDKVERMHITDMKLPHLPGLEDLGIQATPLELKAIEVLRRHRTYRWLSAEIEDVKPAKTVNI

SEQ ID NO: 2808 - protein, 58 aa, unidentified
MVNLLQIVRDHWVHVLVPMGFVIGCYLDRKSDERLTAFRNKSMLFKRELQPSEEVTWK

SEQ ID NO: 2809 - protein, 153 aa, unidentified
MAAGLFGLSARRLLAAAATRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRMKEWSRREAERLVKYREANGLPIMESNCFDPSKIQLPEDE

SEQ ID NO: 2810 - protein, 98 aa, unidentified
MAHEHGHEHGHHKMELPDYRQWKIEGTPLETIQKKLAAKGLRDPWGRNEAWRYMGGFAKSVSFSDVFFKGFKWGFAAFVVAVGAEYYLESLNKDKKHH

SEQ ID NO: 2811 - protein, 129 aa, unidentified
MSFPKYKPSSLRTLPETLDPAEYNISPETRRAQAERLAIRAQLKREYLLQYNDPNRRGLIENPALLRWAYARTINVYPNFRPTPKNSLMGALCGFGPLIFIYYIIKTERDRKEKLIQEGKLDRTFHLSY

SEQ ID NO: 2812 - protein, 189 aa, unidentified
MAAMSLLRRVSVTAVAALSGRPLGTRLGFGGFLTRGFPKAAAPVRHSGDHGKRLFVIRPSRFYDRRFLKLLRFYIALTGIPVAIFITLVNVFIGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 2813 - protein, 128 aa, unidentified
MTGYTPDEKLRLQQLRELRRRWLKDQELSPREPVLPPQKMGPMEKFWNKFLENKSPWRKMVHGVYKKSIFVFTHVLVPVWIIHYYMKYHVSEKPYGIVEKKSRIFPGDTILETGEVIPPMKEFPDQHH

SEQ ID NO: 2814 - protein, 76 aa, unidentified
MAPSALLRPLSRLLAPARLPSGPSVRSKFYVREPPNAKPDWLKVGFTLGTTVFLWIYLIKQHNEDILEYKRRNGLE

SEQ ID NO: 2815 - protein, 119 aa, unidentified
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEDKKTYGEIFEKFHPIR

SEQ ID NO: 2816 - protein, 114 aa, unidentified
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEDVYCCGAERRG

SEQ ID NO: 2817 - protein, 517 aa, unidentified
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEFPYTPSPPEHGRRAGPVPTAIIGGVAGSILLVLIVVGGIVVALRRRRHTFKGDYSTKKHVYGNGYSKAGIPQHHPPMAQNLQYPDDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 2818 - protein, 538 aa, unidentified
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 2819 - protein, 549 aa, unidentified
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 2820 - protein, 510 aa, unidentified
MPLSLGAEMWGPEAWLLLLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSASVVVVGVIAALLFCLLVVVVVLMSRYHRRKAQQMTQKYEEELTLTRENSIRRLHSHHTDPRSQPEESVGLRAEGHPDSLKDNSSCSVMSEEPEGRSYSTLTTVREIETQTELLSPGSGRAEEEEDQDEGIKQAMNHFVQENGTLRAKPTGNGIYINGRGHLV

SEQ ID NO: 2821 - protein, 354 aa, unidentified
MDMMLLVQGACCSNQWLAAVLLSLCCLLPSCLPAGQSVDFPWAAVDNMMVRKGDTAVLRCYLEDGASKGAWLNRSSIIFAGGDKWSVDPRVSISTLNKRDYSLQIQNVDVTDDGPYTCSVQTQHTPRTMQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 2822 - protein, 816 aa, unidentified
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 2823 - protein, 444 aa, unidentified
MAGGMKVAVSPAVGPGPWGSGVGGGGTVRLLLILSGCLVYGTAETDVNVVMLQESQVCEKRASQQFCYTNVLIPKWHDIWTRIQIRVNSSRLVRVTQVENEEKLKELEQFSIWNFFSSFLKEKLNDTYVNVGLYSTKTCLKVEIIEKDTKYSVIVIRRFDPKLFLVFLLGLMLFFCGDLLSRSQIFYYSTGMTVGIVASLLIIIFILSKFMPKKSPIYVILVGGWSFSLYLIQLVFKNLQEIWRCYWQYLLSYVLTVGFMSFAVCYKYGPLENERSINLLTWTLQLMGLCFMYSGIQIPHIALAIIIIALCTKNLEHPIQWLYITCRKVCKGAEKPVPPRLLTEEEYRIQGEVETRKALEELREFCNSPDCSAWKTVSRIQSPKRFADFVEGSSHLTPNEVSVHEQEYGLGSIIAQDEIYEEASSEEEDSYSRCPAITQNNFLT

SEQ ID NO: 2824 - protein, 417 aa, unidentified
MGPRQGRWWLLLWLPPLATLPVRGEAAAAALSVRRCKALKEKDLIRTSESDCYCYNQNSQVEWKYIWSTMQVKITSPGLFRIVYIAERHNCQYPENILSFIKCVIHNFWIPKESNEITIIINPYRETVCFSVEPVKKIFNYMIHVNRNIMDFKLFLVFVAGVFLFFYARTLSQSPTFYYSSGTVLGVLMTLVFVLLLVKRFIPKYSTFWALMVGCWFASVYIVCQLMEDLKWLWYENRIYVLGYVLIVGFFSFVVCYKHGPLADDRSRSLLMWMLRLLSLVLVYAGVAVPQFAYAAIILLMSSWSLHYPLRACSYMRWKMEQWFTSKELVVKYLTEDEYREQADAETNSALEELRRACRKPDFPSWLVVSRLHTPSKFADFVLGGSHLSPEEISLHEEQYGLGGAFLEEQLFNPSTA

SEQ ID NO: 2825 - protein, 1461 aa, unidentified
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 2826 - protein, 533 aa, unidentified
MIHGRSVLHIVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGTVIGVTSCIVIILIIISVIVQIKQPRKKYVQRKSDFDQTVFQEVFEPPHYELCTLRGTGATADFADVADDFENYHKLRRSSSKCIHDHHCGSQLSSTKGSRSNLSTRDASILTEMPTQPGKPLIPPMNRRNILVMKHSYSQDAADACDIDEIEEVPTTSHRLSRHDKAVQRFCLIGSLSKHESEYNTTRV

SEQ ID NO: 2827 - protein, 525 aa, unidentified
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 2828 - protein, 2839 aa, unidentified
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 2829 - protein, 270 aa, unidentified
MENQPVRWRALPGLPRPPGLPAAPWLLLGVLLLPGTLRLAGGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRDAGYREPPQSPQKLLLFGFTGLLSVLSVVGTALLLWNKKRMRGPGKDPTRKCPDPRSASSPKQHPSESVYTALQRRETEVYACIENEDGSSPTAKQSPLSQERPHRFEDDGELNLVYENL

SEQ ID NO: 2830 - protein, 1347 aa, unidentified
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAPPTLPPTTVGATGAVSSTDATAIAATTEATTVPIIPTVAPTTIATTTTVATTTTTTAAATTTTESPPTTTSGTKIHESAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 2831 - protein, 911 aa, unidentified
MEASWRQVAGGRGRSRGRATAAPSGNGVHLRGAGGGREKGSVGAVPSGTSPGGVATTAAAGSRHSPAGSQALQTTAASELMSQKKFEEIKKANQAAARKLVEEQFSSSSEEGDEDFEGKQGKILANTFITYTTQTDGDTRELERTKQYVNEAFQAGAMTCLICIASVKRNQAVWSCSGCFCIFHMPCIQKWAKDSQFLVSSVTDDDFGKKDCPWPCPKCRFEYKRSETPSRYYCYCGKVEDPPLDPWLVPHSCGQVCEREFKPPCGHKCLLLCHPGPCPPCPKMVTTTCYCKKAKPIPRRCSAKEWSCQLPCGQKLLCGQHKCENPCHAGSCQPCPRVSRQKCVCGKKVAERSCASPLWHCDQVCGKTLPCGNHTCEQVCHVGACGECPRSGKRFCPCQKSKFSLPCTEDVPTCGDSCDKVLECGIHRCSQRCHRGPCETCRQEVEKHCRCGKHTKRMPCHKPYLCETKCVKMRDCQKHQCRRKCCPGNCPPCDQNCGRTLGCRNHKCPSVCHRGSCYPCPETVDVKCNCGNTKVTVPCGRERTTRPPKCKEQCSRPPTCHHTSQEKHRCHFGSCPPCHQPCQKVLEKCGHLCPAPCHDQALIKQTGRHQPTGPWEQPSEPAFIQTALPCPPCQVPIPMECLGKHEVSPLPCHAVGPYSCKRVCGRILDCQNHTCMKECHKVTKTDGCTGKNKAGPECLHCEEGCSKSRPLGCLHPCILRCHPGECPPCVQMLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQAELEAFENRLKGRRKKNRKRDEVAVELSLWQKHKYYLISVCGVVVVVFAWYITHDVN

SEQ ID NO: 2832 - protein, 427 aa, unidentified
MGAGATGRAMDGPRLLLLLLLGVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 2833 - protein, 654 aa, unidentified [sequence omitted]

SEQ ID NO: 2834 - protein, 377 aa, unidentified
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTGEMSHHDTLDAASQGINVILCEHSNTERGFLSDLRDMLDSHLENKINIILSETDRDPLQVV

SEQ ID NO: 2835 - protein, 152 aa, unidentified
MDSGTEEYELNGGLPPGTPGSPDASPARWGWRHGPINVNHYASKKSAAESMLDIALLMANASQLKAVVEQGPSFAFYVPLVVLISISLVLQIGVGVLLIFLVKYDLNNPAKHAKLDFLNNLATGLVFIIVVVNIFITAFGVQKPLMDMAPQQ

SEQ ID NO: 2836 - protein, 142 aa, unidentified
MESARENIDLQPGSSDPRSQPINLNHYATKKSVAESMLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 2837 - protein, 329 aa, unidentified
MGTAAAAAAAAAAAAAGEGARSPSPAAVSLGLGVAVVSSLVNGSTFVLQKKGIVRAKRRGTSYLTDIVWWAGTIAMAVGQIGNFLAYTAVPTVLVTPLGALGVPFGSILASYLLKEKLNILGKLGCLLSCAGSVVLIIHSPKSESVTTQAELEEKLTNPVFVGYLCIVLLMLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLVDFLGMACGFTTVSVGIVLIQVFKEFNFNLGEMNKSNMKTD

SEQ ID NO: 2838 - protein, 360 aa, unidentified
MSQGRGKYDFYIGLGLAMSSSIFIGGSFILKKKGLLRLARKGSMRAGQGGHAYLKEWLWWAGLLSMGAGEVANFAAYAFAPATLVTPLGALSVLVSAILSSYFLNERLNLHGKIGCLLSILGSTVMVIHAPKEEEIETLNEMSHKLGDPGFVVFATLVVIVALILIFVVGPRHGQTNILVYITICSVIGAFSVSCVKGLGIAIKELFAGKPVLRHPLAWILLLSLIVCVSTQINYLNRALDIFNTSIVTPIYYVFFTTSVLTCSAILFKEWQDMPVDDVIGTLSGFFTIIVGIFLLHAFKDVSFSLASLPVSFRKDEKAMNGNLSNMYEVLNNNEESLTCGIEQHTGENVSRRNGNLTAF

SEQ ID NO: 2839 - protein, 410 aa, unidentified
MGAQVRLPPGEPCREGYVLSLVCPNSSQAWCEITNVSQLLASPVLYTDLNYSINNLSISANVENKYSLYVGLVLAVSSSIFIGSSFILKKKGLLQLASKGFTRAGQGGHSYLKEWLWWVGLLSMGAGEAANFAAYAFAPATLVTPLGALSVLISAILSSYFLNEHLNIHGKIGCILSILGSTVMVIHAPQEEEVTSLHEMEMKLRDPGFISFAVIITVISLVLILIVAPKKGQTNILVYISICSLIGAFSVSSVKGLGIAIKELIEWKPVYKHPLVFVLLAVLVLSVTTQINYLNKALDTFNTSLVTPIYYVFFTSMVVTCSAILFQEWYGMTAGDIIGTLSGFFTIIIGIFLLHAFKNTDITWSELTSTAKKEAVSLNVNENNYVLLENLECSAPGYNDDVTLFSRTDD

SEQ ID NO: 2840 - protein, 368 aa, unidentified
MAAVAPAGPGDSASAALDELSLNFTYGAPGAGNGSLSGDWYRRNQIHLFGVLLAILGNLVISISLNIQKYSHLQLAQQEHPRPYFKSVLWWGGVLLMAVGETGNFAAYGFAPITLIAPLGCVSVTGSAIISVTFLKDNLRASDLLGTTLAFAGTYLLVNFAPNITQAISARTVQYYLVGWQFLIYVILEILIFCILLYFYKRKGMKHMVILLTLVAILASLTVISVKAVSGMITFSVMDKMQLTYPIFYIMFIIMIASCVFQVKFLNQATKLYNTTTVVPVNHIFFTISAIIAGIIFYQEFLGAPFLTVFIYLFGCFLSFLGVFLVTRNREKEHLQQSYIDFGNIPDTTPERKAWRETNVGQNTTRFT

SEQ ID NO: 2841 - protein, 406 aa, unidentified
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPGMQNMHDKGMTVQPELKASFSYGALENNDNISEIYAPATLPVMQEEHGSRSASGVPYRVLEHTKKE

SEQ ID NO: 2842 - protein, 466 aa, unidentified
MPGDSSPGTLPLWDASLSPPLGPDPGGFSRASHAGDKSRPPAPELGSPGAVRPRVGSCAPGPMELRVSNTSCENGSLLHLYCSSQEVLCQIVNDLSPEVPSNATFHSWQERIRQNYGFYIGLGLAFLSSFLIGSSVILKKKGLLRLVATGATRAVDGGFGYLKDAMWWAGFLTMAAGEVANFGAYAFAPATVVTPLGALSVLISAILSSYFLRESLNLLGKLGCVICVAGSTVMVIHAPEEEKVTTIMEMASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIFNTSLVFPIYYVFFTTVVVTSSIILFKEWYSMSAVDIAGTLSGFVTIILGVFMLHAFKDLDISCASLPHMHKNPPPSPAPEPTVIRLEDKNVLVDNIELASTSSPEEKPKVFIIHS

SEQ ID NO: 2843 - protein, 207 aa, unidentified
MGKCSGRCTLVAFCCLQLVAALERQIFDFLGYQWAPILANFLHIMAVILGIFGTVQYRSRYLILYAAWLVLWVGWNAFIICFYLEVGQLSQDRDFIMTFNTSLHRSWWMENGPGCLVTPVLNSRLALEDHHVISVTGCLLDYPYIEALSSALQIFLALFGFVFACYVSKVFLEEEDSFDFIGGFDSYGYQAPQKTSHLQLQPLYTSG

SEQ ID NO: 2844 - protein, 208 aa, unidentified
MGYCSGRCTLIFICGMQLVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFIGGFDSYGYQGPQKTSHLQLQPMYMSK

SEQ ID NO: 2845 - protein, 197 aa, unidentified
MGCCTGRCSLICLCALQLVSALERQIFDFLGFQWAPILGNFLHIIVVILGLFGTIQYRPRYIMVYTVWTALWVTWNVFIICFYLEVGGLSKDTDLMTFNISVHRSWWREHGPGCVRRVLPPSAHGMMDDYTYVSVTGCIVDFQYLEVIHSAVQILLSLVGFVYACYVISISMEEEDTYSCDLQVCKHLFIQMLQIIE

SEQ ID NO: 2846 - protein, 208 aa, unidentified
MGSCSGRCALVVLCAFQLVAALERQVFDFLGYQWAPILANFVHIIIVILGLFGTIQYRLRYVMVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 2847 - protein, 165 aa, unidentified
MELCRSLALLGGSLGLMFCLIALSTDFWFEAVGPTHSAHSGLWPTGHGDIISGYIHVTQTFSIMAVLWALVSVSFLVLSCFPSLFPPGHGPLVSTTAAFAAAISMVVAMAVYTSERWDQPPHPQIQTFFSWSFYLGWVSAILLLCTGALSLGAHCGGPRPGYETL

SEQ ID NO: 2848 - protein, 863 aa, unidentified
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDVKRISKECARKPGKKICRKGGPLTKKQTDDLGDNDGAEDEDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 2849 - protein, 835 aa, unidentified
MWLLALCLVGLAGAQRGGGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDGPLTKKRDEATLNPPDTDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAEAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGDPNQPVPQDTKFIHTKPNRFEEVVWSKFNSKEKQYLHIGLKPRVRDNYRANKVAFWLELVPHLHNLHTELFTTTTRLPPYATRWPPRPPAGAPGTRRPPPPATLPPEPEPEPGPRAYDRFPGDSRDYSTELSVTVAVGASLLFLNILAFAALYYKRDRRQELRCRRLSPPGGSGSGVPGGGPLLPAAGRELPPEEELVSLQLKRGGGVGADPAEALRPACPPDYTLALRRAPDDVPLLAPGALTLLPSGLGPPPPPPPPSLHPFGPFPPPPPTATSHNNTLPHPHSTTRV

SEQ ID NO: 2850 - protein, 848 aa, unidentified
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDVKRISKECARKPNKKICRKGGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 2851 - protein, 816 aa, unidentified
MSRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 2852 - protein, 816 aa, unidentified
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDDIHEQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 2853 - protein, 390 aa, unidentified
MPSKSLSNLSVTTGANESGSVPEGWERDFLPASDGTTTELVIRCVIPSLYLLIITVGLLGNIMLVKIFITNSAMRSVPNIFISNLAAGDLLLLLTCVPVDASRYFFDEWMFGKVGCKLIPVIQLTSVGVSVFTLTALSADRYRAIVNPMDMQTSGALLRTCVKAMGIWVVSVLLAVPEAVFSEVARISSLDNSSFTACIPYPQTDELHPKIHSVLIFLVYFLIPLAIISIYYYHIAKTLIKSAHNLPGEYNEHTKKQMETRKRLAKIVLVFVGCFIFCWFPNHILYMYRSFNYNEIDPSLGHMIVTLVARVLSFGNSCVNPFALYLLSESFRRHFNSQLCCGRKSYQERGTSYLLSSSAVRMTSLKSNAKNMVTNSVLLNGHSMKQEMAL

SEQ ID NO: 2854 - protein, 426 aa, unidentified
MTPLCLNCSVLPGDLYPGGARNPMACNGSAARGHFDPEDLNLTDEALRLKYLGPQQTELFMPICATYLLIFVVGAVGNGLTCLVILRHKAMRTPTNYYLFSLAVSDLLVLLVGLPLELYEMWHNYPFLLGVGGCYFRTLLFEMVCLASVLNVTALSVERYVAVVHPLQARSMVTRAHVRRVLGAVWGLAMLCSLPNTSLHGIRQLHVPCRGPVPDSAVCMLVRPRALYNMVVQTTALLFFCLPMAIMSVLYLLIGLRLRRERLLLMQEAKGRGSAAARSRYTCRLQQHDRGRRQVTKMLFVLVVVFGICWAPFHADRVMWSVVSQWTDGLHLAFQHVHVISGIFFYLGSAANPVLYSLMSSRFRETFQEALCLGACCHRLRPRHSSHSLSRMTTGSTLCDVGSLGSWVHPLAGNDGPEAQQETDPS

SEQ ID NO: 2855 - protein, 415 aa, unidentified
MSGMEKLQNASWIYQQKLEDPFQKHLNSTEEYLAFLCGPRRSHFFLPVSVVYVPIFVVGVIGNVLVCLVILQHQAMKTPTNYYLFSLAVSDLLVLLLGMPLEVYEMWRNYPFLFGPVGCYFKTALFETVCFASILSITTVSVERYVAILHPFRAKLQSTRRRALRILGIVWGFSVLFSLPNTSIHGIKFHYFPNGSLVPGSATCTVIKPMWIYNFIIQVTSFLFYLLPMTVISVLYYLMALRLKKDKSLEADEGNANIQRPCRKSVNKMLFVLVLVFAICWAPFHIDRLFFSFVEEWSESLAAVFNLVHVVSGVFFYLSSAVNPIIYNLLSRRFQAAFQNVISSFHKQWHSQHDPQLPPAQRNIFLTECHFVELTEDIGPQFPCQSSMHNSHLPAALSSEQMSRTNYQSFHFNKT

SEQ ID NO: 2856 - protein, 81 aa, unidentified
MAAVAAASAELLIIGWYIFRVLLQVFLECCIYWVGFAFRNPPGTQPIARSEVFRYSLQKLAYTVSRTGRQVLGERRQRAPN

SEQ ID NO: 2857 - protein, 1086 aa, unidentified
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIAGYKAVVLAANHFGRFFTGQITAAGKVPPAKILIVGGGVAGLASAGAAKSMGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 2858 - protein, 1146 aa, unidentified
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 2859 - protein, 1222 aa, unidentified
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRT

SEQ ID NO: 2860 - protein, 1267 aa, unidentified
MLVGQGAGLLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGRISIIRFPDTVKQMNKYKVVLSSQDKDKSLVTVETDAHGSFCFKAKPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 2861 - protein, 1222 aa, unidentified
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 2862 - protein, 2555 aa, unidentified
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 2863 - protein, 2471 aa, unidentified
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 2864 - protein, 2321 aa, unidentified
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 2865 - protein, 2003 aa, unidentified
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 2866 - protein, 564 aa, unidentified
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 2867 - protein, 568 aa, unidentified
MMGCWILNEGLSTILVLSWLGINFYLFIDTFYWYEEEESFHYTRVILGSTLAWARASALCLNFNCMLILIPVSRNLISFIRGTSICCRGPWRRQLDKNLRFHKLVAYGIAVNATIHIVAHFFNLERYHWSQSEEAQGLLAALSKLGNTPNESYLNPVRTFPTNTTTELLRTIAGVTGLVISLALVLIMTSSTEFIRQASYELFWYTHHVFIVFFLSLAIHGTGRIVRGQTQDSLSLHNITFCRDRYAEWQTVAQCPVPQFSGKEPSAWKWILGPVVLYACERIIRFWRFQQEVVITKVVSHPSGVLELHMKKRGFKMAPGQYILVQCPAISSLEWHPFTLTSAPQEDFFSVHIRAAGDWTAALLEAFGAEGQALQEPWSLPRLAVDGPFGTALTDVFHYPVCVCVAAGIGVTPFAALLKSIWYKCSEAQTPLKLSKVYFYWICRDARAFEWFADLLLSLETRMSEQGKTHFLSYHIFLTGWDENQALHIALHWDENTDVITGLKQKTFYGRPNWNNEFKQIAYNHPSSSIGVFFCGPKALSRTLQKMCHLYSSADPRGVHFYYNKESF

SEQ ID NO: 2868 - protein, 578 aa, unidentified
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 2869 - protein, 765 aa, unidentified
MNTSGDPAQTGPEGCRGTMSAEEDARWLRWVTQQFKTIAGEDGEISLQEFKAALHVKESFFAERFFALFDSDRSGTITLQELQEALTLLIHGSPMDKLKFLFQVYDIDVCARQGASAGTEWGAGAGPHWASSPLGTGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 2870 - protein, 328 aa, unidentified
MDNASFSEPWPANASGPDPALSCSNASTLAPLPAPLAVAVPVVYAVICAVGLAGNSAVLYVLLRAPRMKTVTNLFILNLAIADELFTLVLPINIADFLLRQWPFGELMCKLIVAIDQYNTFSSLYFLTVMSADRYLVVLATAESRRVAGRTYSAARAVSLAVWGIVTLVVLPFAVFARLDDEQGRRQCVLVFPQPEAFWWRASRLYTLVLGFAIPVSTICVLYTTLLCRLHAMRLDSHAKALERAKKRVTFLVVAILAVCLLCWTPYHLSTVVALTTDLPQTPLVIAISYFITSLSYANSCLNPFLYAFLDASFRRNLRQLITCRAAA

SEQ ID NO: 2871 - protein, 333 aa, unidentified
MQAAGHPEPLDSRGSFSLPTMGANVSQDNGTGHNATFSEPLPFLYVLLPAVYSGICAVGLTGNTAVILVILRAPKMKTVTNVFILNLAVADGLFTLVLPVNIAEHLLQYWPFGELLCKLVLAVDHYNIFSSIYFLAVMSVDRYLVVLATVRSRHMPWRTYRGAKVASLCVWLGVTVLVLPFFSFAGVYSNELQVPSCGLSFPWPEQVWFKASRVYTLVLGFVLPVCTICVLYTDLLRRLRAVRLRSGAKALGKARRKVTVLVLVVLAVCLLCWTPFHLASVVALTTDLPQTPLVISMSYVITSLSYANSCLNPFLYAFLDDNFRKNFRSILRC

SEQ ID NO: 2872 - protein, 1278 aa, unidentified
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHMKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 2873 - protein, 1359 aa, unidentified
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQRLPRRPGEPREVHIGRALGRVAPSMLLCSLSEAICFFLGALTPMPAVRTFALTSGLAVILDFLLQMSAFVALLSLDSKRQEASRLDVCCCVKPQELPPPGQGEGLLLGFFQKAYAPFLLHWITRGVVLLLFLALFGVSLYSMCHISVGLDQELALPKDSYLLDYFLFLNRYFEVGAPVYFVTTLGYNFSSEAGMNAICSSAGCNNFSFTQKIQYATEFPEQSYLAIPASSWVDDFIDWLTPSSCCRLYISGPNKDKFCPSTVNSLNCLKNCMSITMGSVRPSVEQFHKYLPWFLNDRPNIKCPKGGLAAYSTSVNLTSDGQVLDTVAILSPRLEYSGTISAHCNLYLLDSTSRFMAYHKPLKNSQDYTEALRAARELAANITADLRKVPGTDPAFEVFPYTITNVFYEQYLTILPEGLFMLSLCLVPTFAVSCLLLGLDLRSGLLNLLSIVMILVDTVGFMALWGISYNAVSLINLVSAVGMSVEFVSHITRSFAISTKPTWLERAKEATISMGSAVFAGVAMTNLPGILVLGLAKAQLIQIFFFRLNLLITLLGLLHGLVFLPVILSYVGPDVNPALALEQKRAEEAVAAVMVASCPNHPSRVSTADNIYVNHSFEGSIKGAGAISNFLPNNGRQF

SEQ ID NO: 2874 - protein, 325 aa, unidentified
MATPLPPPSPRHLRLLRLLLSGLVLGAALRGAAAGHPDVAACPGSLDCALKRRARCPPGAHACGPCLQPFQEDQQGLCVPRMRRPPGGGRPQPRLEDEIDFLAQELARKESGHSTPPLPKDRQRLPEPATLGFSARGQGLELGLPSTPGTPTPTPHTSLGSPVSSDPVHMSPLEPRGGQGDGLALVLILAFCVAGAAALSVASLCWCRLQREIRLTQKADYATAKAPGSPAAPRISPGDQRLAQSAEMYHYQHQRQQMLCLERHKEPPKELDTASSDEENEDGDFTVYECPGLAPTGEMEVRNPLFDHAALSAPLPAPSSPPALP

SEQ ID NO: 2875 - protein, 430 aa, unidentified
MEGEPSQPPNSSWPLSQNGTNTEATPATNLTFSSYYQHTSPVAAMFIVAYALIFLLCMVGNTLVCFIVLKNRHMHTVTNMFILNLAVSDLLVGIFCMPTTLVDNLITGWPFDNATCKMSGLVQGMSVSASVFTLVAIAVERFRCIVHPFREKLTLRKALVTIAVIWALALLIMCPSAVTLTVTREEHHFMVDARNRSYPLYSCWEAWPEKGMRRVYTTVLFSHIYLAPLALIVVMYARIARKLCQAPGPAPGGEEAADPRASRRRARVVHMLVMVALFFTLSWLPLWALLLLIDYGQLSAPQLHLVTVYAFPFAHWLAFFNSSANPIIYGYFNENFRRGFQAAFRARLCPRPSGSHKEAYSERPGGLLHRRVFVVVRPSDSGLPSESGPSSGAPRPGRLPLRNGRVAHHGLPREGPGCSHLPLTIPAWDI

SEQ ID NO: 2876 - protein, 522 aa, unidentified
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 2877 - protein, 1426 aa, unidentified
MNDWHRIFTQNVLVPPHPQRARQPWKESTAFQCVLKWLDGPVIRQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGDALRKPRLQKPITGHLDDLFFTLYPSLEKFEEELLELHVQDHFQEGCGPLDGGALEILERRLRVGVHNGLGFVQRPQVVVLVPEMDVALTRSASFSRKVVSSSKTSSGSQALVLRSRLRLPEMVGHPAFAVIFQLEYVFSSPAGVDGNAASVTSLSNLACMHMVRWAVWNPLLEADSGRVTLPLQGGIQPNPSHCLVYKVPSASMSSEEVKQVESGTLRFQFSLGSEEHLDAPTEPVSGPKVERRPSRKPPTSPSSPPAPVPRVLAAPQNSPVGPGLSISQLAASPRSPTQHCLARPTSQLPHGSQASPAQAQEFPLEAGISHLEADLSQTSLVLETSIAEQLQELPFTPLHAPIVVGTQTRSSAGQPSRASMVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKHLLRQGRPAVQASHELEVVATEYEQDNMVVSGDMLGFGRVKPIGVHSVVKGRLHLTLANVGHPCEQKVRGCSTLPPSRSRVISNDGASRFSGGSLLTTGSSRRKHVVQAQKLADVDSELAAMLLTHARQGKGPQDVSRESDATRRRKLERMRSVRLQEAGGDLGRRGTSVLAQQSVRTQHLRDLQVIAAYRERTKAESIASLLSLAITTEHTLHATLGVAEFFEFVLKNPHNTQHTVTVEIDNPELSVIVDSQEWRDFKGAAGLHTPVEEDMFHLRGSLAPQLYLRPHETAHVPFKFQSFSAGQLAMVQASPGLSNEKGMDAVSPWKSSAVPTKHAKVLFRASGGKPIAVLCLTVELQPHVVDQVFRFYHPELSFLKKAIRLPPWHTFPGAPVGMLGEDPPVHVRCSDPNVICETQNVGPGEPRDIFLKVASGPSPEIKDFFVIIYSDRWLATPTQTWQVYLHSLQRVDVSCVAGQLTRLSLVLRGTQTVRKVRAFTSHPQELKTDPKGVFVLPPRGVQDLHVGVRPLRAGSRFVHLNLVDVDCHQLVASWLVCLCCRQPLISKAFEIMLAAGEGKGVNKRITYTNPYPSRRTFHLHSDHPELLRFREDSFQVGGGETYTIGLQFAPSQRVGEEEILIYINDHEDKNEEAFCVKVIYQ

SEQ ID NO: 2878 - protein, 1241 aa, unidentified
MALGTTLRASLLLLGLLTEGLAQLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPSGPSGLPLLPVLFALGGLLLLSNASCVGGVLWQRRLRRLAEGISEKTEAGSEEDRVRNEYEESQWTGERDTQSSTVSTTEAEPYYRSLRDFSPQLPPTQEEVSYSRGFTGEDEDMAFPGHLYDEVERTYPPSGAWGPLYDEVQMGPWDLHWPEDTYQDPRGIYDQVAGDLDTLEPDSLPFELRGHLV

SEQ ID NO: 2879 - protein, 383 aa, unidentified
MERRARSSSRESRGRGGRTPHKENKRAKAERSGGGRGRQEAGPEPSGSGRAGTPGEPRAPAATVVDVDEVRGSGEEGTEVVALLESERPEEGTKSSGLGACEWLLVLISLLFIIMTFPFSIWFCVKVVQEYERVIIFRLGHLLPGRAKGPGLFFFLPCLDTYHKVDLRLQTLEIPFHEIVTKDMFIMEIDAICYYRMENASLLLSSLAHVSKAVQFLVQTTMKRLLAHRSLTEILLERKSIAQDAKVALDSVTCIWGIKVERIEIKDVRLPAGLQHSLAVEAEAQRQAKVRMIAAEAEKAASESLRMAAEILSGTPAAVQLRYLHTLQSLSTEKPSTVVLPLPFDLLNCLSSPSNRTQGSLPFPSPSKPVEPLNPKKKDSPML

SEQ ID NO: 2880 - protein, 350 aa, unidentified
MFCCLGYEWLSGGCKTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECLLTPLPPSALPSADDNLKTPAECLLYPLPPSADDNLKTPPECLLTPLPPSAPPSVDDNLKTPPECVCSLPFHPQRMIISRN

SEQ ID NO: 2881 - protein, 317 aa, unidentified
MVKLSIVLTPRFLSHDQGQLTKELQQHVKSVTCPCEYLRKVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKICKMKVTTKVNRHDKINGKRKTAKEHLRKLSMKEREHGEKERQVSEAEENGKLDMKEIHTYMEMFQRAQALRRRAEDYYRCKITPSARKPLCNRVSLLVFLAFGHSLPGQDMDTFFSLRLCAQALQREMAERKAAYKHHSPIPVGNRVAQKHLHPHPVGPPSNILSVRGSVFVIANGP

SEQ ID NO: 2882 - protein, 317 aa, unidentified; identical to SEQ ID NO: 2881

SEQ ID NO: 2883 - protein, 153 aa, unidentified
MAAVEHRHSSGLPYWPYLTAETLKNRMGHQPPPPTQQHSIIDNSLSLKTPSECVLYPLPPSADDNLKTPPECLLTPLPPSALPSADDNLKTPAECLLYPLPPSADDNLKTPPECLLTPLPPSAPPSADDNLKTPPECVCSLPFHPQRMIISRN

SEQ ID NO: 2884 - protein, 153 aa, unidentified; identical to SEQ ID NO: 2883

SEQ ID NO: 2885 - protein, 1050 aa, unidentified
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTALPPSADDNIKTPAERLRGPLPPSADDNLKTPSERQLTPLPPSAPPSADDNIKTPAFHPQRMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 2886 - protein, 1133 aa, unidentified
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTALPPSADDNIKTPAERLRGPLPPSADDNLKTPSERQLTPLPPSAPPSADDNIKTPAFHPQRMISRHLPSVSSLPFHPQLHPQQMIISRYLLSVCGFRFHHQPMIISRHLPSVSSLPFHPQLHPQQMIISRHLPSVCGGRFHPERMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 2887 - protein, 425 aa, unidentified
MVKLSIVLTPQFLSHDQSQLTKELQQHVKSVTCPCEYLRKVINSLAVYRHRETDFGVGVRDHPGQHGKTPSPQKLDNLIIIIIGFLRRYTFNILFCTSCLCVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMVAAEHRHSSGLPYWPYLTAETLKNRMGRQPPPPTQQHSITDNSLSLKTPTECLLTPLPPSVDDNIKECPLAPLPPSPLPPSVDDNLKECLFVPLPPSPLPPSVDDNLKTPPLATQEAEVEKPPKPKRWRVDEVEQSPKPKRRRVDEVEQSPKPKRQREAEAQQLPKPKRRRLSKLRTRHCTQAWAIRINP

SEQ ID NO: 2888 - protein, 421 aa, unidentified [sequence omitted]

SEQ ID NO: 2889 - protein, 1061 aa, unidentified
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLEVLALVGSLSLLGILIVSFFIYRKMQLEKELASELWRVRWEDVEPSSLERHLRSAGSRLTLSGRGSNYGSLLTTEGQFQVFAKTAYYKGNLVAVKRVNRKRIELTRKVLFELKHMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGKGKVRTYWLLGERGSSTRG

SEQ ID NO: 2890 - protein, 1047 aa, unidentified
MALPSLLLLVAALAGGVRPPGARNLTLAVVLPEHNLSYAWAWPRVGPAVALAVEALGRALPVDLRFVSSELEGACSEYLAPLSAVDLKLYHDPDLLLGPGCVYPAASVARFASHWRLPLLTAGAVASGFSAKNDHYRTLVRTGPSAPKLGEFVVTLHGHFNWTARAALLYLDARTDDRPHYFTIEGVFEALQGSNLSVQHQVYAREPGGPEQATHFIRANGRIVYICGPLEMLHEILLQAQRENLTNGDYVFFYLDVFGESLRAGPTRATGRPWQDNRTREQAQALREAFQTVLVITYREPPNPEYQEFQNRLLIRAREDFGVELGPSLMNLIAGCFYDGILLYAEVLNETIQEGGTREDGLRIVEKMQGRRYHGVTGLVVMDKNNDRETDFVLWAMGDLDSGDFQPAAHYSGAEKQIWWTGRPIPWVKGAPPSDNPPCAFDLDDPSCDKTPLSTLAIVALGTGITFIMFGVSSFLIFRKLMLEKELASMLWRIRWEELQFGNSERYHKGAGSRLTLSLRGSSYGSLMTAHGKYQIFANTGHFKGNVVAIKHVNKKRIELTRQVLFELKHMRDVQFNHLTRFIGACIDPPNICIVTEYCPRGSLQDILENDSINLDWMFRYSLINDLVKGMAFLHNSIISSHGSLKSSNCVVDSRFVLKITDYGLASFRSTAEPDDSHALYAKKLWTAPELLSGNPLPTTGMQKADVYSFGIILQEIALRSGPFYLEGLDLSPKEIVQKVRNGQRPYFRPSIDRTQLNEELVLLMERCWAQDPAERPDFGQIKGFIRRFNKEGGTSILDNLLLRMEQYANNLEKLVEERTQAYLEEKRKAEALLYQILPHSVAEQLKRGETVQAEAFDSVTIYFSDIVGFTALSAESTPMQVVTLLNDLYTCFDAIIDNFDVYKVETIGDAYMVVSGLPGRNGQRHAPEIARMALALLDAVSSFRIRHRPHDQLRLRIGVHTGPVCAGVVGLKMPRYCLFGDTVNTASRMESNGQALKIHVSSTTKDALDELGCFQLELRGDVEMKGKGKMRTYWLLGERKGPPGLL

SEQ ID NO: 2891 - protein, 541 aa, unidentified
MPSLLVLTFSPCVLLGWALLAGGTGGGGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSSGGLEESAVTGIVVGALLGAGLLMAFYFFRKKYRITIERRTQQEESNLGKHRELREDSIRSHFSVA

SEQ ID NO: 2892 - protein, 371 aa, unidentified
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVVLLYASTYVLVSLSIDRYHAIVYPMKFLQGEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCREQRSQDSRMTFRERTERHEMQILSKPEFI

SEQ ID NO: 2893 - protein, 398 aa, unidentified
MSGSSLPSALALSLLLVSGSLLPGPGAAQNAGFVKSPMSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 2894 - protein, 384 aa, unidentified
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 2895 - protein, 381 aa, unidentified
MGPIGAEADENQTVEEMKVEQYGPQTTPRGELVPDPEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 2896 - protein, 375 aa, unidentified
MNTSHLLALLLPKSPQGENRSKPLGTPYNFSEHCQDSVDVMVFIVTSYSIETVVGVLGNLCLMCVTVRQKEKANVTNLLIANLAFSDFLMCLLCQPLTAVYTIMDYWIFGETLCKMSAFIQCMSVTVSILSLVLVALERHQLIINPTGWKPSISQAYLGIVLIWVIACVLSLPFLANSILENVFHKNHSKALEFLADKVVCTESWPLAHHRTIYTTFLLLFQYCLPLGFILVCYARIYRRLQRQGRVFHKGTYSLRAGHMKQVNVVLVVMVVAFAVLWLPLHVFNSLEDWHHEAIPICHGNLIFLVCHLLAMASTCVNPFIYGFLNTNFKKEIKALVLTCQQSAPLEESEHLPLSTVHTEVSKGSLRLSGRSNPI

SEQ ID NO: 2897 - protein, 445 aa, unidentified
MDLELDEYYNKTLATENNTAATRNSDFPVWDDYKSSVDDLQYFLIGLYTFVSLLGFMGNLLILMALMKKRNQKTTVNFLIGNLAFSDILVVLFCSPFTLTSVLLDQWMFGKVMCHIMPFLQCVSVLVSTLILISIAIVRYHMIKHPISNNLTANHGYFLIATVWTLGFAICSPLPVFHSLVELQETFGSALLSSRYLCVESWPSDSYRIAFTISLLLVQYILPLVCLTVSHTSVCRSISCGLSNKENRLEENEMINLTLHPSKKSGPQVKLSGSHKWSYSFIKKHRRRYSKKTACVLPAPERPSQENHSRILPENFGSVRSQLSSSSKFIPGVPTCFEIKPEENSDVHELRVKRSVTRIKKRSRSVFYRLTILILVFAVSWMPLHLFHVVTDFNDNLISNRHFKLVYCICHLLGMMSCCLNPILYGFLNNGIKADLVSLIHCLHM

SEQ ID NO: 2898 - protein, 1304 aa, unidentified
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 2899 - protein, 1164 aa, unidentified
MALFPAFAGLSEAPDGGSSRKELDWLSNPSFCVGSITSLSQQTEAAPAHVSEGLPLTRSHLKSESSDESDTNKKLKQTSRKKKKEKKKKRKHQHHKKTKRKHGPSSSSRSETDTDSEKDKPSRGVGGSKKESEEPNQGNNAAADTGHRFVWLEDIQAVTGETFRTDKKPDPANWEYKSLYRGDIARYKRKGDSCLGINPKKQCISWEGTSTEKKHSRKQVERYFTKKSVGLMNIDGVAISSKTEPPSSEPISFIPVKDLEDAAPVTTWLNPLGIYDQSTTHWLQGQGPPEQESKQPDAQPDSESAALKAKVEEFNRRVRENPRDTQLWMAFVAFQDEVMKSPGLYAIEEGEQEKRKRSLKLILEKKLAILERAIESNQSSVDLKLAKLKLCTEFWEPSTLVKEWQKLIFLHPNNTALWQKYLLFCQSQFSTFSISKIHSLYGKCLSTLSAVKDGSILSHPALPGTEEAMFALFLQQCHFLRQAGHSEKAISLFQAMVDFTFFKPDSVKDLPTKGQVEFFEPFWDSGEPRAGEKGARGWKAWMHQQERGGWVVINPDEDDDEPEEDDQEIKDKTLPRWQIWLAAERSRDQRHWRPWRPDKTKKQTEEDCEDPERQVLFDDIGQSLIRLSSHDLQFQLVEAFLQFLGVPSGFTPPASCLYLAMDENSIFDNGLYDEKPLTFFNPLFSGASCVGRMDRLGYPRWTRGQNREGEEFIRNVFHLVMPLFSGKEKSQLCFSWLQYEIAKVIWCLHTKNKKRLKSQGKNCKKLAKNLLKEPENCNNFCLWKQYAHLEWLLGNTEDARKVFDTALGMAGSRELKDSDLCELSLLYAELEVELSPEVRRAATARAVHILTKLTESSPYGPYTGQVLAVHILKARKAYEHALQDCLGDSCVSNPAPTDSCSRLISLAKCFMLFQYLTIGIDAAVQIYEQVFAKLNSSVFPEGSGEGDSASSQSWTSVLEAITLMHTSLLRFHMKVSVYPLAPLREALSQALKLYPGNQVLWRSYVQIQNKSHSASKTRRFFDTITRSAKPLEPWLFAIEAEKLRKRLVETVQRLDGREIHATIPETGLMHRIQALFENAMRSDSGSQCPLLWRMYLNFLVSLGNKERSKGVFYKALQNCPWAKVLYLDAVEYFPDEMQEILDLMTEKELRVRLPLEELELLLED

SEQ ID NO: 2900 - protein, 640 aa, unidentified
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 2901 - protein, 850 aa, unidentified
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 2902 - protein, 720 aa, unidentified
MSEGAAAASPPGAASAAAASAEEGTAAAAAAAAAGGGPDGGGEGAAEPPRELRCSDCIVWNRQQTWLCVVPLFIGFIGLGLSLMLLKWIVVGSVKEYVPTDLVDSKGMGQDPFFLSKPSSFPKAMETTTTTTSTTSPATPSAGGAASSRTPNRISTRLTTITRAPTRFPGHRVPIRASPRSTTARNTAAPATVPSTTAPFFSSSTLGSRPPVPGTPSTQAMPSWPTAAYATSSYLHDSTPSWTLSPFQDAASSSSSSSSSATTTTPETSTSPKFHTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGIEVRKTISHLPIQLWCVERPLDLKYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 2903 - protein, 115 aa, unidentified
MPTDHEEPCGPSHKSFCLNGGLCYVIPTIPSPFCRCVENYTGARCEEVFLPGSSIQTKSNLFEAFVALAVLVTLIIGAFYFLCRKGHFQRASSVQYDINLVETSSTSAHHSHEQH

SEQ ID NO: 2904 - protein, 1582 aa, unidentified
MAGPGGWRDREVTDLGHLPDPTGIFSLDKTIGLGTYGRIYLGLHEKTGAFTAVKVMNARKTPLPEIGRRVRVNKYQKSVGWRYSDEEEDLRTELNLLRKYSFHKNIVSFYGAFFKLSPPGQRHQLWMVMELCAAGSVTDVVRMTSNQSLKEDWIAYICREILQGLAHLHAHRVIHRDIKGQNVLLTHNAEVKLVDFGVSAQVSRTNGRRNSFIGTPYWMAPEVIDCDEDPRRSYDYRSDVWSVGITAIEMAEGAPPLCNLQPLEALFVILRESAPTVKSSGWSRKFHNFMEKCTIKNFLFRPTSANMLQHPFVRDIKNERHVVESLTRHLTGIIKKRQKKGIPLIFEREEAIKEQYTVRRFRGPSCTHELLRLPTSSRCRPLRVLHGEPSQPRWLPDREEPQVQALQQLQGAARVFMPLQALDSAPKPLKGQAQAPQRLQGAARVFMPLQAQVKAKASKPLQMQIKAPPRLRRAARVLMPLQAQVRAPRLLQVQSQVSKKQQAQTQTSEPQDLDQVPEEFQGQDQVPEQQRQGQAPEQQQRHNQVPEQELEQNQAPEQPEVQEQAAEPAQAETEAEEPESLRVNAQVFLPLLSQDHHVLLPLHLDTQVLIPVEGQTEGSPQAQAWTLEPPQAIGSVQALIEGLSRDLLRAPNSNNSKPLGPLQTLMENLSSNRFYSQPEQAREKKSKVSTLRQALAKRLSPKRFRAKSSWRPEKLELSDLEARRQRRQRRWEDIFNQHEEELRQVDKDKEDESSDNDEVFHSIQAEVQIEPLKPYISNPKKIEVQERSPSVPNNQDHAHHVKFSSSVPQRSLLEQAQKPIDIRQRSSQNRQNWLAASESSSEEESPVTGRRSQSSPPYSTIDQKLLVDIHVPDGFKVGKISPPVYLTNEWVGYNALSEIFRNDWLTPAPVIQPPEEDGDYVELYDASADTDGDDDDESNDTFEDTYDHANGNDDLDNQVDQANDVCKDHDDDNNKFVDDVNNNYYEAPSCPRASYGRDGSCKQDGYDGSRGKEEAYRGYGSHTANRSHGGSAASEDNAAIGDQEEHAANIGSERRGSEGDGGKGVVRTSEESGALGLNGEENCSETDGPGLKRPASQDFEYLQEEPGGGNEASNAIDSGAAPSAPDHESDNKDISESSTQSDFSANHSSPSKGSGMSADANFASAILYAGFVEVPEESPKQPSEVNVNPLYVSPACKKPLIHMYEKEFTSEICCGSLWGVNLLLGTRSNLYLMDRSGKADITKLIRRRPFRQIQVLEPLNLLITISGHKNRLRVYHLTWLRNKILNNDPESKRRQEEMLKTEEACKAIDKLTGCEHFSVLQHEETTYIAIALKSSIHLYAWAPKSFDESTAIKVCIDQSADSEGDYMSYQAYIRILAKIQAADPVNRFKRPDELLHLLKLKVFPTLDHKPVTVDLAIGSEKRLKIFFSSADGYHLIDAESEVMSDVTLPKNPLEIIIPQNIIILPDCLGIGMMLTFNAEALSVEANEQLFKKILEMWKDIPSSIAFECTQRTTGWGQKAIEVRSLQSRVLESELKRRSIKKLRFLCTRGDKLFFTSTLRNHHSRVYFMTLGKLEELQSNYDV

SEQ ID NO: 2905 - protein, 262 aa, unidentified
MAPALLLIPAALASFILAFGTGVEFVRFTSLRPLLGGIPESGGPDARQGWLAALQDRSILAPLAWDLGLLLLFVGQHSLMAAERVKAWTSRYFGVLQRSLYVACTALALQLVMRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 2906 - protein, 142 aa, unidentified
MGLKLNGRYISLILAVQIAYLVQAVRAAGKCDAVFKGFSDCLLKLGDSMANYPQGLDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 2907 - protein, 923 aa, unidentified
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 2908 - protein, 931 aa, unidentified
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 2909 - protein, 692 aa, unidentified
MELLPLWLCLGFHFLTVGWRNRSGTATAASQGVCKLVGGAADCRGQSLASVPSSLPPHARMLTLDANPLKTLWNHSLQPYPLLESLSLHSCHLERISRGAFQEQGHLRSLVLGDNCLSENYEETAAALHALPGLRRLDLSGNALTEDMAALMLQNLSSLRSVSLAGNTIMRLDDSVFEGLERLRELDLQRNYIFEIEGGAFDGLAELRHLNLAFNNLPCIVDFGLTRLRVLNVSYNVLEWFLATGGEAAFELETLDLSHNQLLFFPLLPQYSKLRTLLLRDNNMGFYRDLYNTSSPREMVAQFLLVDGNVTNITTVSLWEEFSSSDLADLRFLDMSQNQFQYLPDGFLRKMPSLSHLNLHQNCLMTLHIREHEPPGALTELDLSHNQLSELHLAPGLASCLGSLRLFNLSSNQLLGVPPGLFANARNITTLDMSHNQISLCPLPAASDRVGPPSCVDFRNMASLRSLSLEGCGLGALPDCPFQGTSLTYLDLSSNWGVLNGSLAPLQDVAPMLQVLSLRNMGLHSSFMALDFSGFGNLRDLDLSGNCLTTFPRFGGSLALETLDLRRNSLTALPQKAVSEQLSRGLRTIYLSQNPYDCCGVDGWGALQHGQTVADWAMVTCNLSSKIIRVTELPGGVPRDCKWERLDLGLLYLVLILPSCLTLLVACTVIVLTFKKPLLQVIKSRCHWSSVY

SEQ ID NO: 2910 - protein, 195 aa, unidentified
MSSCSNVCGSRQAQAAAEGGYQRYGVRSYLHQFYEDCTASIWEYEDDFQIQRSPNRWSSVFWKVGLISGTVFVILGLTVLAVGFLVPPKIEAFGEADFVVVDTHAVQFNSALDMYKLAGAVLFCIGGTSMAGCLLMSVFVKSYSKEEKFLQQKFKERIADIKAHTQPVTKAPGPGETKIPVTLSRVQNVQPLLAT

SEQ ID NO: 2911 - protein, 204 aa, unidentified
MMPSCNRSCSCSRGPSVEDGKWYGVRSYLHLFYEDCAGTALSDDPEGPPVLCPRRPWPSLCWKISLSSGTLLLLLGVAALTTGYAVPPKLEGIGEGEFLVLDQRAADYNQALGTCRLAGTALCVAAGVLLAICLFWAMIGWLSQDTKAEPLDPEADSHVEVFGDEPEQQLSPIFRNASGQSWFSPPASPFGQSSVQTIQPKRDS

SEQ ID NO: 2912 - protein, 1477 aa, unidentified
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 2913 - protein, 1712 aa, unidentified
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVNKLHYLVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 2914 - protein, 1643 aa, unidentified
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEDVSQDPGLSHLMMSEQAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 2915 - protein, 373 aa, unidentified
MEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAARNGKMKFVIGNGKNLVDFTFVENVVHGHILAAEQLSRDSTLGGKAFHITNDEPIPFWTFLSRILTGLNYEAPKYHIPYWVAYYLALLLSLLVMVISPVIQLQPTFTPMRVALAGTFHYYSCERAKKAMGYQPLVTMDDAMERTVQSFRHLRRVK

SEQ ID NO: 2916 - protein, 574 aa, unidentified
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 2917 - protein, 344 aa, unidentified
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 2918 - protein, 796 aa, unidentified
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 2919 - protein, 822 aa, unidentified
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 2920 - protein, 839 aa, unidentified
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 2921 - protein, 418 aa, unidentified
MRLNSSAPGTPGTPAADPFQRAQAGLEEALLAPGFGNASGNASERVLAAPSSELDVNTDIYSKVLVTAVYLALFVVGTVGNTVTAFTLARKKSLQSLQSTVHYHLGSLALSDLLTLLLAMPVELYNFIWVHHPWAFGDAGCRGYYFLRDACTYATALNVASLSVERYLAICHPFKAKTLMSRSRTKKFISAIWLASALLAVPMLFTMGEQNRSADGQHAGGLVCTPTIHTATVKVVIQVNTFMSFIFPMVVISVLNTIIANKLTVMVRQAAEQGQVCTVGGEHSTFSMAIEPGRVQALRHGVRVLRAVVIAFVVCWLPYHVRRLMFCYISDEQWTPFLYDFYHYFYMVTNALFYVSSTINPILYNLVSANFRHIFLATLACLCPVWRRRRKRPAFSRKADSVSSNHTLSSNATRETLY

SEQ ID NO: 2922 - protein, 410 aa, unidentified
METSSPRPPRPSSNPGLSLDARLGVDTRLWAKVLFTALYALIWALGAAGNALSAHVVLKARAGRAGRLRHHVLSLALAGLLLLLVGVPVELYSFVWFHYPWVFGDLGCRGYYFVHELCAYATVLSVAGLSAERCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSVQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 2923 - protein, 628 aa, unidentified
MESLVFARRSGPTPSAAELARPLAEGLIKSPKPLMKKQAVKRHHHKHNLRHRYEFLETLGKGTYGKVKKARESSGRLVAIKSIRKDKIKDEQDLMHIRREIEIMSSLNHPHIIAIHEVFENSSKIVIVMEYASRGDLYDYISERQQLSEREARHFFRQIVSAVHYCHQNRVVHRDLKLENILLDANGNIKIADFGLSNLYHQGKFLQTFCGSPLYASPEIVNGKPYTGPEVDSWSLGVLLYILVHGTMPFDGHDHKILVKQISNGAYREPPKPSDACGLIRWLLMVNPTRRATLEDVASHWWVNWGYATRVGEQEAPHEGGHPGSDSARASMADWLRRSSRPLLENGAKVCSFFKQHAPGGGSTTPGLERQHSLKKSRKENDMAQSLHSDTADDTAHRPGKSNLKLPKGILKKKVSASAEGVQEDPPELSPIPASPGQAAPLLPKKGILKKPRQRESGYYSSPEPSESGELLDAGDVFVSGDPKEQKPPQASGLLLHRKGILKLNGKFSQTALELAAPTTFGSLDELAPPRPLARASRPSGAVSEDSILSSESFDQLDLPERLPEPPLRGCVSVDNLTGLEEPPSEGPGSCLRRWRQDPLGDSCFSLTDCQEVTATYRQALRVCSKLT

SEQ ID NO: 2924 - protein, 331 aa, unidentified
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 2925 - protein, 925 aa, unidentified
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 2926 - protein, 1749 aa, unidentified
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 2927 - protein, 2012 aa, unidentified
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKETSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLLRISRN

SEQ ID NO: 2928 - protein, 1887 aa, unidentified
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPARPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGIRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLAPVYTSPQLDMSCPLLQQNKQVVPVSSHRNPRLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVHPLLPGSSTIMIHDLCLVFPAPAKAVVYVSDIQELYIRVVDKVEIGKTVKAYVRVLDLHKKPFLAKYFPFMDLKLRAASPIITLVALDEALDNYTITFLIRGVAIGQTSLTASVTNKAGQRINSAPQQIEVFPPFRLMPRKVTLLIGATMQVTSEGGPQPQSNILFSISNESVALVSAAGLVQGLAIGNGTVSGLVQAVDAETGKVVIISQDLVQVEVLLLRAVRIRAPIMRMRTGTQMPIYVTGITNHQNPFSFGNAVPGLTFHWSVTKRDVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVLDPAAGSQGPLSTTLTFSSPVTNQAIAIPVTVAFVVDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 2929 - protein, 1888 aa, unidentified
MTGCPASSRRRGFGLFFFLRLHRLLLLFLVLRGTLANKLNVPQVLLPFGREPGRVPFLLEAQRGCYTWHSTHHDAVTVEPLYENGTLCSQKAVLIAESTQPIRLSSIILAREIVTDHELRCDVKVDVINSIEIVSRARELYVDDSPLELMVRALDAEGNTFSSLAGMMFEWSIAQDNESAREELSSKIRILKYSEAEYAPPIYIAEMEKEEKQGDVILVSGIRTGAAVVKVRIHEPFYKKVAAALIRLLVLENIFLIPSHDIYLLVGTYIKYQVAKMVQGRVTEVKFPLEHYILELQDHRVALNGSHSEKVAILDDKTAMVTASQLGQTNLVFVHKNVHMRSVSGLPNCTIYVVEPGFLGFTVQPGNRWSLEVGQVYVITVDVFDKSSTKVYISDNLRITYDFPKEYFEEQLTTVNGSYHIVKALKDGVVVINASLTSIIYQNKDIQPIKFLIKHQQEVKIYFPIMLTPKFLAFPHHPMGMLYRYKVQVEGGSGNFTWTSSNETVVIVTTKGVVTAGQVRGNSTVLARDVQNPFRYGEIKIHVLKLNKMELLPFHADVEIGQIIEIPIAMYHINKETKEAMAFTDCSHLSLDLNMDKQGVFTLLKEGIQRPGPMHCSSTHIAAKSLGHTLVTVSVNECDKYLESSATFAAYEPLKALNPVEVALVTWQSVKEMVFEGGPRPWILEPSRFFLELNAEKTEKIGIAQVWLPSKRKQNQYIYRIQCLDLGEQVLTFRIGNHPGVLNPSPAVEVLQVRFICAHPASMSVTPVYKVPAGAQPCPLPQHNKWLIPVSRLRDTVLELAVFDQHRRKFDNFSSLMLEWKSSNETLAHFEDYKSVEMVAKDDGSGQTRLHGHQILKVHQIKGTVLIGVNFVGYSEKKSPKEISNLPRSVDVELLLVDDVTVVPENATIYNHPDVKETFSLVEGSGYFLVNSSEQGVVTITYMEAESSVELVPLHPGFFTLEVYDLCLAFLGPATAHLRVSDIQELELDLIDKVEIDKTVLVTVRVLGSSKRPFQNKYFRNMELKLQLASAIVTLTPMEQQDEYSENYILRATTIGQTTLVAIAKDKMGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKGVYVCIIKVRPQSEELLQALSVADTSVYGWATLVSERSKNGMQRILIPFIPAFYINQSELVLSHKQDIGEIRVLGVDRVLRKLEVISSSPVLVVAGHSHSPLTPGLAIYSVRVVNFTSFQQMASPVFINISCVLTSQSEAVVVRAMKDKLGADHCEDSAILKRFTGSYQILLLTLFAVLASTASIFLAYNAFLNKIQTVPVVYVPTLGTPQPGFFNSTSSPPHFMSLQPPLAQSRLQHWLWSIRH

SEQ ID NO: 2930 - protein, 819 aa, unidentified
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 2931 - protein, 293 aa, unidentified
MTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGKADIVRAAQDFCQLVAQKQKRPTDLDVDTLASLLSSNGCPDPDLVLKFGPVDSTLGFLPWHIRLTEIVSLPSHLNISYEDFFSALRQYAACEQRLGK

SEQ ID NO: 2932 - protein, 547 aa, unidentified
MSSNTMLQKTLLILISFSVVTWMIFIISQNFTKLWSALNLSISVHYWNNSAKSLFPKTSLIPLKPLTETELRIKEIIEKLDQQIPPRPFTHVNTTTSATHSTATILNPRDTYCRGDQLDILLEVRDHLGQRKQYGGDFLRARMSSPALTAGASGKVMDFNNGTYLVSFTLFWEGQVSLSLLLIHPSEGASALWRARNQGYDKIIFKGKFVNGTSHVFTECGLTLNSNAELCEYLDDRDQEAFYCMKPQHMPCEALTYMTTRNREVSYLTDKENSLFHRSKVGVEMMKDRKHIDVTNCNKREKIEETCQVGMKPPVPGGYTLQGKWITTFCNQVQLDTIKINGCLKGKLIYLLGDSTLRQWIYYFPKVVKTLKFFDLHETGIFKKHLLLDAERHTQIQWKKHSYPFVTFQLYSLIDHDYIPREIDRLSGDKNTAIVITFGQHFRPFPIDIFIRRAIGVQKAIERLFLRSPATKVIIKTENIREMHIETERFGDFHGYIHYLIMKDIFKDLNVGIIDAWDMTIAYGTDTIHPPDHVIGNQINMFLNYIC

SEQ ID NO: 2933 - protein, 838 aa, unidentified
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFRLGFPMMVVSCTVGMCYLLVAHVVVGWN

SEQ ID NO: 2934 - protein, 245 aa, unidentified
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 2935 - protein, 44 aa, unidentified
MGMYPPLLLKIYLSRHISILFYLKILYKSGIIWLSWYSFILLVL

SEQ ID NO: 2936 - protein, 522 aa, unidentified
MSSRPLESPPPYRPDEFKPNHYAPSNDIYGGEMHVRPMLSQPAYSFYPEDEILHFYKWTSPPGVIRILSMLIIVMCIAIFACVASTLAWDRGYGTSLLGGSVGYPYGGSGFGSYGSGYGYGYGYGYGYGGYTDPRAAKGFMLAMAAFCFIAALVIFVTSVIRSEMSRTRRYYLSVIIVSAILGIMVFIATIVYIMGVNPTAQSSGSLYGSQIYALCNQFYTPAATGLYVDQYLYHYCVVDPQEAIAIVLGFMIIVAFALIIFFAVKTRRKMDRYDKSNILWDKEHIYDEQPPNVEEWVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 2937 - protein, 566 aa, unidentified
MPGHPGAAEQLVKTGWRSWHLGFWKALAPLQAAWDAFSQPVPASCGQLLTQLLLCASLAAAAAGLVYHWLASLLLYPPGPSAMVATVCGLLVFLSLGLVPPVRCLFALSVPTLGMEQGRRLLLSYSTATLAIAVVPNVLANVGAAGQVLRCVTEGSLESLLNTTHQLHAASRALGPTGQAGSRGLTFEAQDNGSAFYLHMLRVTQQVLEDFSGLESLARAAALGTQRVVTGLFMLGLLVESAWYLHCYLTDLRFDNIYATQQLTQRLAQAQATHLLAPPPTWLLQAAQLRLSQEELLSCLLRLGLLALLLVATAVAVATDHVAFLLAQATVDWAQKLPTVPITLTVKYDVAYTVLGFIPFLFNQLAPESPFLSVHSSYQWELRLTSARCPLLPARRPRAAAPLAAGALQLLAGSTVLLEAYARRLRHAIAASFFTAQEARRVRHLHARLQRRHDRHQGQQLPLGDPSCVPTPRPACKPPAWIDYRLDALRTESSEGEGKELWSCRDLSCNLGPVPPPCVTLGKSLHLSEPRFLHLHNDSIFTIDVTYFPRRDVVRMEGNTGHDRPG

SEQ ID NO: 2938 - protein, 257 aa, unidentified
MDAEYSGNEFPRSEGERDQHQRPGKERKSGEAGWGTGELGQDGRLLSSTLSLSSNRSLGQRQNSPLPFQWRITHSFRWMAQVLASELSLVAFILLLVVAFSKKWLDLSRSLFYQRWPVDVSNRIHTSAHVMSMGLLHFYKSRSCSDLENGKVTFIFSTLMLFPINIWIFELERNVSIPIGWSYFIGWLVLILYFTCAILCYFNHKSFWSLILSHPSGAVSCSSSFGSVEESPRAQTITDTPITQEGVLDPEQKDTHV

SEQ ID NO: 2939 - protein, 319 aa, unidentified
MAPQRRAATKAPEGNGAAERRNRSSTKKDRAPREVQRLWQRPWLRTAGLGAGFVLTALLLWSSLGADDGVAEVLARRGEVVAGRFIEVPCSEDYDSHRRFEGCTPRKCGRGVTDVVITREEAERIRSVAEKGLSLGGSDGGASILDLHSGALSVGKHFVNLYRYFGDKIQNIFSEEDFRLYREVRQKVQLTIAEAFGISASSLHLTKPTFFSRINSTEARTAHDEYWHAHVDKVTYGSFDYTSLLYLSNYLEDFGGGRFMFMEEGANKTVEPRAGRVSFFTSGSENLHRVEKVHWGTRYAITIAFSCNPDHGIEDPAFP

SEQ ID NO: 2940 - protein, 273 aa, unidentified
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLDFIQQAISYSSFPFWMGLSRRNPSYPWLWEDGSPLMPHLFRVRGAVSQTYPSGTCAYIQRGAVYAENCILAAFSICQKKANLRAQ

SEQ ID NO: 2941 - protein, 524 aa, unidentified
MSFICGLQSAARNHVFFRFNSLSNWRKCNTLASTSRGCHQVQVNHIVNKYQGLGVNQCDRWSFLPGNFHFYSTFNNKRTGGLSSTKSKEIWRITSKCTVWNDAFSRQLLIKEVTAVPSLSVLHPLSPASIRAIRNFHTSPRFQAAPVPLLLMILKPVQKLFAIIVGRGIRKWWQALPPNKKEVVKENIRKNKWKLFLGLSSFGLLFVVFYFTHLEVSPITGRSKLLLLGKEQFRLLSELEYEAWMEEFKNDMLTEKDARYLAVKEVLCHLIECNKDVPGISQINWVIHVVDSPIINAFVLPNGQMFVFTGFLNSVTDIHQLSFLLGHEIAHAVLGHAAEKAGMVHLLDFLGMIFLTMIWAICPRDSLALLCQWIQSKLQEYMFNRPYSRKLEAEADKIGLLLAAKACADIRASSVFWQQMEFVDSLHGQPKMPEWLSTHPSHGNRVEYLDRLIPQALKIREMCNCPPLSNPDPRLLFKLSTKHFLEESEKEDLNITKKQKMDTLPIQKQEQIPLTYIVEKRTGS

SEQ ID NO: 2942 - protein, 179 aa, unidentified
MVVGAFPMAKLLYLGIRQVSKPLANRIKEAARRSEFFKTYICLPPAQLYHWVEMRTKMRIMGFRGTVIKPLNEEAAAELGAELLGEATIFIVGGGCLVLEYWRHQAQQRHKEEEQRAAWNALRDEVGHLALALEALQAQVQAAPPQGALEELRTELQEVRAQLCNPGRSASHAVPASKK

SEQ ID NO: 2943 - protein, 141 aa, unidentified
MSFSLNFTLPANTTSSPVTGGKETDCGPSLGLAAGIPLLVATALLVALLFTLIHRRRSSIEAMEESDRPCEISEIDDNPKISENPRRSPTHEKNTMGAQEAHIYVKTVAGSEEPVHDRYRPTIEMERRRGLWWLVPRLSLE

SEQ ID NO: 2944 - protein, 364 aa, unidentified
MAQQWSLQRLAGRHPQDSYEDSTQSSIFTYTNSNSTRGPFEGPNYHIAPRWVYHLTSVWMIFVVIASVFTNGLVLAATMKFKKLRHPLNWILVNLAVADLAETVIASTISVVNQVYGYFVLGHPMCVLEGYTVSLCGITGLWSLAIISWERWMVVCKPFGNVRFDAKLAIVGIAFSWIWAAVWTAPPIFGWSRYWPHGLKTSCGPDVFSGSSYPGVQSYMIVLMVTCCITPLSIIVLCYLQVWLAIRAVAKQQKESESTQKAEKEVTRMVVVMVLAFCFCWGPYAFFACFAAANPGYPFHPLMAALPAFFAKSATIYNPVIYVFMNRQFRNCILQLFGKKVDDGSELSSASKTEVSSVSSVSPA

SEQ ID NO: 2945 - protein, 364 aa, unidentified; identical to SEQ ID NO: 2944

SEQ ID NO: 2946 - protein, 348 aa, unidentified
MRKMSEEEFYLFKNISSVGPWDGPQYHIAPVWAFYLQAAFMGTVFLIGFPLNAMVLVATLRYKKLRQPLNYILVNVSFGGFLLCIFSVFPVFVASCNGYFVFGRHVCALEGFLGTVAGLVTGWSLAFLAFERYIVICKPFGNFRFSSKHALTVVLATWTIGIGVSIPPFFGWSRFIPEGLQCSCGPDWYTVGTKYRSESYTWFLFIFCFIVPLSLICFSYTQLLRALKAVAAQQQESATTQKAEREVSRMVVVMVGSFCVCYVPYAAFAMYMVNNRNHGLDLRLVTIPSFFSKSACIYNPIIYCFMNKQFQACIMKMVCGKAMTDESDTCSSQKTEVSTVSSTQVGPN

SEQ ID NO: 2947 - protein, 402 aa, unidentified
MYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFGIVSIATLTVLAYERYIRVVHARVINFSWAWRAITYIWLYSLAWAGAPLLGWNRYILDVHGLGCTVDWKSKDANDSSFVLFLFLGCLVVPLGVIAHCYGHILYSIRMLRCVEDLQTIQVIKILKYEKKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTNGSKVDVIQVRPL

SEQ ID NO: 2948 - protein, 478 aa, unidentified
MNPPSGPRVPPSPTQEPSCMATPAPPSWWDSSQSSISSLGRLPSISPTAPGTWAAAWVPLPTVDVPDHAHYTLGTVILLVGLTGMLGNLTVIYTFCRSRSLRTPANMFIINLAVSDFLMSFTQAPVFFTSSLYKQWLFGETGCEFYAFCGALFGISSMITLTAIALDRYLVITRPLATFGVASKRRAAFVLLGVWLYALAWSLPPFFGWSAYVPEGLLTSCSWDYMSFTPAVRAYTMLLCCFVFFLPLLIIIYCYIFIFRAIRETGRALQTFGACKGNGESLWQRQRLQSECKMAKIMLLVILLFVLSWAPYSAVALVAFAGYAHVLTPYMSSVPAVIAKASAIHNPIIYAITHPKYRVAIAQHLPCLGVLLGVSRRHSRPYPSYRSTHRSTLTSHTSNLSWISIRRRQESLGSESEVGWTHMEAAAVWGAAQQANGRSLYGQGLEDLEAKAPPRPQGHEAETPGKTKGLIPSQDPRM

SEQ ID NO: 2949 - protein, 354 aa, unidentified
MALNHTALPQDERLPHYLRDGDPFASKLSWEADLVAGFYLTIIGILSTFGNGYVLYMSSRRKKKLRPAEIMTINLAVCDLGISVVGKPFTIISCFCHRWVFGWIGCRWYGWAGFFFGCGSLITMTAVSLDRYLKICYLSYGVWLKRKHAYICLAAIWAYASFWTTMPLVGLGDYVPEPFGTSCTLDWWLAQASVGGQVFILNILFFCLLLPTAVIVFSYVKIIAKVKSSSKEVAHFDSRIHSSHVLEMKLTKVAMLICAGFLIAWIPYAVVSVWSAFGRPDSIPIQLSVVPTLLAKSAAMYNPIIYQVIDYKFACCQTGGLKATKKKSLEGFRLHTVTTVRKSSAVLEIHEEWE

SEQ ID NO: 2950 - protein, 372 aa, unidentified
MEPAPSAGAELQPPLFANASDAYPSACPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVPILIITVCYGLMLLRLRSVRLLSGSKEKDRSLRRITRMVLVVVGAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGAAA

SEQ ID NO: 2951 - protein, 380 aa, unidentified
MDSPIQIFRGEPGPTCAPSACLPPNSSAWFPGWAEPDSNGSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 2952 - protein, 370 aa, unidentified
MEPLFPAPFWEVIYGSHLQGNLSLLSPNHSLLPPHLLLNASHGAFLPLGLKVTIVGLYLAVCVGGLLGNCLVMYVILRHTKMKTATNIYIFNLALADTLVLLTLPFQGTDILLGFWPFGNALCKTVIAIDYYNMFTSTFTLTAMSVDRYVAICHPIRALDVRTSSKAQAVNVAIWALASVVGVPVAIMGSAQVEDEEIECLVEIPTPQDYWGPVFAICIFLFSFIVPVLVISVCYSLMIRRLRGVRLLSGSREKDRNLRRITRLVLVVVAVFVGCWTPVQVFVLAQGLGVQPSSETAVAILRFCTALGYVNSCLNPILYAFLDENFKACFRKFCCASALRRDVQVSDRVRSIAKDVALACKTSETVPRPA

SEQ ID NO: 2953 - protein, 400 aa, unidentified
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 2954 - protein, 303 aa, unidentified
MSFSSLPTEIQSLLFLTFLTIYLVTLMGNCLIILVTLADPMLHSPMYFFLRNLSFLEIGFNLVIVPKMLGTLLAQDTTISFLGCATQMYFFFFFGVAECFLLATMAYDRYVAICSPLHYPVIMNQRTRAKLAAASWFPGFPVATVQTTWLFSFPFCGTNKVNHFFCDSPPVLRLVCADTALFEIYAIVGTILVVMIPCLLILCSYTHIAAAILKIPSAKGKNKAFSTCSSHLLVVSLFYISLSLTYFRPKSNNSPEGKKLLSLSYTVMTPMLNPIIYSLRNNEVKNALSRTVSKALALRNCIP

SEQ ID NO: 2955 - protein, 314 aa, unidentified
MKRQNQSCVVEFILLGFSNFPELQVQLFGVFLVIYVVTLMGNAIITVIISLNQSLHVPMYLFLLNLSVVEVSFSAVITPEMLVVLSTEKTMISFVGCFAQMYFILLFGGTECFLLGAMAYDRFAAICHPLNYPVIMNRGVFMKLVIFSWISGIMVATVQTTWVFSFPFCGPNEINHLFCETPPVLELVCADTFLFEIYAFTGTILIVMVPFLLILLSYIRVLFAILKMPSTTGRQKAFSTCASHLTSVTLFYGTANMTYLQPKSGYSPETKKLISLAYTLLTPLLNPLIYSLRNSEMKRTLIKLWRRKVILHTF

SEQ ID NO: 2956 - protein, 315 aa, unidentified
MMWENWTIVSEFVLVSFSALSTELQALLFLLFLTIYLVTLMGNVLIILVTIADSALQSPMYFFLRNLSFLEIGFNLVIVPKMLGTLIIQDTTISFLGCATQMYFFFFFGAAECCLLATMAYDRYVAICDPLHYPVIMGHISCAQLAAASWFSGFSVATVQTTWIFSFPFCGPNRVNHFFCDSPPVIALVCADTSVFELEALTATVLFILFPFLLILGSYVRILSTIFRMPSAEGKHQAFSTCSAHLLVVSLFYSTAILTYFRPQSSASSESKKLLSLSSTVVTPMLNPIIYSSRNKEVKAALKRLIHRTLGSQKL

SEQ ID NO: 2957 - protein, 317 aa, unidentified
MAIGNWTEISEFILMSFSSLPTEIQSLLFLTFLTIYLVTLKGNSLIILVTLADPMLHSPMYFFLRNLSFLEIGFNLVIVPKMLGTLLAQDTTISFLGCATQMYFFFFFGVAECFLLATMAYDRYVAICSPLHYPVIMNQRTRAKLAAASWFPGFPVATVQTTWLFSFPFCGTNKVNHFFCDSPPVLKLVCADTALFEIYAIVGTILVVMIPCLLILCSYTRIAAAILKIPSAKGKHKAFSTCSSHLLVVSLFYISSSLTYFWPKSNNSPESKKLLSLSYTVVTPMLNPIIYSLRNSEVKNALSRTFHKVLALRNCIP

SEQ ID NO: 2958 - protein, 316 aa, unidentified
MICENHTRVTEFILLGFTNNPEMQVSLFIFFLAIYTVTLLGNFLIVTVTSVDLALQTPMYFFLQNLSLLEVCFTLVMVPKMLVDLVSPRKIISFVGCGTQMYFFFFFGSSECFLLSMMAYDRFVAICNPLHYSVIMNRSLCLWMAIGSWMSGVPVSMLQTAWMMALPFCGPNAVDHFFCDGPPVLKLVTVDTTMYEMQALASTLLFIMFPFCLILVSYTRIIITILRMSSATGRQKAFSTCSSHLIVVSLFYGTASLTYLRPKSNQSPESKKLVSLSYTVITPMLNPIIYGLRNNEVKGAVKRTITQKVLQKLDVF

SEQ ID NO: 2959 - protein, 317 aa, unidentified
MLRNGSIVTEFILVGFQQSSTSTRALLFALFLALYSLTMAMNGLIIFITSWTDPKLNSPMYFFLGHLSLLDVCFITTTIPQMLIHLVVRDHIVSFVCCMTQMYFVFCVGVAECILLAFMAYDRYVAICYPLNYVPIISQKVCVRLVGTAWFFGLINGIFLEYISFREPFRRDNHIESFFCEAPIVIGLSCGDPQFSLWAIFADAIVVILSPMVLTVTSYVHILATILSKASSSGRGKTFSTCASHLTVVIFLYTSAMFSYMNPHSTHGPDKDKPFSLLYTIITPMCNPIIYSFRNKEIKEAMVRALGRTRLAQPQSV

SEQ ID NO: 2960 - protein, 301 aa, unidentified
MEFVLLGFSDIPNLHWMLFSIFLLMYLMILMCNGIIILLIKIHPALQTPMYFFLSNFSLLEICYVTIIIPRMLMDIWTQKGNISLFACATQMCFFLMLGGTECLLLTVMAYDRYVAICKPLQYPLVMNHKVCIQLIIASWTITIPVVIGETCQIFLLPFCGTNTINHFFCDIPPILKLACGNIFVNEITVHVVAVVFITVPFLLIVVSYGKIISNILKLSSARGKAKAFSTCSSHLIVVILFFGAGTITYLQPKPHQFQRMGKLISLFYTILIPTLNPIIYTLRNKDIMVALRKLLAKLLT

SEQ ID NO: 2961 - protein, 312 aa, unidentified
MSANTSMVTEFLLLGFSHLADLQGLLFSVFLTIYLLTVAGNFLIVVLVSTDAALQSPMYFFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIMVSLFYGTALFIYIRPKASYDPATDPLVSLFYAVVTPILNPIIYSLRNTEVKAALKRTIQKTVPMEI

SEQ ID NO: 2962 - protein, 310 aa, unidentified
MGKTKNTSLDAVVTDFILLGLSHPPNLRSLLFLVFFIIYILTQLGNLLILLTMWADPKLCARPMYILLGVLSFLDMWLSSVTVPRLILDFTPSIKAIPFGGCVAQLYFFHFLGSTQCFLYTLMAYDRYLAICQPLHYPVLMNGRLCTVLVAGAWVAGSMHGSIQATLTFRLPYCGPNQVDYFICDIRAVLRLACADTTVNELVTFVDVRVVAASCFMLILLSYANIVHAILKIRTADGRRRAFSTCGSHLIVVTVYYVPCIFIYLRAGSKDPLDGAAAVFYTVVTPLLNPLIYTLRNQEVKSALKRITAG

SEQ ID NO: 2963 - protein, 313 aa, unidentified
MERINSTLLTAFILTGIPYPLRLRTLFFVFFFLIYILTQLGNLLILITVWADPRLHARPMYIFLGVLSVIDMSISSIIVPRLMMNFTLGVKPIPFGGCVAQLYFYHFLGSTQCFLYTLMAYDRYLAICQPLRYPVLMTAKLSALLVAGAWMAGSIHGALQAILTFRLPYCGPNQVDYFFCDIPAVLRLACADTTVNELVTFVDIGVVVASCFSLILLSYIQIIQAILRIHTADGRRRAFSTCGAHVTVVTVYYVPCAFIYLRPETNSPLDGAAALVPTAITPFLNPLIYTLRNQEVKLALKRMLRSPRTPSEV

SEQ ID NO: 2964 - protein, 311 aa, unidentified
MSNASLVTAFILTGLPHAPGLDALLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATGTWLSGSLHSAVQTILTFHLPYCGPNQIQHYFCDAPPILKLACADTSANVMVIFVDIGIVASGCFVLIVLSYVSIVCSILRIRTSDGRRRAFQTCASHCIVVLCFFVPCVVIYLRPGSMDAMDGVVAIFYTVLTPLLNPVVYTLRNKEVKKAVLKLRDKVAHPQRK

SEQ ID NO: 2965 - protein, 311 aa, unidentified
MSNATLLTAFILTGLPHAPGLDAPLFGIFLVVYVLTVLGNLLILLVIRVDSHLHTPMYYFLTNLSFIDMWFSTVTVPKMLMTLVSPSGRTISFHSCVAQLYFFHFLGSTECFLYTVMSYDRYLAISYPLRYTNMMTGRSCALLATGTWLSGSLHSAVQTILTFHLPYCGPNQIQHYFCDAPPILKLACADTSANEMVIFVNIGLVASGCFVLIVLSYVSIVCSILRIRTSEGRHRAFQTCASHCIVVLCFFGPGLFIYLRPGSRDALHGVVAVFYTTLTPLFNPVVYTLRNKEVKKALLKLKNGSVFAQGE

SEQ ID NO: 2966 - protein, 311 aa, unidentified
MSNASLLTAFILMGLPHAPALDAPLFGVFLVVYVLTVLGNLLILLVIRVDSHLHTTMYYFLTNLSFIDMWFSTVTVPKLLMTLVFPSGRAISFHSCMAQLYFFHFLGGTECFLYRVMSCDRYLAISYPLRYTSMMTGRSCTLLATSTWLSGSLHSAVQAILTFHLPYCGPNWIQHYLCDAPPILKLACADTSAIETVIFVTVGIVASGCFVLIVLSYVSIVCSILRIRTSEGKHRAFQTCASHCIVVLCFFGPGLFIYLRPGSRKAVDGVVAVFYTVLTPLLNPVVYTLRNKEVKKALLKLKDKVAHSQSK

SEQ ID NO: 2967 - protein, 311 aa, unidentified
MSKTSLVTAFILTGLPHAPGLDAPLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATSTWLSGSLHSAVQTILTFHLPYCGPNQIQHYLCDAPPILKLACADTSANEMVIFVDIGLVASGCFLLIVLSYVSIVCSILRIHTSEGRHRAFQTCASHCIVVLCFFVPCVFIYLRPGSRDVVDGVVAIFYTVLTPLLNPVVYTLRNKEVKKAVLKLRDKVAHSQGE

SEQ ID NO: 2968 - protein, 318 aa, unidentified
MQRANHSTVTQFILVGFSVFPHLQLMLFLLFLLMYLFTLLGNLLIMATVWSERSLHTPMYLFLCALSVSEILYTVAIIPRMLADLLSTQRSIAFLACASQMFFSFSFGFTHSFLLTVMGYDRYVAICHPLRYNVLMSPRGCACLVGCSWAGGLVMGMVVTSAIFHLAFCGHKEIHHFACHVPPLLKLACGDDVLVVAKGVGLVCITALLGCFLLILLSYAFIVAAILKIPSAEGRNKAFSTCASHLTVVVVHYGFASVIYLKPKSPQSLEGDTLMGITYTVLTPFLSPIIFSLRNKELKVAMKKTFFSKLYPEKNVMM

SEQ ID NO: 2969 - protein, 315 aa, unidentified
MLGLNHTSMSEFILVGFSAFPHLQLMLFLLFLLMYLFTLLGNLLIMATVWSERSLHTPMYLFLCVLSVSEILYTVAIIPRMLADLLSTQRSIAFLACASQMFFSFSFGFTHSFLLTVMGYDRYVAICHPLRYNVLMSPRGCACLVGCSWAGGSVMGMVVTSAIFQLTFCGSHEIQHFLCHVPPLLKLACGNNVPAVALGVGLVCIMALLGCFLLILLSYAFIVADILKIPSAEGRNKAFSTCASHLIVVIVHYGFASVIYLKPKGPHSQEGDTLMATTYAVLTPFLSPIIFSLRNKELKVAMKRTFLSTLYSSGT

SEQ ID NO: 2970 - protein, 316 aa, unidentified
MPGQNYRTISEFILSGFSAFPQQLLPVLFLLYLLMFLFTLLGNLLIMATVWIERRLHTPMYLFLCALSISEILFTVAITPRMLADLLFTHRSITFVACAIQMFFSFMFGFTHSFLLMVMGYDHYVTICHPLHYNMLMSPRGCAHLVAWTWAGGSVMGMMVTMMVFHLTFCGSNVIHHFLCHVLSLLKLACGSKTSSVIMGVMLVCVTALIGCLFLIILSFVFIVAAILRIPSAEGRHKTFSTCVSHLTVVVMHYSFASLIYLKPKGLHSMYSDALMATTYTVFTPFLSPIIFSLRNKELKNAINKNFCRRFCPLSS

SEQ ID NO: 2971 - protein, 316 aa, unidentified
MPSQNYSIISEFNLFGFSAFPQHLLPILFLLYLLMFLFTLLGNLLIMATIWIEHRLHTPMYLFLCTLSVSEILFTVAITPRMLADLLSTHHSITFVACANQMFFSFMFGFTHSFLLLVMGYDRYVAICHPLRYNVLMSPRDCAHLVACTWAGGSVMGMMVTTIVFHLTFCGSNVIHHFFCHVLSLLKLACENKTSSVIMGVMLVCVTALIGCLFLIILSYVFIVAAILRIPSAEGRHKTFSTCVSHLTVVVTHYSFASFIYLKPKGLHSMYSDALMATTYTVFTPFLSPIIFSLRNKELKNAINKNFYRKFCPPSS

SEQ ID NO: 2972 - protein, 315 aa, unidentified
MQGLNHTSVSEFILVGFSAFPHLQLMLFLLFLLMYLFTLLGNLLIMATVWSERSLHMPMYLFLCALSITEILYTVAIIPRMLADLLSTQRSIAFLACASQMFFSFSFGFTHSFLLTVMGYDRYVAICHPLRYNVLMSLRGCTCRVGCSWAGGLVMGMVVTSAIFHLAFCGHKEIHHFFCHVPPLLKLACGDDVLVVAKGVGLVCITALLGCFLLILLSYAFIVAAILKIPSAEGRNKAFSTCASHLTVVVVHYGFASVIYLKPKGPQSPEGDTLMGITYTVLTPFLSPIIFSLRNKELKVAMKKTCFTKLFPQNC

SEQ ID NO: 2973 - protein, 320 aa, unidentified
MLLCFRFGNQSMKRENFTLITDFVFQGFSSFHEQQITLFGVFLALYILTLAGNIIIVTIIRMDLHLHTPMYFFLSMLSTSETVYTLVILPRMLSSLVGMSQPISLAGCATQMFFFVTFGITNCFLLTAMGYDRYVAICNPLRYMVIMNKRLRIQLVLGACSIGLIVAITQVTSVFRLPFCARKVPHFFCDIRPVMKLSCIDTTVNEILTLIISVLVLVVPMGLVFISYVLIISTILKIASVEGRKKAFATCASHLTVVIVHYSCASIAYLKPKSENTREHDQLISVTYTVITPLLNPVVYTLRNKEVKDALCRAVGGKFS

SEQ ID NO: 2974 - protein, 329 aa, unidentified
MPKLNSTFVTEFLFEGFSSFRRQHKLVFFVVFLTLYLLTLSGNVIIMTIIRLDHHLHTPMYFFLCMLSISETCYTVAIIPHMLSGLLNPHQPIATQSCATQLFFYLTFGINNCFLLTVMGYDRYVAICNPLRYSVIMGKRACIQLASGSLGIGLGMAIVQVTSVFGLPFCDAFVISHFFCDVRHLLKLACTDTTVNEIINFVVSVCVLVLPMGLVFISYVLIISTILKIASAEGQKKAFATCASHLTVVIIHYGCASIIYLKPKSQSSLGQDRLISVTYTHHSPTEPCCVQPEEQGGQRCSAQSRGAKNSVSLMKRGCEGFSFAFINMY

SEQ ID NO: 2975 - protein, 309 aa, unidentified
MKRKNFTEVSEFIFLGFSSFGKHQITLFVVFLTVYILTLVANIIIVTIICIDHHLHTPMYFFLSMLASSETVYTLVIVPRMLLSLIFHNQPISLAGCATQMFFFVILATNNCFLLTAMGYDRYVAICRPLRYTVIMSKGLCAQLVCGSFGIGLTMAVLHVTAMFNLPFCGTVVDHFFCDIYPVMKLSCIDTTINEIINYGVSSFVIFVPIGLIFISYVLVISSILQIASAEGRKKTFATCVSHLTVVIVHCGCASIAYLKPKSESSIEKDLVLSVTYTIITPLLNPVVYSLRNKEVKDALCRVVGRNIS

SEQ ID NO: 2976 - protein, 313 aa, unidentified
MEQVNKTVVREFVVLGFSSLARLQQLLFVIFLLLYLFTLGTNAIIISTIVLDRALHTPMYFFLAILSCSEICYTFVIVPKMLVDLLSQKKTISFLGCAIQMFSFLFFGSSHSFLLAAMGYDRYMAICNPLRYSVLMGHGVCMGLMAAACACGFTVSLVTTSLVFHLPFHSSNQLHHFFCDISPVLKLASQHSGFSQLVIFMLGVFALVIPLLLILVSYIRIISAILKIPSSVGRYKTFSTCASHLIVVTVHYSCASFIYLRPKTNYTSSQDTLISVSYTILTPLFNPMIYSLRNKEFKSALRRTIGQTFYPLS

SEQ ID NO: 2977 - protein, 312 aa, unidentified
MERVNETVVREVIFLGFSSLARLQQLLFVIFLLLYLFTLGTNAIIISTIVLDRALHIPMYFFLAILSCSEICYTFIIVPKMLVDLLSQKKTISFLGCAIQMFSFLFLGCSHSFLLAVMGYDRYIAICNPLRYSVLMGHGVCMGLVAAACACGFTVAQIITSLVFHLPFYSSNQLHHFFCDIAPVLKLASHHNHFSQIVIFMLCTLVLAIPLLLILVSYVHILSAILQFPSTLGRCKAFSTCVSHLIIVTVHYGCASFIYLRPQSNYSSSQDALISVSYTIITPLFNPMIYSLRNKEFKSALCKIVRRTISLL

SEQ ID NO: 2978 - protein, 313 aa, unidentified
MAGENHTTLPEFLLLGFSDLKALQGPLFWVVLLVYLVTLLGNSLIILLTQVSPALHSPMYFFLRQLSVVELFYTTDIVPRTLANLGSPHPQAISFQGCAAQMYVFIVLGISECCLLTAMAYDRYVAICQPLRYSTLLSPRACMAMVGTSWLTGIITATTHASLIFSLPFRSHPIIPHFLCDILPVLRLASAGKHRSEISVMTATIVFIMIPFSLIVTSYIRILGAILAMASTQSRRKVFSTCSSHLLVVSLFFGTASITYIRPQAGSSVTTDRVLSLFYTVITPMLNPIIYTLRNKDVRRALRHLVKRQRPSP

SEQ ID NO: 2979 - protein, 319 aa, unidentified
MPVGKLVFNQSEPTEFVFRAFTTATEFQVLLFLLFLLLYLMILCGNTAIIWVVCTHSTLRTPMYFFLSNLSFLELCYTTVVVPLMLSNILGAQKPISLAGCGAQMFFFVTLGSTDCFLLAIMAYDRYVAICHPLHYTLIMTRELCTQMLGGALGLALFPSLQLTALIFTLPFCGHHQEINHFLCDVPPVLRLACADIRVHQAVLYVVSILVLTIPFLLICVSYVFITCAILSIRSAEGRRRAFSTCSFHLTVVLLQYGCCSLVYLRPRSSTSEDEDSQIALVYTFVTPLLNPLLYSLRNKDVKGALRSAIIRKAASDAN

SEQ ID NO: 2980 - protein, 335 aa, unidentified
MPQILIFTYLNMFYFFPPLQILAENLTMVTEFLLLGFSSLGEIQLALFVVFLFLYLVILSGNVTIISVIHLDKSLHTPMYFFLGILSTSETFYTFVILPKMLINLLSVARTISFNCCALQMFFFLGFAITNCLLLGVMGYDRYAAICHPLHYPTLMSWQVCGKLAAACAIGGFLASLTVVNLVFSLPFCSANKVNHYFCDISAVILLACTNTDVNEFVIFICGVLVLVVPFLFICVSYLCILRTILKIPSAEGRRKAFSTCASHLSVVIVHYGCASFIYLRPTANYVSNKDRLVTVTYTIVTPLLNPMVYSLRNKDVQLAIRKVLGKKGSLKLYN

SEQ ID NO: 2981 - protein, 331 aa, unidentified
MTSRSVCEKMTMTTENPNQTVVSHFFLEGLRYTAKHSSLFFLLFLLIYSITVAGNLLILLTVGSDSHLSLPMYHFLGHLSFLDACLSTVTVPKVMAGLLTLDGKVISFEGCAVQLYCFHFLASTECFLYTVMAYDRYLAICQPLHYPVAMNRRMCAEMAGITWAIGATHAAIHTSLTFRLLYCGPCHIAYFFCDIPPVLKLACTDTTINELVMLASIGIVAAGCLILIVISYIFIVAAVLRIRTAQGRQRAFSPCTAQLTGVLLYYVPPVCIYLQPRSSEAGAGAPAVFYTIVTPMLNPFIYTLRNKEVKHALQRLLCSSFRESTAGSPPP

SEQ ID NO: 2982 - protein, 314 aa, unidentified
MRGFNKTTVVTQFILVGFSSLGELQLLLFVIFLLLYLTILVANVTIMAVIRFSWTLHTPMYGFLFILSFSESCYTFVIIPQLLVHLLSDTKTISFMACATQLFFFLGFACTNCLLIAVMGYDRYVAICHPLRYTLIINKRLGLELISLSGATGFFIALVATNLICDMRFCGPNRVNHYFCDMAPVIKLACTDTHVKELALFSLSILVIMVPFLLILISYGFIVNTILKIPSAEGKKAFVTCASHLTVVFVHYGCASIIYLRPKSKSASDKDQLVAVTYTVVTPLLNPLVYSLRNKEVKTALKRVLGMPVATKMS

SEQ ID NO: 2983 - protein, 309 aa, unidentified
MEGINKTAKMQFFFRPFSPDPEVQMLIFVVFLMMYLTSLGGNATIAVIVQINHSLHTPMYFFLANLAVLEIFYTSSITPLALANLLSMGKTPVSITGCGTQMFFFVFLGGADCVLLVVMAYDQFIAICHPLRYRLIMSWSLCVELLVGSLVLGFLLSLPLTILIFHLPFCHNDEIYHFYCDMPAVMRLACADTRVHKTALYIISFIVLSIPLSLISISYVFIVVAILRIRSAEGRQQAYSTCSSHILVVLLQYGCTSFIYLSPSSSYSPEMGRVVSVAYTFITPILNPLIYSLRNKELKDALRKALRKF

SEQ ID NO: 2984 - protein, 305 aa, unidentified
MEFVFLAYPSCPELHILSFLGVSLVYGLIITGNILIVVSIHTETCLCTSMYYFLGSLSGIEICYTAVVVPHILANTLQSEKTITLLGCATQMAFFIALGSADCFLLAAMAYDRYVAICHPLQYPLLMTLTLCVHLVVASVISGLFLSLQLVAFIFSLPFCQAQGIEHFFCDVPPVMHVVCAQSHIHEQSVLVAAILAIAVPFFLITTSYTFIVAALLKIHSAAGRHRAFSTCSSHLTVVLLQYGCCAFMYLCPSSSYNPKQDRFISLVYTLGTPLLNPLIYALRNSEMKGAVGRVLTRNCLSQNS

SEQ ID NO: 2985 - protein, 313 aa, unidentified
MGQTNVTSWRDFVFLGFSSSGELQLLLFALFLSLYLVTLTSNVFIIIAIRLDSHLHTPMYLFLSFLSFSETCYTLGIIPRMLSGLAGGDQAISYVGCAAQMFFSASWACTNCFLLAAMGFDRYVAICAPLHYASHMNPTLCAQLVITSFLTGYLFGLGMTLVIFHLSFCSSHEIQHFFCDTPPVLSLACGDTGPSELRIFILSLLVLLVSFFFITISYAYILAAILRIPSAEGQKKAFSTCASHLTVVIIHYGCASFVYLRPKASYSLERDQLIAMTYTVVTPLLNPIVYSLRNRAIQTALRNAFRGRLLGKG

SEQ ID NO: 2986 - protein, 315 aa, unidentified
MEIVSTGNETITEFVLLGFYDIPELHFLFFIVFTAVYVFIIIGNMLIIVAVVSSQRLHKPMYIFLANLSFLDILYTSAVMPKMLEGFLQEATISVAGCLLQFFIFGSLATAECLLLAVMAYDRYLAICYPLHYPLLMGPRRYMGLVVTTWLSGFVVDGLVVALVAQLRFCGPNHIDQFYCDFMLFVGLACSDPRVAQVTTLILSVFCLTIPFGLILTSYARIVVAVLRVPAGASRRRAFSTCSSHLAVVTTFYGTLMIFYVAPSAVHSQLLSKVFSLLYTVVTPLFNPVIYTMRNKEVHQALRKILCIKQTETLD

SEQ ID NO: 2987 - protein, 345 aa, unidentified
MHFLSQNDLNINLIPHLCLHRHSVIAGAFTIHRHMKIFNSPSNSSTFTGFILLGFPCPREGQILLFVLFTVVYLLTLMGNGSIICAVHWDQRLHAPMYILLANFSFLEICYVTSTVPSMLANFLSDTKIISFSGCFLQFYFFFSLGSTECFFLAVMAFDRYLAICRPLRYPTIMTRRLCTNLVVNCWVLGFIWFLIPIVNISQMSFCGSRIIDHFLCDPAPLLTLTCKKGPVIELVFSVLSPLPVFMLFLFIVGSYALVVRAVLRVPSAAGRRKAFSTCGSHLAVVSLFYGSVLVMYGSPPSKNEAGKQKTVTLFYSVVTPLLNPVIYSLRNKDMRKALKKFWGT

SEQ ID NO: 2988 - protein, 326 aa, unidentified
MCPLTLQVTGLMNVSEPNSSFAFVNEFILQGFSCEWTIQIFLFSLFTTTYALTITGNGAIAFVLWCDRRLHTPMYMFLGNFSFLEIWYVSSTVPKMLVNFLSEKKNISFAGCFLQFYFFFSLGTSECLLLTVMAFDQYLAICRPLLYPNIMTGHLYAKLVILCWVCGFLWFLIPIVLISQMPFCGPNIIDHVVCDPGPRFALDCVSAPRIQLFCYTLSSLVIFGNFLFIIGSYTLVLKAMLGMPSSTGRHKAFSTCGSHLAVVSLCYSSLMVMYVSPGLGHSTGMQKIETLFYAMVTPLFNPLIYSLQNKEIKAALRKVLGSSNII

SEQ ID NO: 2989 - protein, 326 aa, unidentified
MCPLTLQVTGLMNVSEPNSSFAFVNEFILQGFTCEWTIQIFLFSLFTTTYALTITGNGAIAFVLWCDWRLHTPMYMFLGNFSFLEIWYVSSTVPKMLVNFLSEKKNISFAGCFLQFYFFFSLGTSECLLLTVMAFDQYLAICRPLLYPNIMTGHLCAKLVILCWVCGFLWFLIPIVLISQMPFCGPNIIDHVVCDPGPRFALDCVSAPRIQLFCYTLSSLVIFGNFLFIIGSYTLVLKAVLGMPSSTGRHKAFSTCGSHLAVVSLCYSSLMVMYVSPGLGHSTGMQKIETLFYAMVTPLFNPLIYSLQNKEIKAALRKVLGSSNII

SEQ ID NO: 2990 - protein, 324 aa, unidentified
MSFFFVDLRPMNRSATHIVTEFILLGFPGCWKIQIFLFSLFLVIYVLTLLGNGAIIYAVRCNPLLHTPMYFLLGNFAFLEIWYVSSTIPNMLVNILSKTKAISFSGCFLQFYFFFSLGTTECLFLAVMAYDRYLAICHPLQYPAIMTVRFCGKLVSFCWLIGFLGYPIPIFYISQLPFCGPNIIDHFLCDMDPLMALSCAPAPITECIFYTQSSLVLFFTSMYILRSYILLLTAVFQVPSAAGRRKAFSTCGSHLVVVSLFYGTVMVMYVSPTYGIPTLLQKILTLVYSVTTPLFNPLIYTLRNKDMKLALRNVLFGMRIRQNS

SEQ ID NO: 2991 - protein, 330 aa, unidentified
MFFIIHSLVTSVFLTALGPQNRTMHFVTEFVLLGFHGQREMQSCFFSFILVLYLLTLLGNGAIVCAVKLDRRLHTPMYILLGNFAFLEIWYISSTVPNMLVNILSEIKTISFSGCFLQFYFFFSLGTTECFFLSVMAYDRYLAICRPLHYPSIMTGKFCIILVCVCWVGGFLCYPVPIVLISQLPFCGPNIIDHLVCDPGPLFALACISAPSTELICYTFNSMIIFGPFLSILGSYTLVIRAVLCIPSGAGRTKAFSTCGSHLMVVSLFYGTLMVMYVSPTSGNPAGMQKIITLVYTAMTPFLNPLIYSLRNKDMKDALKRVLGLTVSQN

SEQ ID NO: 2992 - protein, 322 aa, unidentified
MEPQNTSTVTNFQLLGFQNLLEWQALLFVIFLLIYCLTIIGNVVIITVVSQGLRLHSPMYMFLQHLSFLEVWYTSTTVPLLLANLLSWGQAISFSACMAQLYFFVFLGATECFLLAFMAYDRYLAICSPLRYPFLMHRGLCARLVVVSWCTGVSTGFLPSLMISRLDFCGRNQINHFFCDLPPLMQLSCSRVYITEVTIFILSIAVLCICFFLTLGPYVFIVSSILRIPSTSGRRKTFSTCGSHLAVVTLYYGTMISMYVCPSPHLLPEINKIISVFYTVVTPLLNPVIYSLRNKDFKEAVRKVMRRKCGILWSTSKRKFLY

SEQ ID NO: 2993 - protein, 316 aa, unidentified
MENVTTMNEFLLLGLTGVQELQPFFFGIFLIIYLINLIGNGSILVMVVLEPQLHSPMYFFLGNLSCLDISYSSVTLPKLLVNLVCSRRAISFLGCITQLHFFHFLGSTEAILLAIMAFDRFVAICNPLRYTVIMNPQVCILLAAAAWLISFFYALMHSVMTAHLSFCGSQKLNHFFYDVKPLLELACSDTLLNQWLLSIVTGSISMGAFFLTLLSCFYVIGFLLFKNRSCRILHKALSTCASHFMVVCLFYGPVGFTYIRPASATSMIQDRIMAIMYSAVTPVLNPLIYTLRNKEVMMALKKIFGRKLFKDWQQHH

SEQ ID NO: 2994 - protein, 328 aa, unidentified
MKLWMESHLIVPETRPSPRMMSNQTLVTEFILQGFSEHPEYRVFLFSCFLFLYSGALTGNVLITLAITFNPGLHAPMYFFLLNLATMDIICTSSIMPKALASLVSEESSISYGGCMAQLYFLTWAASSELLLLTVMAYDRYAAICHPLHYSSMMSKVFCSGLATAVWLLCAVNTAIHTGLMLRLDFCGPNVIIHFFCEVPPLLLLSCSSTYVNGVMIVLADAFYGIVNFLMTIASYGFIVSSILKVKTAWGRQKAFSTCSSHLTVVCMYYTAVFYAYISPVSGYSAGKSKLAGLLYTVLSPTLNPLIYTLRNKEVKAALRKLFPFFRN

SEQ ID NO: 2995 - protein, 347 aa, unidentified
MIVQLICTVCFLAVNTFHVRSSFDFLKADDMGEINQTLVSEFLLLGLSGYPKIEIVYFALILVMYLVILIGNGVLIIASIFDSHFHTPMYFFLGNLSFLDICYTSSSVPSTLVSLISKKRNISFSGCAVQMFFGFAMGSTECLLLGMMAFDRYVAICNPLRYPIILSKVAYVLMASVSWLSGGINSAVQTLLAMRLPFCGNNIINHFACEILAVLKLACADISLNIITMVISNMAFLVLPLMVIFFSYMFILYTILQMNSATGRRKAFSTCSAHLTVVIIFYGTIFFMYAKPKSQDLIGEEKLQALDKLISLFYGVVTPMLNPILYSLRNKDVKAAVKYLLNKKPIH

SEQ ID NO: 2996 - protein, 318 aa, unidentified
MDKINQTFVREFILLGLSGYPKLEIIFFALILVMYVVILIGNGVLIIASILDSRLHMPMYFFLGNLSFLDICYTTSSIPSTLVSLISKKRNISFSGCAVQMFFGFAMGSTECFLLGMMAFDRYVAICNPLRYPIIMNKVVYVLLTSVSWLSGGINSTVQTSLAMRWPFCGNNIINHFLCEILAVLKLACSDISVNIVTLAVSNIAFLVLPLLVIFFSYMFILYTILRTNSATGRHKAFSTCSAHLTVVIIFYGTIFFMYAKPKSQDLLGKDNLQATEGLVSMFYGVVTPMLNPIIYSLRNKDVKAAIKYLLSRKAINQ

SEQ ID NO: 2997 - protein, 320 aa, unidentified
MERTNDSTSTEFFLVGLSAHPKLQTVFFVLILWMYLMILLGNGVLISVIIFDSHLHTPMYFFLCNLSFLDVCYTSSSVPLILASFLAVKKKVSFSGCMVQMFISFAMGATECMILGTMALDRYVAICYPLRYPVIMSKGAYVAMAAGSWVTGLVDSVVQTAFAMQLPFCANNVIKHFVCEILAILKLACADISINVISMTGSNLIVLVIPLLVISISYIFIVATILRIPSTEGKHKAFSTCSAHLTVVIIFYGTIFFMYAKPESKASVDSGNEDIIEALISLFYGVMTPMLNPLIYSLRNKDVKAAVKNILCRKNFSDGK

SEQ ID NO: 2998 - protein, 318 aa, unidentified
MEWENQTILVEFFLKGHSVHPRLELLFFVLIFIMYVVILLGNGTLILISILDPHLHTPMYFFLGNLSFLDICYTTTSIPSTLVSFLSERKTISFSGCAVQMFLGLAMGTTECVLLGMMAFDRYVAICNPLRYPIIMSKNAYVPMAVGSWFAGIVNSAVQTTFVVQLPFCRKNVINHFSCEILAVMKLACADISGNEFLMLVATILFTLMPLLLIVISYSLIISSILKIHSSEGRSKAFSTCSAHLTVVIIFYGTILFMYMKPKSKETLNSDDLDATDKIISMFYGVMTPMMNPLIYSLRNKDVKEAVKHLPNRRFFSK

SEQ ID NO: 2999 - protein, 346 aa, unidentified
MYRFTDFDVSNISIYLNHVLFYTTQQAGDLEHMETRNYSAMTEFFLVGLSQYPELQLFLFLLCLIMYMIILLGNSLLIIITILDSRLHTPMYFFLGNLSFLDICYTSSSIPPMLIIFMSERKSISFIGCALQMVVSLGLGSTECVLLAVMAYDHYVAICNPLRYSIIMNGVLYVQMAAWSWIIGCLTSLLQTVLTMMLPFCGNNVIDHITCEILALLKLVCSDITINVLIMTVTNIVSLVILLLLIFISYVFILSSILRINCAEGRKKAFSTCSAHSIVVILFYGSALFMYMKPKSKNTNTSDEIIGLSYGVVSPMLNPIIYSLRNKEVKEAVKKVLSRHLHLLKM

SEQ ID NO: 3000 - protein, 319 aa, unidentified
MFPANWTSVKVFFFLGFFHYPKVQVIIFAVCLLMYLITLLGNIFLISITILDSHLHTPMYLFLSNLSFLDIWYSSSALSPMLANFVSGRNTISFSGCATQMYLSLAMGSTECVLLPMMAYDRYVAICNPLRYPVIMNRRTCVQIAAGSWMTGCLTAMVEMMSVLPLSLCGNSIINHFTCEILAILKLVCVDTSLVQLIMLVISVLLLPMPMLLICISYAFILASILRISSVEGRSKAFSTCTAHLMVVVLFYGTALSMHLKPSAVDSQEIDKFMALVYAGQTPMLNPIIYSLRNKEVKVALKKLLIRNHFNTAFISILK

SEQ ID NO: 3001 - protein, 307 aa, unidentified
MNHSVVTEFIILGLTKKPELQGIIFLFFLIVYLVAFLGNMLIIIAKIYNNTLHTPMYVFLLTLAVVDIICTTSIIPKMLGTMLTSENTISYAGCMSQLFLFTWSLGAEMVLFTTMAYDRYVAICFPLHYSTIMNHHMCVALLSMVMAIAVTNSWVHTALIMRLTFCGPNTIDHFFCEIPPLLALSCSPVRINEVMVYVADITLAIGDFILTCISYGFIIVAILRIRTVEGKRKAFSTCSSHLTVVTLYYSPVIYTYIRPASSYTFERDKVVAALYTLVTPTLNPMVYSFQNREMQAGIRKVFAFLKH

SEQ ID NO: 3002 - protein, 308 aa, unidentified
MAMDNVTAVFQFLLIGISNYPQWRDTFFTLVLIIYLSTLLGNGFMIFLIHFDPNLHTPIYFFLSNLSFLDLCYGTASMPQALVHCFSTHPYLSYPRCLAQTSVSLALATAECLLLAAMAYDRVVAISNPLRYSVVMNGPVCVCLVATSWGTSLVLTAMLILSLRLHFCGANVINHFACEILSLIKLTCSDTSLNEFMILITSIFTLLLPFGFVLLSYIRIAMAIIRIRSLQGRLKAFTTCGSHLTVVTIFYGSAISMYMKTQSKSYPDQDKFISVFYGALTPMLNPLIYSLRKKDVKRAIRKVMLKRT

SEQ ID NO: 3003 - protein, 312 aa, unidentified
MEPLNRTEVSEFFLKGFSGYPALEHLLFPLCSAMYLVTLLGNTAIMAVSVLDIHLHTPVYFFLGNLSTLDICYTPTFVPLMLVHLLSSRKTISFAVCAIQMCLSLSTGSTECLLLAITAYDRYLAICQPLRYHVLMSHRLCVLLMGAAWVLCLLKSVTEMVISMRLPFCGHHVVSHFTCKILAVLKLACGNTSVSEDFLLAGSILLLPVPLAFICLSYLLILATILRVPSAARCCKAFSTCLAHLAVVLLFYGTIIFMYLKPKSKEAHISDEVFTVLYAMVTTMLNPTIYSLRNKEVKEAARKVWGRSRASR

SEQ ID NO: 3004 - protein, 309 aa, unidentified
MANLTIVTEFILMGFSTNKNMCILHSILFLLIYLCALMGNVLIIMITTLDHHLHTPVYFFLKNLSFLDLCLISVTAPKSIANSLIHNNSISFLGCVSQVFLLLSSASAELLLLTVMSFDRYTAICHPLHYDVIMDRSTCVQRATVSWLYGGLIAVMHTAGTFSLSYCGSNMVHQFFCDIPQLLAISCSENLIREIALILINVVLDFCCFIVIIITYVHVFSTVKKIPSTEGQSKAYSICLPHLLVVLFLSTGFIAYLKPASESPSILDAVISVFYTMLPPTFNPIIYSLRNKAIKVALGMLIKGKLTKK

SEQ ID NO: 3005 - protein, 312 aa, unidentified
MPNSTTVMEFLLMRFSDVWTLQILHSASFFMLYLVTLMGNILIVTVTTCDSSLHMPMYFFLRNLSILDACYISVTVPTSCVNSLLDSTTISKAGCVAQVFLVVFFVYVELLFLTIMAHDRYVAVCQPLHYPVIVNSRICIQMTLASLLSGLVYAGMHTGSTFQLPFCRSNVIHQFFCDIPSLLKLSCSDTFSNEVMIVVSALGVGGGCFIFIIRSYIHIFSTVLGFPRGADRTKAFSTCIPHILVVSVFLSSCSSVYLRPPAIPAATQDLILSGFYSIMPPLFNPIIYSLRNKQIKVAIKKIMKRIFYSENV

SEQ ID NO: 3006 - protein, 311 aa, unidentified
MDNLTKVTEFLLMEFSGIWELQVLHAGLFLLIYLAVLVGNLLIIAVITLDQHLHTPMYFFLKNLSVLDLCYISVTVPKSIRNSLTRRSSISYLGCVAQVYFFSAFASAELAFLTVMSYDRYVAICHPLQYRAVMTSGGCYQMAVTTWLSCFSYAAVHTGNMFREHVCRSSVIHQFFRDIPHVLALVSCEVFFVEFLTLALSSCLVLGCFILMMISYFQIFSTVLRIPSGQSRAKAFSTCSPQLIVIMLFLTTGLFAALGPIAKALSIQDLVIALTYTVLPPFLNPIIYSLRNKEIKTAMWRLFVKIYFLQK

SEQ ID NO: 3007 - protein, 321 aa, unidentified
MVNLTSMSGFLLMGFSDERKLQILHALVFLVTYLLALTGNLLIITIITVDRRLHSPMYYFLKHLSLLDLCFISVTVPQSIANSLMGNGYISLVQCILQVFFFIALASSEVAILTVMSYDRYAAICQPLHYETIMDPRACRHAVIAVWIAGGLSGLMHAAINFSIPLCGKRVIHQFFCDVPQMLKLACSYEFINEIALAAFTTSAAFICLISIVLSYIRIFSTVLRIPSAEGRTKVFSTCLPHLFVATFFLSAAGFEFLRLPSDSSSTVDLVFSVFYTVIPPTLNPVIYSLRNDSMKAALRKMLSKEELPQRKMCLKAMFKL

SEQ ID NO: 3008 - protein, 309 aa, unidentified
MRENNQSSTLEFILLGVTGQQEQEDFFYILFLFIYPITLIGNLLIVLAICSDVRLHNPMYFLLANLSLVDIFFSSVTIPKMLANHLLGSKSISFGGCLTQMYFMIALGNTDSYILAAMAYDRAVAISRPLHYTTIMSPRSCIWLIAGSWVIGNANALPHTLLTASLSFCGNQEVANFYCDITPLLKLSCSDIHFHVKMMYLGVGIFSVPLLCIIVSYIRVFSTVFQVPSTKGVLKAFSTCGSHLTVVSLYYGTVMGTYFRPLTNYSLKDAVITVMYTAVTPMLNPFIYSLRNRDMKAALRKLFNKRISS

SEQ ID NO: 3009 - protein, 309 aa, unidentified
MKKENQSFNLDFILLGVTSQQEQNNVFFVIFLCIYPITLTGNLLIILAICADIRLHNPMYFLLANLSLVDIIFSSVTIPKVLANHLLGSKFISFGGCLMQMYFMIALAKADSYTLAAMAYDRAVAISCPLHYTTIMSPRSCILLIAGSWVIGNTSALPHTLLTASLSFCGNQEVANFYCDIMPLLKLSCSDVHFNVKMMYLGVGVFSLPLLCIIVSYVQVFSTVFQVPSTKSLFKAFCTCGSHLTVVFLYYGTTMGMYFRPLTSYSPKDAVITVMYVAVTPALNPFIYSLRNWDMKAALQKLFSKRISS

SEQ ID NO: 3010 - protein, 314 aa, unidentified
MEKRNLTVVREFVLLGLPSSAEQQHLLSVLFLCMYLATTLGNMLIIATIGFDSHLHSPMYFFLSNLAFVDICFTSTTVPQMVVNILTGTKTISFAGCLTQLFFFVSFVNMDSLLLCVMAYDRYVAICHPLHYTARMNLCLCVQLVAGLWLVTYLHALLHTVLIAQLSFCASNIIHHFFCDLNPLLQLSCSDVSFNVMIIFAVGGLLALTPLVCILVSYGLIFSTVLKITSTQGKQRAVSTCSCHLSVVVLFYGTAIAVYFSPSSPHMPESDTLSTIMYSMVAPMLNPFIYTLRNRDMKRGLQKMLLKCTVFQQQ

SEQ ID NO: 3011 - protein, 312 aa, unidentified
MDGGNQSEGSEFLLLGMSESPEQQRILFWMFLSMYLVTVVGNVLIILAISSDSRLHTPVYFFLANLSFTDLFFVTNTIPKMLVNLQSHNKAISYAGCLTQLYFLVSLVALDNLILAVMAYDRYVAICCPLHYTTAMSPKLCILLLSLCWVLSVLYGLIHTLLMTRVTFCGSRKIHYIFCEMYVLLRMACSNIQINHTVLIATGCFIFLIPFGFVIISYVLIIRAILRIPSVSKKYKAFSTCASHLGAVSLFYGTLCMVYLKPLHTYSVKDSVATVMYAVVTPMMNPFIYSLRNKDMHGALGRLLDKHFKRLT

SEQ ID NO: 3012 - protein, 312 aa, unidentified
MDGDNQSENSQFLLLGISESPEQQRILFWMFLSMYLVTVLGNVLIILAISSDSHLHTPMYFFLANLSFTDLFFVTNTIPKMLVNFQSQNKAISYAGCLTQLYFLVSLVTLDNLILAVMAYDRYVATCCPLHYVTAMSPGLCVLLLSLCWGLSVLYGLLLTFLLTRVTFCGPREIHYLFCDMYILLWLACSNTHIIHTALIATGCFIFLTPLGFMTTSYVRIVRTILQMPSASKKYKTFSTCASHLGVVSLFYGTLAMVYLQPLHTYSMKDSVATVMYAVLTPMMNPFIYRLRNKDMHGAPGRVLWRPFQRPK

SEQ ID NO: 3013 - protein, 314 aa, unidentified
MMGQNQTSISDFLLLGLPIQPEQQNLCYALFLAMYLTTLLGNLLIIVLIRLDSHLHTPMYLFLSNLSFSDLCFSSVTIPKLLQNMQNQDPSIPYADCLTQMYFFLLFGDLESFLLVAMAYDRYVAICFPLHYTAIMSPMLCLALVALSWVLTTFHAMLHTLLMARLCFCADNVIPHFFCDMSALLKLAFSDTRVNEWVIFIMGGLILVIPFLLILGSYARIVSSILKVPSSKGICKAFSTCGSHLSVVSLFYGTVIGLYLCSSANSSTLKDTVMAMMYTVVTPMLNPFIYSLRNRDMKGALSRVIHQKKTFFSL

SEQ ID NO: 3014 - protein, 323 aa, unidentified
MMGQNQTSISDFLLLGLPIQPEQQNLCYALFLAMYLTTLLGNLLIIVLIRLDSHLHTPVYLFLSNLSFSDLCFSSVTMPKLLQNMQNQDPSIPYADCLTQMYFFLYFSDLESFLLVAMAYDRYVAICFPMHYTAICFLLHYTAIMSPMLCLSVVALSWVLTTFHAMLHTLLMARLCFCADNVIPHFFCDMSALLKLACSDTRVNEWVIFIMGGLILVIPFLLILGSYARIVSSILKVPSSKGICKAFSTCGSHLSVVSLFYGTVIGLYLCPSANSSTLKDTVMAMMYTVVTPMLTPFIYSLRNRDMKGALERVICKRKNPFLL

SEQ ID NO: 3015 - protein, 312 aa, unidentified
MSGTNQSSVSEFLLLGLSRQPQQQHLLFVFFLSMYLATVLGNLLIILSVSIDSCLHTPMYFFLSNLSFVDICFSFTTVPKMLANHILETQTISFCGCLTQMYFVFMFVDMDNFLLAVMAYDHFVAVCHPLHYTAKMTHQLCALLVAGLWVVANLNVLLHTLLMAPLSFCADNAITHFFCDVTPLLKLSCSDTHLNEVIILSEGALVMITPFLCILASYMHITCTVLKVPSTKGRWKAFSTCGSHLAVVLLFYSTIIAVYFNPLSSHSAEKDTMATVLYTVVTPMLNPFIYSLRNRYLKGALKKVVGRVVFSV

SEQ ID NO: 3016 - protein, 313 aa, unidentified
MEGKNLTSISECFLLGFSEQLEEQKPLFGSFLFMYLVTVAGNLLIILVIITDTQLHTPMYFFLANLSLADACFVSTTVPKMLANIQIQSQAISYSGCLLQLYFFMLFVMLEAFLLAVMAYDCYVAICHPLHYILIMSPGLCIFLVSASWIMNALHSLLHTLLMNSLSFCANHEIPHFFCDINPLLSLSCTDPFTNELVIFITGGLTGLICVLCLIISYTNVFSTILKIPSAQGKRKAFSTCSSHLSVVSLFFGTSFCVDFSSPSTHSAQKDTVASVMYTVVTPMLNPFIYSLRNQEIKSSLRKLIWVRKIHSP

SEQ ID NO: 3017 - protein, 355 aa, unidentified
MEPEKQTEISEFFLQGLSEKPEHQTLLFTMFLSTYLVTIIGNALIILAIITDSHLHTPMYFFLFNLSLVDTLLSSTTVPKMLANIQAQSRAIPFVGCLTQMYAFHLFGTMDSFLLAVMAIDRFVAIVHPQRYLVLMCSPVCGLLLGASWMITNLQSLIHTCLMAQLTFCAGSEISHFFCDLMPLLKLSGSDTHTNELVIFAFGIVVGTSPFSCILLSYIRIFWTVFKIPSTRGKWKAFSTCGLHLTVVSLSYGTIFAVYLQPTSPSSSQKDKAAALMCGVFIPMLNPFIYSIRNKDMKAALGKLIGKVAVPCPRPEQLLDVYHVPGSLLAARDTEMHPIPYPGGVQSLAGNRDME

SEQ ID NO: 3018 - protein, 322 aa, unidentified
MSPENQSSVSEFLLLGLPIRPEQQAVFFALFLGMYLTTVLGNLLIMLLIQLDSHLHTPMYFFLSHLALTDISFSSVTVPKMLMNMQTQHLAVFYKGCISQTYFFIFFADLDSFLITSMAYDRYVAICHPLHYATIMTQSQCVMLVAGSWVIACACALLHTLLLAQLSFCADHIIPHYFCDLGALLKLSCSDTSLNQLAIFTAALTAIMLPFLCILVSYGHIGVTILQIPSTKGICKALSTCGSHLSVVTIYYRTIIGLYFLPPSSNTNDKNIIASVIYTAVTPMLNPFIYSLRNKDIKGALRKLLSRSGAVAHACNLNTLGG

SEQ ID NO: 3019 - protein, 313 aa, unidentified
MSPENQSSVSEFLLLGLPIRPEQQAVFFTLFLGMYLTTVLGNLLIMLLIQLDSHLHTPMYFFLSHLALTDISFSSVTVPKMLMDMRTKYKSILYEECISQMYFFIFFTDLDSFLITSMAYDRYVAICHPLHYTVIMREELCVFLVAVSWILSCASSLSHTLLLTRLSFCAANTIPHVFCDLAALLKLSCSDIFLNELVMFTVGVVVITLPFMCILVSYGYIGATILRVPSTKGIHKALSTCGSHLSVVSLYYGSIFGQYLFPTVSSSIDKDVIVALMYTVVTPMLNPFIYSLRNRDMKEALGKLFSRATFFSW

SEQ ID NO: 3020 - protein, 313 aa, unidentified
MKRENQSSVSEFLLLDLPIWPEQQAVFFTLFLGMYLITVLGNLLIILLIRLDSHLHTPMFFFLSHLALTDISLSSVTVPKMLLSMQTQDQSILYAGCVTQMYFFIFFTDLDNFLLTSMAYDRYVAICHPLRYTTIMKEGLCNLLVTVSWILSCTNALSHTLLLAQLSFCADNTIPHFFCDLVALLKLSCSDISLNELVIFTVGQAVITLPLICILISYGHIGVTILKAPSTKGIFKALSTCGSHLSVVSLYYGTIIGLYFLPSSSASSDKDVIASVMYTVITPLLNPFIYSLRNRDIKGALERLFNRATVLSQ

SEQ ID NO: 3021 - protein, 316 aa, unidentified
MEAANESSEGISFVLLGLTTSPGQQRPLFVLFLLLYVASLLGNGLIVAAIQASPALHAPMYFLLAHLSFADLCFASVTVPKMLANLLAHDHSISLAGCLTQMYFFFALGVTDSCLLAAMAYDCYVAIRHPLPYATRMSRAMCAALVGMAWLVSHVHSLLYILLMARLSFCASHQVPHFFCDHQPLLRLSCSDTHHIQLLIFTEGAAVVVTPFLLILASYGAIAAAVLQLPSASGRLRAVSTCGSHLAVVSLFYGTVIAVYFQATSRREAEWGRVATVMYTVVTPMLNPIIYSLWNRDVQGALRALLIGRRISASDS

SEQ ID NO: 3022 - protein, 360 aa, unidentified
MERNHNPDNCNVLNFFFADKKNKRRNFGQIVSDVGRICYSVSLSLGEPTTMGRNNLTRPSEFILLGLSSRPEDQKPLFAVFLPIYLITVIGNLLIILAIRSDTRLQTPMYFFLSILSFVDICYVTVIIPKMLVNFLSETKTISYSECLTQMYFFLAFGNTDSYLLAAMAIDRYVAICNPFHYITIMSHRCCVLLLVLSFCIPHFHSLLHILLTNQLIFCASNVIHHFFCDDQPVLKLSCSSHFVKEITVMTEGLAVIMTPFSCIIISYLRILITVLKIPSAAGKRKAFSTCGSHLTVVTLFYGSISYLYFQPLSNYTVKDQIATIIYTVLTPMLNPFIYSLRNKDMKQGLAKLMHRMKCQ

SEQ ID NO: 3023 - protein, 324 aa, unidentified
MGMSNLTRLSEFILLGLSSRSEDQRPLFALFLIIYLVTLMGNLLIILAIHSDPRLQNPMYFFLSILSFADICYTTVIVPKMLVNFLSEKKTISYAECLAQMYFFLVFGNIDSYLLAAMAINRCVAICNPFHYVTVMNRRCCVLLLAFPITFSYFHSLLHVLLVNRLTFCTSNVIHHFFCDVNPVLKLSCSSTFVNEIVAMTEGLASVMAPFVCIIISYLRILIAVLKIPSAAGKHKAFSTCSSHLTVVILFYGSISYVYLQPLSSYTVKDRIATINYTVLTSVLNPFIYSLRNKDMKRGLQKLINKIKSQMSRFSTKTNKICGP

SEQ ID NO: 3024 - protein, 311 aa, unidentified
METKNYSSSTSGFILLGLSSNPKLQKPLFAIFLIMYLLTAVGNVLIILAIYSDPRLHTPMYFFLSNLSFMDICFTTVIVPKMLVNFLSETKIISYVGCLIQMYFFMAFGNTDSYLLASMAIDRLVAICNPLHYDVVMKPWHCLLMLLGSCSISHLHSLFRVLLMSRLSFCASHIIKHFFCDTQPVLKLSCSDTSSSQMVVMTETLAVIVTPFLCTIFSYLQIIVTVLRIPSAAGKWKAFSTCGSHLTVVVLFYGSVIYVYFRPLSMYSVMKGRVATVMYTVVTPMLNPFIYSLRNKDMKRGLKKLRHRIYS

SEQ ID NO: 3025 - protein, 347 aa, unidentified
MSYFYRLKLMKEAVLVKLPFTSLPLLLQTLSRKSRDMEIKNYSSSTSGFILLGLSSNPQLQKPLFAIFLIMYLLAAVGNVLIIPAIYSDPRLHTPMYFFLSNLSFMDICFTTVIVPKMLVNFLSETKVISYVGCLAQMYFFMAFGNTDSYLLASMAIDRLVAICNPLHYDVVMKPRHCLLMLLGSCSISHLHSLFRVLLMSRLSFCASHIIKHFFCDTQPVLKLSCSDTSSSQMVVMTETLAVIVTPFLCIIFSYLRIMVTVLRIPSAAGKWKAFSTCGSHLTAVALFYGSIIYVYFRPLSMYSVVRDRVATVMYTVVTPMLNPFIYSLRNKDMKRGLKKLQDRIYR

SEQ ID NO: 3026 - protein, 309 aa, unidentified
MERINHTSSVSEFILLGLSSRPEDQKTLFVLFLIVYLVTITGNLLIILAIRFNPHLQTPMYFFLSFLSLTDICFTTSVVPKMLMNFLSEKKTISYAGCLTQMYFLYALGNSDSCLLAVMAFDRYVAVCDPFHYVTTMSHHHCVLLVAFSCSFPHLHSLLHTLLLNRLTFCDSNVIHHFLCDLSPVLKLSCSSIFVNEIVQMTEAPIVLVTRFLCIAFSYIRILTTVLKIPSTSGKRKAFSTCGFYLTVVTLFYGSIFCVYLQPPSTYAVKDHVATIVYTVLSSMLNPFIYSLRNKDLKQGLRKLMSKRS

SEQ ID NO: 3027 - protein, 313 aa, unidentified
MEPRNQTSASQFILLGLSEKPEQETLLFSLFFCMYLVMVVGNLLIILAISIDSHLHTPMYFFLANLSLVDFCLATNTIPKMLVSLQTGSKAISYPCCLIQMYFFHFFGIVDSVIIAMMAYDRFVAICHPLHYAKIMSLRLCRLLVGALWAFSCFISLTHILLMARLVFCGSHEVPHYFCDLTPILRLSCTDTSVNRIFILIVAGMVIATPFVCILASYARILVAIMKVPSAGGRKKAFSTCSSHLSVVALFYGTTIGVYLCPSSVLTTVKEKASAVMYTAVTPMLNPFIYSLRNRDLKGALRKLVNRKITSSS

SEQ ID NO: 3028 - protein, 311 aa, unidentified
MENQSSISEFFLRGISAPPEQQQSLFGIFLCMYLVTLTGNLLIILAIGSDLHLHTPMYFFLANLSFVDMGLTSSTVTKMLVNIQTRHHTISYTGCLTQMYFFLMFGDLDSFFLAAMAYDRYVAICHPLCYSTVMRPQVCALMLALCWVLTNIVALTHTFLMARLSFCVTGEIAHFFCDITPVLKLSCSDTHINEMMVFVLGGTVLIVPFLCIVTSYIHIVPAILRVRTRGGVGKAFSTCSSHLCVVCVFYGTLFSAYLCPPSIASEEKDIAAAAMYTIVTPMLNPFIYSLRNKDMKGALKRLFSHRSIVSS

SEQ ID NO: 3029 - protein, 330 aa, unidentified
MEGFYLRRSHELQGMGKPGRVNQTTVSDFLLLGLSEWPEEQPLLFGIFLGMYLVTMVGNLLIILAISSDPHLHTPMYFFLANLSLTDACFTSASIPKMLANIHTQSQIISYSGCLAQLYFLLMFGGLDNCLLAVMAYDRYVAICQPLHYSTSMSPQLCALMLGVCWVLTNCPALMHTLLLTRVAFCAQKAIPHFYCDPSALLKLACSDTHVNELMIITMGLLFLTVPLLLIVFSYVRIFWAVFVISSPGGRWKAFSTCGSHLTVVLLFYGSLMGVYLLPPSTYSTERESRAAVLYMVIIPTLNPFIYSLRNRDMKEALGKLFVSGKTFFL

SEQ ID NO: 3030 - protein, 314 aa, unidentified
MDNSNWTSVSHFVLLGISTHPEEQIPLFLVFSLMYAINISGNLAIITLILSAPRLHIPMYIFLSNLALTDICFTSTTVPKMLQIIFSPTKVISYTGCLAQTYFFICFAVMENFILAVMAYDRYIAICHPFHYTMILTRMLCVKMVVMCHALSHLHAMLHTFLIGQLIFCADNRIPHFFCDLYALMKISCTSTYLNTLMIHTEGAVVISGALAFITASYACIILVVLRIPSAKGRWKTFSTCGSHLTVVAIFYGTLSWVYFRPLSSYSVTKGRIITVVYTVVTPMLNPFIYSLRNGDVKGGFMKWMSRMQTFFFR

SEQ ID NO: 3031 - protein, 325 aa, unidentified
MKTLCSFLQISRNMHQENQTTITEFILLGLSNQAEHQNLLFVLFLSMYVVTVVGNGLIIVAISLDIYLHTPMYLFLAYLSFADISSISNSVPKMLVNIQTNSQSISYESCITQMYFSIVFVVTDNLLLGTMAFDHFVAICHPLNYTTFMRARFGTLLTVISWFLSNIIALTHTLLLIQLLFCDHNTLPHFFCDLAPLLKLSCSDTMINELVLFIVGLSVIIFPFVLIFFSYVCIIRAVLGVSSTQGKWKAFSTCGSHLTIALLFYGTTVGVYFFPSSTHPEDTDKIGAVLFTVVTPMMNPFIYSLRNKDMKGALRKLINRKISSL

SEQ ID NO: 3032 - protein, 310 aa, unidentified
MGENQTMVTEFLLLGFLLGPRIQMLLFGLFSLFYIFTLLGNGAILGLISLDSRLHTPMYFFLSHLAVVDIAYTRNTVPQMLANLLHPAKPISFAGCMTQTFLCLSFGHSECLLLVLMSYDRYVAICHPLRYSVIMTWRVCITLAVTSWTCGSLLALAHVVLILRLPFSGPHEINHFFCEILSVLRLACADTWLNQVVIFAACVFFLVGPPSLVLVSYSHILAAILRIQSGEGRRKAFSTCSSHLCVVGLFFGSAIIMYMAPKSRHPEEQQKVFFLFYSFFNPTLNPLIYSLRNGEVKGALRRALGKESHS

SEQ ID NO: 3033 - protein, 310 aa, unidentified
MESNQTWITEVILLGFQVDPALELFLFGFFLLFYSLTLMGNGIILGLIYLDSRLHTPMYVFLSHLAIVDMSYASSTVPKMLANLVMHKKVISFAPCILQTFLYLAFAITECLILVMMCYDRYVAICHPLQYTLIMNWRVCTVLASTCWIFSFLLALVHITLILRLPFCGPQKINHFFCQIMSVFKLACADTRLNQVVLFAGSAFILVGPLCLVLVSYLHILVAILRIQSGEGRRKAFSTCSSHLCVVGLFFGSAIVMYMAPKSSHSQERRKILSLFYSLFNPILNPLIYSLRNAEVKGALKRVLWKQRSM

SEQ ID NO: 3034 - protein, 310 aa, unidentified
MEGNKTWITDITLPRFQVGPALEILLCGLFSAFYTLTLLGNGVIFGIICLDCKLHTPMYFFLSHLAIVDISYASNYVPKMLTNLMNQESTISFFPCIMQTFLYLAFAHVECLILVVMSYDRYADICHPLRYNSLMSWRVCTVLAVASWVFSFLLALVPLVLILSLPFCGPHEINHFFCEILSVLKLACADTWLNQVVIFAACVFILVGPLCLVLVSYLRILAAILRIQSGEGRRKAFSTCSSHLCVVGLFFGSAIVTYMAPKSRHPEEQQKVLSLFYSLFNPMLNPLIYSLRNAEVKGALRRALRKERLT

SEQ ID NO: 3035 - protein, 318 aa, unidentified
MEGNQTWITDITLLGFQVGPALAILLCGLFSVFYTLTLLGNGVIFGIICLDSKLHTPMYFFLSHLAIIDMSYASNNVPKMLANLMNQKRTISFVPCIMQTFLYLAFAVTECLILVVMSYDRYVAICHPFQYTVIMSWRVCTILVLTSWSCGFALSLVHEILLLRLPFCGPRDVNHLFCEILSVLKLACADTWVNQVVIFATCVFVLVGPLSLILVSYMHILGAILKIQTKEGRIKAFSTCSSHLCVVGLFFGIAMVVYMVPDSNQREEQEKMLSLFHSVFNPMLNPLIYSLRNAQLKGALHRALQRKRSMRTVYGLCL

SEQ ID NO: 3036 - protein, 310 aa, unidentified
MGGNQTSITEFLLLGFPIGPRIQMLLFGLFSLFYIFILLGNGTILGLISLDSRLHTPMYFFLSHLAVVDIACACSTVPQMLVNLLHPAKPISFAGCMTQMFLFLSFAHTECLLLVVMSYDRYVAICHPLRYSTIMTWKVCITLALTSWILGVLLALVHLVLLLPLSFCGPQKLNHFFCEIMAVLKLACADTHINEVMVLAGAVSVLVGAFFSTVISYVHILCAILKIQSGEGCQKAFSICSSHLCVVGLFYGTAIIMYVEPQYESPKEQKKYLLLFHSLFNPMLNPLIYSLRNKEVQGTLKRMLEKKRTS

SEQ ID NO: 3037 - protein, 310 aa, unidentified
MGDNITSIREFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLAIMTWRVCITLAVTSWTTGVLLSLIHLVLLLPLPFCRPQKIYHFFCEILAVLKLACADTHINENMVLAGAISGLVGPLSTIVVSYMCILCAILQIQSREVQRKAFRTCFSHLCVIGLVYGTAIIMYVGPRYGNPKEQKKYLLLFHSLFNPMLNPLICSLRNSEVKNTLKRVLGVERAL

SEQ ID NO: 3038 - protein, 310 aa, unidentified; identical to SEQ ID NO: 3032

SEQ ID NO: 3039 - protein, 311 aa, unidentified
MTKNQTWVTEFILLGFPLSLRIQMLLSGLFSLLYVFTLLGNGAILGLIWLDSRLHTPMYFFLSHLAIIDISYASNNVPKMLTNLGLNKRKTISFVPCTMQTFLYMAFAHTECLILVMMSYDRYMAICHPLQYSVIMRWGVCTVLAVTSWACGSLLALVHVVLILRLPFCGPHEINHFFCEILSVLKLACADTWLNQVVIFAASVFILVGPLCLVLVSYSRILAAILRIQSGEGRRKAFSTCSSHLCMVGLFFGSAIVMYMAPKSRHPEEQQKVLSLFYSLFNPMLNPLIYSLRNAEVKGALKRVLWKQRSK

SEQ ID NO: 3040 - protein, 310 aa, unidentified
MGDNITSITEFLLLGFPVGPRIQMLLFGLFSLFYVFTLLGNGTILGLISLDSRLHAPMYFFLSHLAVVDIAYACNTVPRMLVNLLHPAKPISFAGRMMQTFLFSTFAVTECLLLVVMSYDLYVAICHPLRYLAIMTWRVCITLAVTSWTTGVLLSLIHLVLLLPLPFCRPQKIYHFFCEILAVLKLACADTHINENMVLAGAISGLVGPLSTIVVSYMCILCAILQIQSREVQRKAFCTCFSHLCVIGLFYGTAIIMYVGPRYGNPKEQKKYLLLFHSLFNPMLNPLICSLRNSEVKNTLKRVLGVERAL

SEQ ID NO: 3041 - protein, 323 aa, unidentified
MWQKNQTSLADFILEGLFDDSLTHLFLFSLTMVVFLIAVSGNTLTILLICIDPQLHTPMYFLLSQLSLMDLMHVSTIILKMATNYLSGKKSISFVGCATQHFLYLCLGGAECFLLAVMSYDRYVAICHPLRYAVLMNKKVGLMMAVMSWLGASVNSLIHMAILMHFPFCGPRKVYHFYCEFPAVVKLVCGDITVYETTVYISSILLLLPIFLISTSYVFILQSVIQMRSSGSKRNAFATCGSHLTVVSLWFGACIFSYMRPRSQCTLLQNKVGSVFYSIITPTLNSLIYTLRNKDVAKALRRVLRRDVITQCIQRLQLWLPRV

SEQ ID NO: 3042 - protein, 316 aa, unidentified
MELRNSTLGSGFILVGILNDSGSPELLYATFTILYMLALTSNGLLLLAITIEARLHMPMYLLLGQLSLMDLLFTSVVTPKALADFLRRENTISFGGCALQMFLALTMGSAEDLLLAFMAYDRYVAICHPLKYMTLMSPRVCWIMVATSWILASLIAIGHTMYTMHLPFCVSWEIRHLLCEIPPLLKLACADTSRYELIIYVTGVTFLLLPISAIVASYTLVLFTVLRMPSNEGRKKALVTCSSHLIVVGMFYGAATFMYVLPSSFHSPKQDNIISVFYTIVTPALNPLIYSLRNKEVMRALRRVLGKYILLAHSTL

SEQ ID NO: 3043 - protein, 335 aa, unidentified
MNISDVISFDILVSAMKTGNQSFGTDFLLVGLFQYGWINSLLFVVIATLFTVALTGNIMLIHLIRLNTRLHTPMYFLLSQLSIVDLMYISTTVPKMAVSFLSQSKTIRFLGCEIQTYVFLALGGTEALLLGFMSYDRYVAICHPLHYPMLMSKKICCLMVACAWASGSINAFIHTLYVFQLPFCRSRLINHFFCEVPALLSLVCQDTSQYEYTVLLSGLIILLLPFLAILASYARVLIVVFQMSSGKGQAKAVSTCSSHLIVASLFYATTLFTYTRPHSLRSPSRDKAVAVFYTIVTPLLNPFIYSLRNKEVTGAVRRLLGYWICCRKYDFRSLY

SEQ ID NO: 3044 - protein, 309 aa, unidentified
MKNKTVLTEFILLGLTDVPELQVAVFTFLFLAYLLSILGNLTILILTLLDSHLQTPMYFFLRNFSFLEISFTNIFIPRVLISITTGNKSISFAGCFTQYFFAMFLGATEFYLLAAMSYDRYVAICKPLHYTTIMSSRICIQLIFCSWLGGLMAIIPTITLMSQQDFCASNRLNHYFCDYEPLLELSCSDTSLIEKVVFLVASVTLVVTLVLVILSYAFIIKTILKLPSAQQRTKAFSTCSSHMIVISLSYGSCMFMYINPSAKEGDTFNKGVALLITSVAPLLNPFIYTLRNQQVKQPFKDMVKKLLNL

SEQ ID NO: 3045 - protein, 320 aa, unidentified
MDATACNESVDGSPVFYLLGIPSLPETFFLPVFFIFLLFYLLILMGNALILVAVVAEPSLHKPMYFFLINLSTLDILFTTTTVPKMLSLFLLGDRFLSFSSCLLQMYLFQSFTCSEAFILVVMAYDRYVAICHPLHYPVLMNPQTNATLAASAWLTALLLPIPAVVRTSQMAYNSIAYIYHCFCDHLAVVQASCSDTTPQTLMGFCIAMVVSFLPLLLVLLSYVHILASVLRISSLEGRAKAFSTCSSHLLVVGTYYSSIAIAYVAYRADLPLDFHIMGNVVYAILTPILNPLIYTLRNRDVKAAITKIMSQDPGCDRSI

SEQ ID NO: 3046 - protein, 317 aa, unidentified
MKSDNHSFLGDSPKAFILLGVSDRPWLELPLFVVLLLSYVLAMLGNVAIILASRVDPQLHSPMYIFLSHLSFLDLCYTTTTVPQMLVNMGSSQKTISYGGCTVQYAVFHWLGCTECIVLAAMALDRYVAICKPLHYAVLMHRALCQQLVALAWLSGFGNSFVQVVLTVQLPFCGRQVLNNFFCEVPAVIKLSCADTAVNDTILAVLVAFFVLVPLALILLSYGFIARAVLRIQSSKGRHKAFGTCSSHLMIVSLFYLPAIYMYLQPPSSYSQEQGKFISLFYSIITPTLNPFTYTLRNKDMKGALRRLLARIWRLCG

SEQ ID NO: 3047 - protein, 357 aa, unidentified
MNWVNKSVPQEFILLVFSDQPWLEIPPFVMFLFSYILTIFGNLTIILVSHVDFKLHTPMYFFLSNLSLLDLCYTTSTVPQMLVNICNTRKVISYGGCVAQLFIFLALGSTECLLLAVMCFDRFVAICRPLHYSIIMHQRLCFQLAAASWISGFSNSVLQSTWTLKMPLCGHKEVDHFFCEVPALLKLSCVDTTANEAELFFISVLFLLIPVTLILISYAFIVQAVLRIQSAEGQRKAFGTCGSHLIVVSLFYGTAISMYLQPPSPSSKDRGKMVSLFCGIIAPMLNPLIYTLRNKEVKEAFKRLVAKSLLNQEIRNMQMISFAKDTVLTYLTNFSASCPIFVITIENYCNLPQRKFP

SEQ ID NO: 3048 - protein, 313 aa, unidentified
MNWENESSPKEFILLGFSDRAWLQMPLFVVLLISYTITIFGNVSIMMVCILDPKLHTPMYFFLTNLSILDLCYTTTTVPHMLVNIGCNKKTISYAGCVAHLIIFLALGATECLLLAVMSFDRYVAVCRPLHYVVIMNYWFCLRMAAFSWLIGFGNSVLQSSLTLNMPRCGHQEVDHFFCEVPALLKLSCADTKPIEAELFFFSVLILLIPVTLILISYGFIAQAVLKIRSAEGRQKAFGTCGSHMIVVSLFYGTAIYMYLQPPSSTSKDWGKMVSLFYGIITSMLNSLIYSLRNKDMKEAFKRLMPRIFFCKK

SEQ ID NO: 3049 - protein, 313 aa, unidentified
MNWVNDSIIQEFILLGFSDRPWLEFPLLVVFLISYTVTIFGNLTIILVSRLDTKLHTPMYFFLTNLSLLDLCYTTCTVPQMLVNLCSIRKVISYRGCVAQLFIFLALGATEYLLLAVMSFDRFVAICRPLHYSVIMHQRLCLQLAAASWVTGFSNSVWLSTLTLQLPLCDPYVIDHFLCEVPALLKLSCVETTANEAELFLVSELFHLIPLTLILISYAFIVRAVLRIQSAEGRQKAFGTCGSHLIVVSLFYSTAVSVYLQPPSPSSKDQGKMVSLFYGIIAPMLNPLIYTLRNKEVKEGFKRLVARVFLIKK

SEQ ID NO: 3050 - protein, 312 aa, unidentified
MDGVNDSSLQGFVLMGISDHPQLEMIFFIAILFSYLLTLLGNSTIILLSRLEARLHTPMYFFLSNLSSLDLAFATSSVPQMLINLWGPGKTISYGGCITQLYVFLWLGATECILLVVMAFDRYVAVCRPLRYTAIMNPQLCWLLAVIACLGGLGNSVIQSTFTLQLPLCGHRRVEGFLCEVPAMIKLACGDTSLNQAVLNGVCTFFTAVPLSIIVISYCLIAQAVLKIRSAEGRRKAFNTCLSHLLVVFLFYGSASYGYLLPAKNSKQDQGKFISLFYSLVTPMVNPLIYTLRNMEVKGALRRLLGKGREVG

SEQ ID NO: 3051 - protein, 320 aa, unidentified
MMEIANVSSPEVFVLLGFSTRPSLETVLFIVVLSFYMVSILGNGIIILVSHTDVHLHTPMYFFLANLPFLDMSFTTSIVPQLLANLWGPQKTISYGGCVVQFYISHWLGATECVLLATMSYDRYAAICRPLHYTVIMHPQLCLGLALASWLGGLTTSMVGSTLTMLLPLCGNNCIDHFFCEMPLIMQLACVDTSLNEMEMYLASFVFVVLPLGLILVSYGHIARAVLKIRSAEGRRKAFNTCSSHVAVVSLFYGSIIFMYLQPAKSTSHEQGKFIALFYTVVTPALNPLIYTLRNTEVKSALRHMVLENCCGSAGKLAQI

SEQ ID NO: 3052 - protein, 308 aa, unidentified
MRQINQTQVTEFLLLGLSDGPHTEQLLFIVLLGVYLVTVLGNLLLISLVHVDSQLHTPMYFFLCNLSLADLCFSTNIVPQALVHLLSRKKVIAFTLCAARLLFFLIFGCTQCALLAVMSYDRYVAICNPLRYPNIMTWKVCVQLATGSWTSGILVSVVDTTFILRLPYRGSNSIAHFFCEAPALLILASTDTHASEMAIFLMGVVILLIPVFLILVSYGRIIVTVVKMKSTVGSLKAFSTCGSHLMVVILFYGSAIITYMTPKSSKQQEKSVSVFYAIVTPMLNPLIYSLRNKDVKAALRKVATRNFP

SEQ ID NO: 3053 - protein, 330 aa, unidentified
MCSFFLCQTGKQAKISMGEENQTFVSKFIFLGLSQDLQTQILLFILFLIIYLLTVLGNQLIIILIFLDSRLHTPMYFFLRNLSFADLCFSTSIVPQVLVHFLVKRKTISFYGCMTQIIVFLLVGCTECALLAVMSYDRYVAVCKPLYYSTIMTQRVCLWLSFRSWASGALVSLVDTSFTFHLPYWGQNIINHYFCEPPALLKLASIDTYSTEMAIFSMGVVILLAPVSLILGSYWNIISTVIQMQSGEGRLKAFSTCGSHLIVVVLFYGSGIFTYMRPNSKTTKELDKMISVFYTAVTPMLNPIIYSLRNKDVKGALRKLVGRKCFSHRQ

SEQ ID NO: 3054 - protein, 317 aa, unidentified
MEIDNQTWVREFILLGLSSDWCTQISLFSLFLVTYLMTVLGNCLIVLLIRLDSRLHTPMYFFLTNLSLVDVSYATSVVPQLLAHFLAEHKAIPFQSCAAQLFFSLALGGIEFVLLAVMAYDRHVAVSDRLRYSAIMHGGLCARLAITSWVSGSINSLVQTAITFQLPMCTNKFIDHISCELLAVVRLACVDTSSNEAAIMVSSIVLLMTPFCLVLLSYIRIISTILKIQSREGRKKAFHTCASHLTVVALCYGTTIFTYIQPHSGPSVLQEKLISVFYAIVMPLLNPVIYSLRNKEVKGAWHKLLEKFSGLTSKLGT

SEQ ID NO: 3055 - protein, 317 aa, unidentified
MGMVRHTNESNLAGFILLGFSDYPQLQKVLFVLILILYLLTILGNTTIILVSRLEPKLHMPMYFFLSHLSFLYRCFTSSVIPQLLVNLWEPMKTIAYGGCLVHLYNSHALGSTECVLPAVMSCDRYVAVCRPLHYTVLMHIHLCMALASMAWLSGIATTLVQSTLTLQLPFCGHRQVDHFICEVPVLIKLACVGTTFNEAELFVASILFLIVPVSFILVSSGYIAHAVLRIKSATRRQKAFGTCFSHLTVVTIFYGTIIFMYLQPAKSRSRDQGKFVSLFYTVVTRMLNPLIYTLRIKEVKGALKKVLAKALGVNIL

SEQ ID NO: 3056 - protein, 309 aa, unidentified
MGLGNESSLMDFILLGFSDHPRLEAVLFVFVLFFYLLTLVGNFTIIIISYLDPPLHTPMYFFLSNLSLLDICFTTSLAPQTLVNLQRPKKTITYGGCVAQLYISLALGSTECILLADMALDRYIAVCKPLHYVVIMNPRLCQQLASISWLSGLASSLIHATFTLQLPLCGNHRLDHFICEVPALLKLACVDTTVNELVLFVVSVLFVVIPPALISISYGFITQAVLRIKSVEARHKAFSTCSSHLTVVIIFYGTIIYVYLQPSDSYAQDQGKFISLFYTMVTPTLNPIIYTLRNKDMKEALRKLLSGKL

SEQ ID NO: 3057 - protein, 316 aa, unidentified
MEETNNSSEKGFLLLGFSDQPQLERFLFAIILYFYVLSLLGNTALILVCCLDSRLHTPMYFFLSNLSCVDICFTTSVAPQLLVTMNKKDKTMSYGGCVAQLYVAMGLGSSECILLAVMAYDRYAAVCRPLRYIAIMHPRFCASLAGGAWLSGLITSLIQCSLTVQLPLCGHRTLDHIFCEVPVLIKLACVDTTFNEAELFVASVVFLIVPVLLILVSYGFITQAVLRIKSAAGRQKAFGTCSSHLVVVIIFYGTIIFMYLQPANRRSKNQGKFVSLFYTIVTPLLNPIIYTLRNKDVKGALRTLILGSAAGQSHKD

SEQ ID NO: 3058 - protein, 316 aa, unidentified
MVNQSSPMGFLLLGFSEHPALERTLFVVVFTSYLLTLVGNTLIILLSVLYPRLHSPMYFFLSDLSFLDLCFTTSCVPQMLVNLWGPKKTISFLGCSVQLFIFLSLGTTECILLTVMAFDRYVAVCQPLHYATIIHPRLCWQLASVAWVMSLVQSIVQTPSTLHLPFCPHQQIDDFLCEVPSLIRLSCGDTSYNEIQLAVSSVIFVVVPLSLILASYGATAQAVLRINSATAWRKAFGTCSSHLTVVTLFYSSVIAVYLQPKNPYAQGRGKFFGLFYAVGTPSLNPLVYTLRNKEIKRALRRLLGKERDSRESWRAA

SEQ ID NO: 3059 - protein, 312 aa, unidentified
MVNQSSTPGFLLLGFSEHPGLERTLFVVVLTSYLLTLVGNTLIILLSALDPKLHSPMYFFLSNLSFLDLCFTTSCVPQMLVNLWGPKKTISFLDCSVQIFIFLSLGTTECILLTVMAFDRYVAVCQPLHYATIIHPRLCWQLASVAWVIGLVESVVQTPSTLHLPFCPDRQVDDFVCEVPALIRLSCEDTSYNEIQVAVASVFILVVPLSLILVSYGAITWAVLRINSAKGRRKAFGTCSSHLTVVTLFYSSVIAVYLQPKNPYAQERGKFFGLFYAVGTPSLNPLIYTLRNKEVTRAFRRLLGKEMGLTQS

SEQ ID NO: 3060 - protein, 312 aa, unidentified
MMIKKNASSEDFFILLGFSNWPQLEVVLFVVILIFYLMTLTGNLFIIILSYVDSHLHTPMYFFLSNLSFLDLCHTTSSIPQLLVNLRGPEKTISYAGCMVQLYFVLALGIAECVLLVVMSYDRYVAVCRPLHYTVLMHPRFCHLLAAASWVIGFTISALHSSFTFWVPLCGHRLVDHFFCEVPALLRLSCVDTHANELTLMVMSSIFVLIPLILILTAYGAIARAVLSMQSTTGLQKVFRTCGAHLMVVSLFFIPVMCMYLQPPSENSPDQGKFIALFYTVVTPSLNPLIYTLRNKHVKGAAKRLLGWEWGK

SEQ ID NO: 3061 - protein, 311 aa, unidentified
MNDDGKVNASSEGYFILVGFSNWPHLEVVIFVVVLIFYLMTLIGNLFIIILSYLDSHLHTPMYFFLSNLSFLDLCYTTSSIPQLLVNLWGPEKTISYAGCMIQLYFVLALGTTECVLLVVMSYDRYAAVCRPLHYTVLMHPRFCHLLAVASWVSGFTNSALHSSFTFWVPLCGHRQVDHFFCEVPALLRLSCVDTHVNELTLMITSSIFVLIPLILILTSYGAIVRAVLRMQSTTGLQKVFGTCGAHLMAVSLFFIPAMCIYLQPPSGNSQDQGKFIALFYTVVTPSLNPLIYTLRNKVVRGAVKRLMGWE

SEQ ID NO: 3062 - protein, 316 aa, unidentified
MQGENFTIWSIFFLEGFSQYPGLEVVLFVFSLVMYLTTLLGNSTLILITILDSRLKTPMYLFLGNLSFMDICYTSASVPTLLVNLLSSQKTIIFSGCAVQMYLSLAMGSTECVLLAVMAYDRYVAICNPLRYSIIMNRCVCARMATVSWVTGCLTALLETSFALQIPLCGNLIDHFTCEILAVLKLACTSSLLMNTIMLVVSILLLPIPMLLVCISYIFILSTILRITSAEGRNKAFSTCGAHLTVVILYYGAALSMYLKPSSSNAQKIDKIISLLYGVLTPMLNPIIYSLRNKEVKDAMKKLLGKITLHQTHEHL

SEQ ID NO: 3063 - protein, 312 aa, unidentified
MEKWNHTSNDFILLGLLPPNQTGIFLLCLIILIFFLASVGNSAMIHLIHVDPRLHTPMYFLLSQLSLMDLMYISTTVPKMAYNFLSGQKGISFLGCGVQSFFFLTMACSEGLLLTSMAYDRYLAICHSLYYPIRMSKMMCVKMIGGSWTLGSINSLAHTVFALHIPYCRSRAIDHFFCDVPAMLLLACTDTWVYEYMVFVSTSLFLLFPFIGITSSCGRVLFAVYHMHSKEGRKKAFTTISTHLTVVIFYYAPFVYTYLRPRNLRSPAEDKILAVFYTILTPMLNPIIYSLRNKEVLGAMRRVFGIFSFLKE

SEQ ID NO: 3064 - protein, 312 aa, unidentified
MENYNQTSTDFILLGLFPQSRIGLFVFTLIFLIFLMALIGNLSMILLIFLDIHLHTPMYFLLSQLSLIDLNYISTIVPKMVYDFLYGNKSISFTGCGIQSFFFLTLAVAEGLLLTSMAYDRYVAICFPLHYPIRISKRVCVMMITGSWMISSINSCAHTVYALCIPYCKSRAINHFFCDVPAMLTLACTDTWVYESTVFLSSTIFLVLPFTGIACSYGRVLLAVYRMHSAEGRKKAYSTCSTHLTVVSFYYAPFAYTYVRPRSLRSPTEDKILAVFYTILTPMLNPIIYSLRNKEVMGALTQVIQKIFSVKM

SEQ ID NO: 3065 - protein, 312 aa, unidentified
MENYNQTSTDFILLGFFPPSRIGLFLFILIVFIFLMALIGNLSMILLIFLDTHLHTPMYFLLSQLSLIDLNYISTIVPKMASDFLSGNKSISFTGCGIQSFFFSALGGAEALLLASMAYDRYIAICFPLHYPIRMSKRMCVLMITGSWIIGSINACAHTVYVLHIPYCQSRAINHFFCDVPAMVTLACMDTWVYEGTVFLSTTIFLVFPFIAISCSYGRVLLAVYHMKSAEGRKKAYLTCSTHLTVVTFYYAPFVYTYLRPRSLRSPTEDKVLAVFYTTLTPMLNPIIYSLRNKEVMGALTRVSQRICSGKM

SEQ ID NO: 3066 - protein, 312 aa, unidentified
MENYNQTSTDFILLGLFPPSKIGLFLFILFVLIFLMALIGNLSMILLIFLDTHLHTPMYFLLSQLSLIDLNYISTIVPKMASDFLYGNKSISFIGCGIQSFFFMTFAGAEALLLTSMAYDRYVAICFPLHYPIRMSKRMYVLMITGSWMIGSINSCAHTVYAFRIPYCKSRAINHFFCDVPAMLTLACTDTWVYEYTVFLSSTIFLVFPFTGIACSYGWVLLAVYRMHSAEGRKKAYSTCSTHLTVVTFYYAPFAYTYLCPRSLRSLTEDKVLAVFYTILTPMLNPIIYSLRNKEVMGALTRVIQNIFSVKM

SEQ ID NO: 3067 - protein, 347 aa, unidentified
MAWENQTFNSDFILLGIFNHSPPHTFLFFLVLGIFLVAFMGNSVMVLLIYLDTQLHTPMYFLLSQLSLMDLMLICTTVPKMAFNYLSGSKSISMAGCVTQIFFYISLSGSECFLLAVMAYDRYIAICHPLRYTNLMNPKICGLMATFSWILGSTDGIIDAVATFSFSFCGSREIAHFFCEFPSLLILSCNDTSIFEEVIFICCIVMLVFPVAIIIASYARVILAVIHMGSGEGRCKAFTTCSSHLMVVGMYYGAALFMYIRPTSDHSPTQDKMVSVFYTILTPMLNPLIYSLRNKEVTRAFMKILGKGKSESELPHKLYVLLFAKFFFLISIFFYDVKILALIMYIA

SEQ ID NO: 3068 - protein, 312 aa, unidentified
MARENSTFNSDFILLGIFNHSPTHTFLFFLVLAIFSVAFMGNSVMVLLIYLDTQLHTPMYLLLSQLSLMDLMLICTTVPKMAFNYLSGSKSISMAGCATQIFFYTSLLGSECFLLAVMAYDRYTAICHPLRYTNLMSPKICGLMTAFSWILGSTDGIIDVVATFSFSYCGSREIAHFFCDFPSLLILSCSDTSIFEKILFICCIVMIVFPVAIIIASYARVILAVIHMGSGEGRRKAFTTCSSHLLVVGMYYGAALFMYIRPTSDRSPTQDKMVSVFYTILTPMLNPLIYSLRNKEVTRAFMKILGKGKSGE

SEQ ID NO: 3069 - protein, 311 aa, unidentified
MVWENQTFNSIFILLGIFNHSPTHTFLFSLVLGIFSLALMENISMVLLIYIEKQLHTPMYFLLSQLSLMDLMLICTTLPKMIFSYLSGKKSISLAGCGTQIFFYVSLLGAECFLLAVMAYDRYVAICHPLQYTILMNPKLCVFMTVASWTLGSLDGIIVLAAVLSFSYCSSLEIHHFFCDVAALLPLSCTETSAFERLLVICCVVMLIFPVSVIILSYSHVLRAVIHMGSGESRRKAFTTCSSHLSVVGLYYGAAMFMYMRPASKHTPDQDKMVSAFYTILTPMLNPLIYSLRNKEVFRALQKVLKKRKLI

SEQ ID NO: 3070 - protein, 312 aa, unidentified
MAWENQTFNSDFILLGIFNHSPTHTFLFFLVLAIFSVAFMGNSVMVLLIYLDTQLHTPMYFLLSQLFLMDLMLICSTVPKMAFNYLSGSKSISMAGCATQIFFYVSLLGSECFLLAVMSYDRYIAICHPLRYTNLMRPKICGLMTAFSWILGSMDAIIDAVATFSFSYCGSREIAHFFCDFPSLLILSCNDTSIFEKVLFICCIVMIVFPVAIIIASYARVILAVIHMGSGEGRRKAFTTCSSHLMVVGMYYGAGLFMYIRPTSDRSPMQDKLVSVFYTILTPMLNPLIYSLRNKEVTRALRKVLGKGKCGE

SEQ ID NO: 3071 - protein, 312 aa, unidentified
MAWENQTFNSDFLLLGIFNHSPTHTFLFFLVLAIFSVAFMGNSIMVLLIYLDTQLHTPMYFLLSQLSLMDLMLICTTVPKMAFNYLSGSKSISMAGCATQIFFYISLLGSECFLLAVMSYDRYTAICHPLRYTNLMRPKICGLMTAFSWILGSTDGIIDAVATFSFSYCGSREIAHFCCDFPSLLILSCNDTSIFEEVIFICCIVMLVFPVAIIITSYARVILAVIHMGSGEGRRKAFTTCSSHLMVVGMYYGAGLFMCIQPTSHHSPMQDKMVSVFYTIVTPMLNPLIYSLRNKEVTRALMKILGKGKSGD

SEQ ID NO: 3072 - protein, 369 aa, unidentified
MWQEYYFLNVFFPLLKVCCLTINSHVVILLPWECYHLIWKILPYIGTTVGSMEEYNTSSTDFTFMGLFNRKETSGLIFAIISIIFFTALMANGVMIFLIQTDLRLHTPMYFLLSHLSLIDMMYISTIVPKMLVNYLLDQRTISFVGCTAQHFLYLTLVGAEFFLLGLMAYDRYVAICNPLRYPVLMSRRVCWMIIAGSWFGGSLDGFLLTPITMSFPFCNSREINHFFCEAPAVLKLACADTALYETVMYVCCVLMLLIPFSVVLASYARILTTVQCMSSVEGRKKAFATCSSHMTVVSLFYGAAMYTYMLPHSYHKPAQDKVLSVFYTILTPMLNPLIYSLRNKDVTGALKRALGRFKGPQRVSGGVF

SEQ ID NO: 3073 - protein, 312 aa, unidentified
MRLANQTLGGDFFLLGIFSQISHPGRLCLLIFSIFLMAVSWNITLILLIHIDSSLHTPMYFFINQLSLIDLTYISVTVPKMLVNQLAKDKTISVLGCGTQMYFYLQLGGAECCLLAAMAYDRYVAICHPLRYSVLMSHRVCLLLASGCWFVGSVDGFMLTPIAMSFPFCRSHEIQHFFCEVPAVLKLSCSDTSLYKIFMYLCCVIMLLIPVTVISVSYYYIILTIHKMNSVEGRKKAFTTCSSHITVVSLFYGAAIYNYMLPSSYQTPEKDMMSSFFYTILTPVLNPIIYSFRNKDVTRALKKMLSVQKPPY

SEQ ID NO: 3074 - protein, 320 aa, unidentified
MEMRNTTPDFILLGLFNHTRAHQVLFMMLLATVLTSLFSNALMILLIHWDHRLHRPMYFLLSQLSLMDMMLVSTTVPKMAADYLTGNKAISRAGCGVQIFFLPTLGGGECFLLAAMAYDRYAAVCHPLRYPTLMSWQLCLRMTMSSWLLGAADGLLQAVATLSFPYCGAHEIDHFFCEAPVLVRLACADTSVFENAMYICCVLMLLVPFSLILSSYGLILAAVLLMRSTEARKKAFATCSSHVAVVGLFYGAGIFTYMRPKSHRSTNHDKVVSAFYTMFTPLLNPLIYSVRNSEVKEALKRWLGTCVNLKHQQNEAHRSR

SEQ ID NO: 3075 - protein, 324 aa, unidentified
MGMEGLLQNSTNFVLTGLITHPAFPGLLFAIVFSIFVVAITANLVMILLIHMDSRLHTPMYFLLSQLSIMDTIYICITVPKMLQDLLSKDKTISFLGCAVQIFLYLTLIGGEFFLLGLMAYDRYVAVCNPLRYPLLMNRRVCLFMVVGSWVGGSLDGFMLTPVTMSFPFCRSREINHFFCEIPAVLKLSCTDTSLYETLMYACCVLMLLIPLSVISVSYTHILLTVHRMNSAEGRRKAFATCSSHIMVVSVFYGAAFYTNVLPHSYHTPEKDKVVSAFYTILTPMLNPLIYSLRNKDVAAALRKVLGRCGSSQSIRVATVIRKG

SEQ ID NO: 3076 - protein, 317 aa, unidentified
MEQSNYSVYADFILLGLFSNARFPWLLFALILLVFLTSIASNVVKIILIHIDSRLHTPMYFLLSQLSLRDILYISTIVPKMLVDQVMSQRAISFAGCTAQHFLYLTLAGAEFFLLGLMSYDRYVAICNPLHYPVLMSRKICWLIVAAAWLGGSIDGFLLTPVTMQFPFCASREINHFFCEVPALLKLSCTDTSAYETAMYVCCIMMLLIPFSVISGSYTRILITVYRMSEAEGRGKAVATCSSHMVVVSLFYGAAMYTYVLPHSYHTPEQDKAVSAFYTILTPMLNPLIYSLRNKDVTGALQKVVGRCVSSGKVTTF

SEQ ID NO: 3077 - protein, 315 aa, unidentified
MANITRMANHTGRLDFILMGLFRQSKHPALLSVVIFVVFLKALSGNAVLILLIHCDAHLHSPMYFFISQLSLMDMAYISVTVPKMLLDQVMGVNKVSAPECGMQMFLYLTLAGSEFFLLATMAYDRYVAICHPLRYPVLMNHRVCLFLASGCWFLGSVDGFMLTPITMSFPFCRSWEIHHFFCEVPAVTILSCSDTSLYETLMYLCCVLMLLIPVTIISSSYLLILLTVHRMNSAEGRKKAFATCSSHLTVVILFYGAAVYTYMLPSSYHTPEKDMMVSVFYTILTPVLNPLIYSLRNKDVMGALKKMLTVRFVL

SEQ ID NO: 3078 - protein, 318 aa, unidentified
MCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFYLTLAGAEVFLLAAMAYDRYAAVCRPLHYPLLMNQRVCQLLVSACWVLGMVDGLLLTPITMSFPFCQSRKILSFFCETPALLKLSCSDVSLYKTLMYLCCILMLLAPIMVISSSYTLILHLIHRMNSAAGHRKALATCSSHMIIVLLLFGASFYTYMLPSSYHTAEQDMMVSAFYTIFTPVLNPLIYSLRNKDVTRALRSMMQSRMNQEK

SEQ ID NO: 3079 - protein, 320 aa, unidentified
MEMRNTTPDFILLGLFNHTRAHQVLFMMVLSIVLTSLFGNSLMILLIHWDHRLHTPMYFLLSQLSLMDMMLVSTTVPKMAADYLTGSKAISRAGCGVQIFFLPTLGGGECFLLAAMAYDRYAAVCHPLRYPTLMSWQLCLRMTMSCWLLGAADGLLQAVVTLSFPYCGAHEIDHFFCETPVLVRLACADTSVFENAMYICCVLMLLVPFSLILSSYGLILAAVLHMRSTEARKKAFATCSSHVAVVGLFYGAAIFTYMRPKSHRSTNHDKVVSAFYTMFTPLLNPLIYSVKNSEVKGALKRWLGTCVNIKHQQNEAHRSR

SEQ ID NO: 3080 - protein, 318 aa, unidentified
MCSGNQTSQNQTASTDFTLTGLFAESKHAALLYTVTFLLFLMALTGNALLILLIHSEPRLHTPMYFFISQLALMDLMYLCVTVPKMLVGQVTGDDTISPSGCGIQMFFHLTLAGAEVFLLAAMAYDRYAAVCRPLHYPLLMNQRVCQLLVSACWVLGMVDGLLLTPITMSFPFCQSRKILSFFCETPALLKLSCSDVSLYKMLTYLCCILMLLTPIMVISSSYTLILHLIHRMNSAAGRRKALATCSSHMIIVLLLFGASFYTYMLRSSYHTAEQDMMVSAFYTIFTPVLNPLIYSLRNKDVTRALRSMMQSRMNQEK

SEQ ID NO: 3081 - protein, 323 aa, unidentified
MGMEGLLQNSTNFVLTGLITHPAFPGLLFAVVFSIFVVAITANLVMILLIHMDSRLHTPMYFLLSQLSIMDTIYICITVPKMLQDLLSKDKTISFLGCAVQIFYLTLIGGEFFLLGLMAYDRYVAVCNPLRYPLLMNRRVCLFMVVGSWVGGSLDGFMLTPVTMSFPFCRSREINHFFCEIPAVLKLSCTDTSLYETLMYACCVLMLLIPLSVISVSYTHILLTVHRMNSAEGRRKAFATCSSHIMVVSVFYGAAFYTNVLPHSYHTPEKDKVVSAFYTILTPMLNPLIYSLRNKDVAAALRKVLGRCGSSQSIRVATVIRKG

SEQ ID NO: 3082 - protein, 348 aa, unidentified
MDNITWMASHTGWSDFILMGLFRQSKHPMANITWMANHTGWSDFILLGLFRQSKHPALLCVVIFVVFLMALSGNAVLILLIHCDAHLHTPMYFFISQLSLMDMAYISVTVPKMLLDQVMGVNKISAPECGMQMFFYVTLAGSEFFLLATMAYDRYVAICHPLRYPVLMNHRVCLFLSSGCWFLGSVDGFTFTPITMTFPFRGSREIHHFFCEVPAVLNLSCSDTSLYEIFMYLCCVLMLLIPVVIISSSYLLILLTIHGMNSAEGRKKAFATCSSHLTVVILFYGAAIYTYMLPSSYHTPEKDMMVSVFYTILTPVVNPLIYSLRNKDVMGALKKMLTVEPAFQKAME

(The sequence listing continues in the following parts.)

What is claimed is:

1. An engineered lentivirus comprising an envelope, wherein the envelope comprises:
   (a) a viral envelope protein having at least 90% sequence identity to a sequence selected from SEQ ID NOs: 1-167 or SEQ ID NOs: 8154-16497;
   (b) a non-viral membrane-bound protein comprising:
      (i) an optional signal peptide(S),
      (ii) an extracellular targeting domain (ETD), and
      (iii) a membrane-bound domain (MBD); and
   (c) a functional modulator protein,
   wherein the functional modulator protein is different from the non-viral membrane-bound protein and is capable of binding to a target cell to modulate a function of the target cell.

2. The engineered lentivirus of claim 1, wherein the viral envelope protein has a sequence selected from SEQ ID NOs: 1-167 or SEQ ID NOs: 8154-16497.

3. The engineered lentivirus of claim 1, wherein the viral envelope protein is fused to one or more different molecules.

4. The engineered lentivirus of claim 3, wherein the one or more different molecules comprise a guide RNA and an exogenous endonuclease.

5. The engineered lentivirus of claim 1, further comprising a nucleic acid construct encapsulated in the envelope.

6. The engineered lentivirus of claim 1, wherein the functional modulator protein has at least 90%, 95%, 96%, 97%, or 99% sequence identity to a sequence selected from SEQ ID NOs: 168-8121.

7. The engineered lentivirus of claim 6, wherein the functional modulator protein has a sequence selected from SEQ ID NOs: 168-8121.

8. The engineered lentivirus of claim 1, comprising the non-viral membrane-bound protein, wherein the extracellular targeting domain (ETD) comprises a T cell receptor, antibody, MHC protein, or a modification thereof.

9. The engineered lentivirus of claim 1, wherein the non-viral membrane-bound protein has a sequence selected from SEQ ID NOs 168-8121, or a fragment thereof.

10. The engineered lentivirus of claim 8, wherein the extracellular targeting domain (ETD) comprises an antibody specific to CD3, CD4, CD5, CD7, CD8, CD19, CD20, or CD 117.

11. The engineered lentivirus of claim 1, comprising the non-viral membrane-bound protein, wherein the non-viral membrane-bound protein further comprises an Fc domain and a linker positioned between the extracellular targeting domain (ETD) and the membrane-bound domain (MBD).

12. The engineered lentivirus of claim 1, wherein the viral envelope protein comprises at least one amino acid insertion, deletion or substitution compared to a protein having a sequence selected from SEQ ID NOs: 1-167 or SEQ ID NOs: 8154-16497.

13. The engineered lentivirus of claim 5, wherein the nucleic acid construct comprises a barcode sequence, a coding sequence of a reporter protein, or a coding sequence of a transgene, optionally wherein the transgene is a therapeutic gene.

14. The engineered lentivirus of claim 5, wherein the nucleic acid construct comprises a sequence for inhibitory RNA, catalytic RNA, or CRISPR/Cas9 or other site-specific endonuclease-mediated mutagenesis.

15. A library of engineered lentivirus, comprising 10, 100, 1,000, 10,000, 100,000, 1,000,000, or 10,000,000 unique clones of the engineered lentivirus of claim 1.

16. The library of claim 15, wherein each clone of the engineered lentivirus comprises a unique nucleic acid barcode, a unique extracellular targeting domain (ETD) or a unique viral envelope protein.

* * * * *